United States Patent 9,976,180 (METHODS FOR DETECTING A GENETIC VARIATION IN SUBJECTS WITH PARKINSONISM) - sequence listing, part 28

SEQ ID NO: 415 - DNA, 979320 bp, Homo sapiens
atggatgtaaaggaccggcgacaccgctctttgaccagaggacgctgtggcaaagagtgtcgctacacaagctcctctctggacagtgaggactgccgcgtgcccacacagaaatcctacagctccagtgagactctgaaggcctatgaccatgacagcaggatgcactatggaaaccgagtcacagacctcatccaccgggagtcagatgagtttcctagacaaggtttgtagggtttcccctgctgatttgctctcaactgtctaacttacttgatttacatggttgatggctgcttttggagatccagcatggtggtttttgacagatgtaccctacagcagacccttggttccataaaggacattcctaacaacatggtgaatctctatcctgagaaacctaagattatctgtggtttctcaaaactattctcctcatagtccacttacaagcctcaaatttctattccttttcccattgggtttctcacttagattctccttgaacaaatggtgtatcttggttaaaacatctttgaaatagtgtataataatacgcccttttccctctactaaaatatgatgttaattctgagttatacgtttctctttttgtgtttcagagcatgggtggccacatgtatgttattttccaattccactgatgtaattatccctcctactttccccaagtcttaattttcctttccttatactgttttgatttcttttgggaggagaatatttttctcccaagcactaacagttggcactctcttcatgtccaatatttataaagagttctgttatcacttctccagggttgctgtaaatgcatcaacacgtagaataaagcaaagcagtgctgagaggtggtgtgacaaagctcactctctagctccatgtcttactagtcccagcctcgctgtgtgtgcactttacattgatggctcagcaaaattacaggcaaacgcacaaaactgtaccgaatgcctcgggaagggtcactctgccagtgccaaagggctaagccctgctctgctaggttattgcctcatttgttttataacactgattctttatttcttgttccatgtccttgggagtaaatgttgcaatgggtttaatttctaatgaaataacttagcttggaattctagtcctggtttctcagcttccttaaactactttttactactttttattacaaaatgtgcatgtgtgtatatatgttattaattagcactatgcccacggtttataaatctacaatccagaggttgttgtagataacatctttttatacactcctggtttaccctagcttcagcttttatatttaacataggattgaaaaaataaatcaacagagaaactgttagaattgtgtttccattgccattataactcttgcaggatacaatttttatttaatcttccttcttattttctgagttatcttcatgtaaatgaaacacatgctgatcctcctccatgagaaaatgggggcagaggctgcttgaaaattgctctggatcaaatgcctttgatctgtaacttcaacaagtgtttttgctttgttaagtcctcaccattccccaaatttcaggtagtggcaattggaaaaaaaatatgaagaatcatggcttaattaactgagagagagcttacatttccaatataataaaattgggacacctctctgttgtttcccagagctgcactaacacgagactcagatattttgaaaggtgatgcacgttcaacgtggttcaaagcctttcattttctgctgtagtttttgtctcatttacgttgttcctgcatacgtttttgtgtctcataattctgtgctgaaatgttcacttttcttcctaagttttattaaaagtgcatcctggcttctggatcattgtgcactgacatgtagattccagatgattgttgaattgtagataggcctgtcaccttttcctttattaatatttacataaaataaaaccaaggactgggattttattttcaaatatacctttattcttcctgtttagtcttgttcccctccattgataataatggaggttgcttggccatatcaaactcatagctttgcaattaacaattcacacatgccgcatgttgttattgagcccatatttgtttgtgtaatgtgtttgcatgaattaaaaactgtgcaggccaaaagtagaaataaaaagcatcagaaggtatttgcatatgcaagtgcaattccttctgaagacatctatgaatttatgcatgaaaatgtagtcagagtctgagtggatctactttgatgggttctaaaattgaactctgcaggaagtaaataagcacatatttaaggagaggaggaacaggagatacaatctggcaagcagtacattcaacttgaaacttagccactacagacagggttaaaataaattttacactcagtaataacaataatttttttaaatgtcatgcatttcccattttattttcttattcatgaaatcaaagagcaggatcatctccgtacttattagcctagaggtacattaacaaggatcatagtgggatcatctcttgcagtattcttatttaaaacccaagacactgatcataaaacaaacacacttctcacatacaaccaagttttgcaaacacagttggatgactctacagatgctcagggtggaaaagaattgccagccagcaaaagtgatgggggcccagagtcagaccttgtccagttaccccagctggcccattcaagtatcaaatgcaagaacctgccatctcccagcaggagaaatgagccaggtgttcccatgagaagtttacggaagctcggtcaaattgtgcccatctttgcttgctttcaacacagaatcctcctctgccttcttctattgtggcttcttctcttgagtatgcaaatcacctgtctggcctctattatgctggatcctcctggtgtgaaagaagaaaattgctgaccttcggtctgtggccactggagtaattagtaattagtaaatgactaatcctgcactaaatagcatcctagtggtctgagagctaatgcacctgacaaaagtgagcagtggtctgatccctggtcagacccagccctaatccaacctgtgaaatagatgccactttgaataatgaaggtcggccaagttcccaggcagtttgtacaagcttgtctttttttttggaccccggagttagggtgaagagcaatgtgatatacaagacattctcctggggcttaggagtctagagttggacgtgaattctgcttttgcatgtgtatgtgcctgggactctgctctgcattctgtgtttcatcaggattactacatggtttttaggtatattaaacaaacaacaataataacaatgacaaaggaataatggcgaacaggcgggcgcggtggctcacacctgtaatcccagcactttgggaggccgaggtgggcggatcacgaggtcaagagatggagaccatcctggctaacacggtgaaacgctatctctactaaaaatacaaaaaattagtcgggcgcggtggcgggcgcctgtagtcccagctactcagcaggctgaggcaggggaatggcgtgaacctgggaggcggagcttgcagtgagcggagatcgcgccactgcactccagcctgggcgacagagcgagactccgtctcaaaaaaaaaaaaaaaagaaaaagaaaagaataatggcgaacatttgttgagtagtttgtgtcaggagccaatctaagcattttgcttgcattaactcagttaatgctcacaacagctttgcgaggtggatactatcactcccttgtttacttatattaggaaactgagtcagagagagattaaataagtcatccaggttgaaaacatggaaagagccggagataggcttcaaacctaaggggctgtattcaagacctgtgttttaaaccaatgtgtttcatcacgtcccaaaaaaataagtaaacaaaacaaaaatatctttaaatccttagtcaaaggctgggaaggatctatgaaattcactttctaagccttttaagaatccatacctttaaatctttcttaatgatacaggaactgtagttaacagtattgattgaacatataatgttcaccaccagctcccagccctgctgatctaattcctgttctcatccattcacctccatctcacaatcattcctgactctccagaagcattcctgcctacaatacctctctaccaaccaccactgtaggaaaacgtttcgactgtagggatgtgtactgggctgtcagcactgattctatgccctcccttatggtcatcacctttttgcacaaactctcaacctggaacactaacaaagaaaggtgtcactatctaaatgatattgctcaggtaagtagaactgacttgtttctgtgctaaccaagacccagtgggccagagagttcagccagccctcttattcctcaaaaagtgcttctttccagttagcagttcaagtctctcgagagggggccaagattgaattctttctctgtacgtcaggctggctgtctaggtcaaggtcgaagaaaaaattgggggaagattgaatttttgaaagtatgcttgcatcagttctctcaatcagttaaagcaaagagataaatcctaccggctatttgatgtgctttaaaaagcatgtaaacaaaaatcaacacacatacacattttaggctaggtttggttttggtactccataaactaattcttgctcctatgatctttaaaataatgtgggcaataacttttgctctgtataatttggcataatgtacatttaaacagtgttaatgagctgaaaactcatgaaccactagtaagctagagtattacctgcaatgattcaattaacttatataataattgtgggaatactttggaaattgtaaatatttctttctatgcctttgtcttaaaatagccatttttccactatacctaaataataattaaaaggttctagtttgaaaacctcagcactttaatttacctacaaagaataccttgtagatgttagtaaagttcaagagtttctgtggtcagtatcttgaaggctgaaatgtaccttgagaagattgctttccatttattttcccacttccaggtaggacttcttttcataactcaactaagaataacacaatgccttctagtctttggttgtattgttttttcttttttaaaaaatatccttagaaaaagagaatctacaacttttcaatgttatctttttgctggataacttgaatccttgttgttttatatgggaggcatatgtgaaaagagtaatgaatgaagactctggagttcaactttgtccatatcccagtgctgatgggtaccgctagtgtgatcttgatcaaattctagaacacagactgagtctcattttctccatttgtaaaagctctaccatatataggtattgggtttatttcttacaattgtgtatttattagatctggacattatctttcttttaataagtgctagtagttatcgttacagttattgtcactttaaccctactaccagcagaagtggcgatcacttgctctccgaccctaataatactttggtgcaacagaaatttttctttcctcttgatttgtttcccatgacttgcaaaaattctgacattttcaaactcagaacttttttccagcttgttcatagagtgtgtctgactctctatccaccatacatttctttcccaaagatgaacataactcatacattattttcctatttttagacaggaatgaaagatactatctaacaactgtcaactgatgccaacacactgtaagagagttgctagtcagacaattttacaagtcaaaaaaaaaaaaaatagattggaaaaactgctctaaggtagtgtcataggatacaaacactttttttaagtgtgcattttatggcatgtaaatccatacatatttcagaaatgagtttaagagtagatttaatccatataaatgctggataaaattaatccattttcgtcactttatgggcaataatttggagtctatgtcagagagtcaatgttttggattttcatcattgatgcttactacccttctaggaatatgtctatattttttgataactttagccatttggcaactatcttcatgtttgcccaactgttatcctcccagtaattatctattgtcaattctgtgttcaactttatatttaactttctttgaattaccttccttctcctgctctttctcagtggaaattccccagagtttcaccctaatcctatactcttcttctccatagcactttctttagaacactcttattcatatgacttcagtggccactatttctgcttctgaaaactttttcatttacaaacaatagtatcccagttcaaattagcttacttgaaagggtaatgttttggcagacatcaccagtaatctaagaaagcatctgccctcacacttatcatctctcacaagattctcattctcatatattggctttattctttggagcgatctctttgaagatgtctgctgattacccccactctcacattttctcatttggtaacatcactggaaagagtcccttgtttatatatatggttggggtttattttgctgttttcagcagaatattctccaggtagatattcaggctggcctggcatgggacacatgctgatgatacctatatctaccattttacggctgtagctggccacatcttggatgtaggtttatcctgtgcttggagatagcttacagtgagtgcctcctaaacctgatggaatgaattccgcacaggaaagaaagactctgatagctgcagtagactgtaaacactaactggcctgataacaaatgctcctaatgctagtgaggctgaagtttaaggcttcctttctgtagtctatctaagctgtattggtccattctcacactgctaataaagacatacctgagactgggtaatttataaggaaaaagaggtttaatggacttacagttccacatggctgggaggcctcacaatcatggtagaaggcaaaggaggagcaaaggcacatcttacatggcggcagggaagagcacctgtacagaggaactgcccttcataaaaccatcaaatctcatgagacttattcactatcatgagaacagcatgggaaaaacttacccccatgattcaattacctcccaccaggtccctcccatcacacatggggattatgggagctacaattcaagatgagatttgagtggggacacagccaaaccatattataagcttcacatccactttgctactgggccttggaatattttatctttacatatccaagtgggaaatttaattgtctttccctcaaaatttgtttccgtttttcatttctcagctttggggaatggtatcacagccttgcattttagataaagtcttccaagcctcttttttcttgatcctttatattgatgtttaccacatcacacctattattcctgcttcatttatctcagtttcaagtttctcattccatgggcagcttccaatatttcaacactggacaattgcttgagcatttcaatcgcctccttccctaattctttcctctggcatgttttccataacatggatagttttgagtttttaaaacacggccttatttttcccacttccctcaaattgattcaaaaatatttcaggggttcctaaaaggcaactgcaatttgtgggacacaacaataaaaaaaggtaaacatggtttctaacctcacagaacctggcagttttaaaatggtaagatataacagatatgtaactaggtaccttataaaaaacactacaaaagggataatattggatggttttggagagacctctaacccagatttatgtccggaatggcatcccagaaattgtggcattcctgcatacatttgagggatggggaggaggttggacaatcaaagaggcaagacagtgttcaggcaagagtcatggcatgtgcaaaggcccagaggtgactacattttgttgttccaaggatgtcaaagaagtgtaggttggatgagctagagtggcagagagagacagtcatgaagacatttcagggagacagtgctggtttcagcttgtggagagaggaaagatggtcagttagaggttgtgtcttcatctaagcaagggagcctggtggcctgaactaggatagcagagattgtttgagaaatgttattgagataaaaagagtgttggcttttttgtttgtttgtttgttttaaggcagagcttcactcttgttgcccaggctggagtgcaatggtgcaatctctgctcacagcaatctccgcctcccaggttcaagcgattctcctgcctcagcctcccaagtagctggcattacagggatgcgtcaccatgtccggctaattttttttttttttttttttttgtattttttagtagagacggggtttctccatgttggtcaggctgttctcaaactcctgatcttaggtgatccacccgcctcgggcttccaaagtgctgggattacaggcatgagccaccgcacctggcccctgattgttggctttttaggataccttaaaagtggaggcagatatactgttctgagactcctgggcattgactgcttttttctcttggaaagagaatattgcctttctgatgctgagtttacttaaagagccaggaaaggtcaacgcttgcaaataaccccttaagtggaagtacatagattgttagttcaggttcttctggaatgttggacataaacctaagtataaaaaatgtagtgttgcaacaaaaatttggatttttttttaaaatttgttagattcctgcctatgcaaagggtagcaccagctacagagcacttcatacggatcccaggcaaggaaaaaatagagaagagattatgctgcatctgccccttctctgtgtggaccatgataccattgtttgttctctatcatggactaaataaatcagagactctaagtagatgtgagttctgtgtgtgtgtgtgtgtgtgtgtgtgtgttcaactgagtgtgtgttttatccctgccaatggtaactttatttgcaaagctgagtacgtttggaagatagaaacaatactttcttgcaactgatggggtaagcaggctaagcaaaaaaagaaaagtcaaggacatccctgaagtttctggttatggcaactgacaagatgttaccatcaatccccagggcttgagacagaggatggcctggtttgtgggttagatgggataggtaactgtcaaccttttgaattggaggtatcctgtaggctctccatgtgcagatgtctaataggctgtggctgtccagtcttgaaattctggagagaggcttgagctggataaagatttagcagttgacagctaataatttcatgggacttggtatgatcatctgagaaaaaaatgtacaaggaagagaaataagaagttcacatgacagtgcaggtactcaaggaataggaaggggaagaaaatcctgtgaaacaagtgggggaaaaaaaagaacaccttactttcctttacatgtgctattcactcagtgcaaacttgacctgtcattccacagggcgagttttattccccatcccaccactcagagttgacctcctttatgtcccctaaatcagaggccacaaaattaatgtacataggacatattcggcccctagataggttttatttggcctatggatttctttagaattttgaatcaagtgccagtctattcacatttcagtttgccacaggccccgtttctgccttctgtcttacaccagtcctattcctctcaggcctttattttatatgccaaacctctgaaagctctcacaattgcaaaaatatcacggatcttcctatgtctatttttttcttgtggaatacctctctgcctattgcaaatctattcatcccacagggtgtgacctgtggttcacgtctttggtgaagcttcctgccctctgaatttttatagcccttaatgggttgttattgttgttattattctcttgatgagtgactcagcatacatagcacatggattctatgactcctatgaatagggaaataaacaaagggctctgcagttttgtgctctgactcatagatgcaactaccagggaatttgctctttttagtggcttgtttcctgttctaatgagaaaaatggaaagcacagctcagaaacagactctacttagaaaatgtggatggtatgtctgtccagcatgacaatgtcaaatctcacattttgaaatgccaacttacaacttttctgccatttactctgacactagcatgttgagttgcactaacagttcctttttctgattattggtgatgcaatattatcagcttctcttggctggtgccacatgttgcagttaagtctctgcagctgtctactctgcggtatgtataggagggctttggtgcatatgtgatctgtgcagggatgcctttctgaccagaacctttgggaaaactgcacagtgagagacggaagaattgccaggatcagccttaccatgctttacaatctgtgtccaggagtggcactgccccacccactgatgaatcatcacactgatattatcaaaggagacattacattttcaatgtcatgttttaggtttataatttaattttcagctctggcaattccagaagcatccctagggacatatgaagaggaaggggctagcgtgtactcgaaatgaatacatgttcatttcttgagcaccttaattggcatgcacatctcacaagctccctttttctctgctgcagccaaactctctcacaccaccaagttactcaatattcctcctgcactgactgccttcctttccactcaacctcaagtcagatctactttagtaataaatctctgctgggaatgatcagaacaaatactgagtgtgcaccacaatattaaaaataagtgtaatatagacttatttaataaggtccaacagacttttataacatttggaatattttaccaaaggtactatcagcattatgtttaatgcattttctccaagacagaaaaatcttttcaagaatgaggggggaaaagaaaaaaaacacaaaacacagagaaaagtcagatgggctctgatgcattctcactcaactaaatctgtgattctccttcctttcccagatctttctcttcggccagacccacaaaatgtgaagcctctttgtgttcaccctgatttatgaatagtcggcactgggcaattgcggtcccagtgggatacatttcagtttaaaaatagtctgaagcactttctttcaaattcccacatgtccactgccacctcataatatgtgcttctccttctgtccttgtgcagttaaagtcggatccatgtacggggaatgaaagcactgaatttgtttgtagcactttgaaccaaaatggtgaatttatttagagagtagttccagcgagttaagttagtttcaatggacatattggctgcaactggagcattgatggaagggaggcatactactttaatgtcctcaaaaagaaaaaaagaaagaaagaaaataaataaataaaatccagtcaactgcaggataagtatccataggccaaacaaatccctctcaaaatgactgcaagttcaggtgacaccaacagctgtcaaaagacccctgtttgcctggcggcagctttgggttcaaattcttcctagtttacagtgacatttcatttaatgcttgcactctgactccatttgtctgccctgcaaaagctctgcaaagagctgacccagttaacactttctgtttcacaaacccagagactgaacagcagggaggctacagcaaagtgctgagttgtcctagctgagcagtaaggggacaatgactgtggccacagtccatgtcatttttgtttctagaccagtggtgactcattggactctcctgggcagttctgaaaagtctgcatgtcctagtctcacccaagaccaattaaatcccaatctgtggcagggaggacccaggcatcagcattttttaaaaccaaatctttatataaataaaatgtctcaagggatttgagtgcaaaaggacatactctatagaatataatatttctttggtaactgatgacatttcaagcttataggacctcatacttagcatagtgacttagaatctcacttttcactcagaagctcataatagagtcttttgattcttcaggggtttaggttaataaatgcaatataaccgaagctcattatgtagtgtttctaaaccactatcgagtaatcatttgctggtgtattaggcattgcaagcccttggtgccatagtccatctccttgtttctgagtcagaagaagcaggtggactgattcttctggcacccctgcttctcagcccacattgtgtcaaacattaaaagtgaggttttaatttgagtacctggcttggaatgtaacaggtaacagttgattatgttaattgatccaacgtcttcaaagtcaaagcagtaatgatgaatctggacctactattggaagaaaatgatcaagttacatttatgttgaaagatgaagtcagtagggaaagattctgttaaaatagtgggtttcatgcgcatccatgtgaagagaccaccaaacaggctttgtgtgagtaacaaggctgtttatttcacctgggtgcaggcgggctgagtctgaaaagagagtcagcaaagggagataggggtggggccattttataagatttgggtaggtaaaggaaaattacagtcaaaggggggttgttctctggtgggctggagtgggggtcacagggtgttcagtaggggagcttttgagccaggatgagccaggagaaggaatttcacaagataatgtcatcagttaaggcaggaacaggccattttcatttcttttgtggtggaatgtcatcagttaaggcaggaaccggccatctggatgtgtacgtgcaggtcacaggggatatgatggcttagcttgggctcagaggcctgacattcctgtcttcttatattaataagaaaaataaaatgaaatagtggtaaaatgttggggaaaatttttgggggtgggatggagagataatgggcgacgtttctcagggctgcctcgagcgggattggggcggcgtgggaacctagagtgggagagattaagctgaaggaagattttgtggtaaggggtgatattgtggggttgttagaagaaacatttgtcatttagaattattggtgatggcctggatatggttttgtatgaattgaaaaactaaatggggccgggtgcggtggctcacgcctgtaatcccagcacttcgggaggccgaggggggcggatcacgaggtcaggagattgagaccatcctggctaacacggtgaaaccccttctttactaaaaatacaaaaaattagccgggcgaggtggcgggcgcctgaagtcccagctactcgggaggctgaggcaggagaatggcgtaaaccccagggggcggagcctgcagtgagccgagatcgtgccactgcactccagcctgggcgacagcgagactccgtctcaaaaaaacaaacaaacaaacaaaaaacccaaaaactaaatggaataagagaaggagaaaaacaggtattaaaggtctaagaattgggaggacccagggcatctaattagagagtgcctaaggagattcagcatagtcctgccagcaaagattatttatttactttaagagttaagagtggcagtttggggatagcacgaggaggtatcagctgtgatggcttggagaaacagtgtaaactggcagtgtaaacaagagcagggcatgtatgagtagttgagaacggtgaataggagtgtgactagacagaagatagtagggatgacaagtttttgggggcacagtccgagttggtctggtgtctggactgagactggggcttaataaaaaggagcgtccatacaggagctcaaatgggctgtaccctgtagcattccgaggacaggcctgacttctgagaagggaaagtggtaaaagtattgtccagtcctttttaagttggtggctgagcctggtgaggtgtgtttttaaaggacctttagtccgttctacctttcctgaagactgaggactgtaagggatataaaggtttcaccgaataccaagagcctgaaaaactgcttggctgatttgactaataaaggctggtctgttaacagactgtatagaggtgggaaggctaaactgaggaattatgtctgacagaaggaaagaaatgactgcagtggccttctcagaccctgtaggaaaggcctctacctatccagtgaaagtgtctacccagactaagaggtattttagttatctgactggggacatgctgattaaagctaatttgccagtcctgggtgggggcaaatcctcgagcttgatgtgtgtagggaagggagggggcctgaataatccttgagaagtagtagaacagcagatggaacactgagaagttatttccttgaggatagatttccacgatggaaaggaaatgagaggttttaagaggcaggctagtggcctgtactatagcatagcctgcctttgctggtgtgtggcgattaggcctggtggaactgccatcaataaactaagtgtgatcagggtgaggaacaggaaagaaggaaatatggggaaatggggtgaacgtcaggtggatcagagagatgcagtcatgagggtcaggtgtggtatctggaataatgtgggaggctggattgaagtccgggccaggaacaatggtaattatgggagactcaacaaagagtgagtacagctgaaggagccagggagcagaaagtatatgtgtcaggtgggaggaagaaaagattttggaagttacgagaaatgtagagagtgagttgagcatagtttgtgatttttagggcctttaaaagtattaaagcagcagcagctgctgcacgcagacatgagggctaggctaaaacagtaaggtcaagttgtttggacagaaaggctatcgggtgcggtcctggctcttgtgtaaggattctgaccacactaaccatgcctaggaaggaaaggagttgttgttttgtaagggattgaggtttgggagattagtcggacatgatcagcagggagagcacgtgtgtttttatgagaattatgccgagatgggtaacagatgaggatgaaatttgggcttgactgaagtaaaggggactgtctgtgaagccttgcggcagtacagcccaggtaatttgctgagcctaatgggtgtcagggtcagtccaagtgaaagcgaagagaggctgggatgaagatccagaacagaataatgcgttgtagagggaggtattgaggataggagagtatatgagtttagcaccatggggtggataggcaaaacaatttggttgataaggcacagatcctgaactaacctgtaagtcttgtctggttttaggacaggtaaaatgggggaattgtaatgagagtttataggctttaaaaagccatgatgtaacaggcgagtgataacaggctctaatccttttaaagcgtgctgtgggatgggatattggcatggaggggggtaagagtgattaggttttaatgggatggtaaggggtgcatgattggtcgataaggaaggagtagaggtgtcttatacttgtgggttaaggtggggagatacaaggggaggatatgaaggaggctttgaactgagggaaaaggcagcaatgaggtgtggctgtagcccaggaatagtcagggaagcccataacttagttaaagtgtctcggcctaataagggaactgggcaggtggagataactaaaaaggagtgcttaaaagagtattatctaagttggccccagaattggggagttttaagaggtttagaagcctggccgtcaatacctacaacagttatggaggcaagggaacagcccttgaaaagaaggtaatgtggagtgggtagcctccttattgattaagaaggggacggacttactttccactgtgagagttacccgaagctcagcatccgtgatggcctagggggcttccgaggtgatcgggcagcgtcagtcttcagccgctaagccgagaagatctgggaaggagtcagaaagccttgggccagagttccaggggctctgggagtggatgccaggtgagttgaacagtccgatttttcagtggggtcccacacagatgggacatggcttaggaggaatcctgggctgcgggcattccttggcctggtggccagatttctggcacttgtagcaagctcctgggggaggcagttctggaggaatgcctggccactgtggtttaggcatttggaagttcttgtgtgctggagatgtggctggggtttgtctcacagtggaggcaaggaattgcaactcagaaatatgttgccacttggctgcctctactctattattgtacaccttgaagatgaggttaagtaagtcctgttgtggggttggagggctggaatttaatttttggagttttatttaatgttgggagcagattggataataaaatgtatattgagcataagacggccttttgaccttttagggtctagggctgtaaagcgtctcagggttgctgccaaacgagccatgaactgggctggatttttatatttgatgaaaaagagcctaaacgctatctgatttgggataaggaaaaaggagcattaaccttgactatgcctttagctccagccacctttttaagagtaaattgctgggcaggtgggggagggctagtcacagaacaaaactgtaagccggaccgggtgtgaggaggggaggtgataaaaggattatagggtggaggagtggaggctgaggaagaattgggacctagctcggcctggcaaagaggagagagatcagatgggtctgtagaaaaggaatattagaaagactcacgacgcttggggttgggactgaggggacaggtgggagggaaagaaggaagatttgggacaagttgcattgggaacagagactatggagggactgatgtgtaaaagaatgcctggacatcaggcacctcagaccgtttgcctattttgtgacaagaattacttagatcttgtaggatggaaaaatggaaagtgccattttctggctatttggaactactgtcgagtttatattggggtcaagtggcattatagaagaaaataaggcatttaggttttaggtcaggtgtgagttgaagaggttttaggtttttaagaacacaggctaagggagaagaaggaggaatggagggtggaaggttgctcatagtgaaggaggcaagcccagagaaaagagagagtagagacacagaggaaaggggtttgggggttcttaccctccagaaaaggaggaaaggggtcagggtggggaaataaggggttggggtgcagagataagaggtcggggcatggaaataagggatcagggtgcagagataagaggtcggggcgtggaaataagggatggggcacagagataagaggtcagggcgtggaaaaggatcagggtgcagagataaggggtcagggcatggaaataagggactggggggttcttgcaccctagaaaagtggtacttgccactaagggtgaaggagaaggggttggggggttcttactgcccagaaaagcggagaaggggtattgacatggagagaaggggttgtggttcttgcccctcccccagaaaagcgggacttgccgctaagggtgaaggaccaaggcaggcatccctgcatggtcagacacctctgaaacatgggtaaataatcagagaggtgtccctgcagtgattaaacaccaagggaaggctgccttcccgagtccgtgagcagtgctggagttttgggtccatggataaaacgtgtctcctttgtctctaccagaaaatgaaaggaattgaaattaagagaagggagagattgaagggtggtgccaaaattgaaaggagaagatggttgacggttagtgagagaggttggagaagagagtaagaagaggccgcttacccgatttaaaattggtgagatgttccttgggctggtgggtctgaggacctgaggtcgtaggtagatctttttcacggagcaaagagcaggaggacaggggattgatctcccaagggaggtcccccgatcccagtcactgcaccaaatttcatgggcgtctgtgtgaagagaccaccaaacaggctttgtgtgagcaacaaggctgtttatttcgcctgggtgcaggcgggctgagtctgaaaagagagtcagcaaagggaggggtgaggccgttttataagatttggttaggtaaaggaaaattacagtcaaaggggggctgttctctggcgggctggagtgggggtcacaaggtgctcagtaggggagcttttgagccaggatgagccaggagaaggaatttcacaagataatgtcatcagttaaggcaggaacaggccattttcatttcttttgtggtggaatgtcatcatttaaggcaggaaccagccatctggatgtgtacctgcaggtcacaggggatatgatggcttagcttgggctcagaggcctgacagtgggtctgtatctccttttcaatgtgaatatgtatcgagactatgaatagctaagtaaaggtgaaaagtcccatactcacaaggaccaggcaggtaagataaacgggggaaataggccaggttgtcaactatgcgtcatggtggggactgttctgatttgaagtctgtatggccaggcagtgtctctcagggctggcaggttggtgcttccagggaattcaggtgtagagttgctagatctcccagttcctcaagaaaattgagcaatctggatttatttttatataaaatccccagatttaaaatggttctgtaatggtcacttgtggaacagtttaagtaggcttttggcacaacatcctggcttcagatttttctgacaataatgtgctaaatgcccttaaggaccaggacaattacacatacgcaacccatgaagtgcagaaagttagcagctgtgggacttccttgaatgatgggttcagaagccagaagataagaagctgatgataaatgcttcttcccctcatcctgagatgcacagcctaaggctcctgggaaggtccagcaccatcatgattaggcacccacaacggcagtggctaactgtataactcttccttgtgttggctttccctttccttgtctctgccactgttccttactcttgctcttctgaatcgcttccccagtaaactacttgttcacagcctcagtctcagcctctcctttcaatacaaattgggttaagacgtttggcagctaattcatttttaaaagtcactgtgtagaacaaaacaagactatctatagggcagatgtgtagtgcaggacttcttgggaaatggtagatttaaaaagaaggcattgagcttgagttacagacgtgatttggtacttagggaatatttgtaacttattttgttttccataagaaactgtgtgattttttttctttgctttttggattgtttgtttgttttttttaaagaattttagtaaacctttcattttaggatagttttggatttacatgacagttgcaaaaatattatggagtatcctggttgaatttttttgttgctgttattgttttgagtacatgggagttttctaaacacatgcttagcaaacctgatactgtttttccctcttcagagctgtcagttcagatttcagaaagtgcagaataggaagttataaacataccctgtaaattccttgaaagacagtgcctcactcatctttctatctcccttagaaccagccacactgccatgtacgtgacatttaataaatagttgttgaacaggggatcctatcatacatgagcacggagagggatcatagccagtctgaaggcccttccctgcactatccctgaccaccatacctcttttcctcctctccaaaaggcaacctttccccctgtgcgatttctgtcctaccagggtagattgggaaggacactggatattggaaggcaaggtttttcgttcaggtttgcctgaatctcccactcactcatgtatgattaagtgatctttgttgccaaacaaagccagagctgcagctttgccgtctggacactgtgagagctttctaggacatacctgtgcactgcatgtcacagtgtatttttagccaatccctgagtgaaagctgacaagcattttgtttctcttctagatcctataagcacccaccttgcatatttactcagtggctaacgaaaacagtaataataacacatgctatagtttcagcctcagattttagaacatctttacaaggtcttttttatcaacccttctcaggaaactcagacagcttgcttaaaaaaccaggaaatatagaaacaatatctgtgagaacaagttacttttgttcaatctcagtttacatctcaagaggatgattattcgtagaactttaaatgatgtggtaacaaatactgtaagctatttgttttccgtccttcacagaattgaaagcattcagcattctatggcagggattcggcacattttattcatggactatgtcagggatgaaatgaacagaaggcatcttatttcatagaggttttgttttgttaatgataacaataatgccctgcattgagtacgtcattgggtgccagggatcctccagtgcacctcacaagtatccattcaataatatccccattttaaaaatggaataactgaggttgagagattatgatcagcagagctaaggggacaatgggatttcatggaggatgtttagttccagagcaatataatctaatttacattactgaagaagtcgctggcttctcagtgggaaacaaatgcaaaaatggtgagagtggaaacagggacaacaaaagctacccagggttgcttaaggggaaccagcatcccaatatctagaagaggtgttggtgggtctgacagaagtttggagactcggagttgttcaaacgctaaaggcagtagcctgctccttatattcgattcggtaagaattatagatatgagcaatggttattttgtggagcacaatgaaagcacgtttcaatcagatcgtggcccttttccgtaagtcttgctttctggagcagagcagtgggtccggcactgttgtactttatctcaaaccagatggtcttctctagcttctatcagcttgcttgagacacacagtaagtactggcttcttgctcctcagtcatccttaggggacgatgatttgtttcttggcttttgaaaggtgatttaattcaggcgtatcagagccccttttctgtaaggggaaagaatcttaaaaaaaaaaacaacaactagaaaatcgtctgttgtccacaaacccacacatccctggttgtacggaacatcacagcttcttgttcacaggcagctttaacagatagatgcggggatgccagctaagccaagtgataagaaaacaaaacaaaacagtggataagggctcatcattaaaatcaactattcgtatcatttatatagtccccacaccaattattctgggaactgtgtctttctggaactttctgtcaccatcattcgttttcccaattctgtaacaccataataccctctttctctaacacagatacagaagacttgtagcaataatgttaataactgaataatatttactgaatattaactgtatgcctcactattccctgtaaagttggtacatgaaaatcatcactctgctaaggacaaccaaggcctagagaggttagttacttgaccaagtgcaggtaacttgtatgaaagggctggaaagagaatcaaacccaagctattgcactccagtggctggtgatcttaggtgcaagaaagtctgttgactgactatgtgaaaaccatactccccgcaacactggccagagggaagaaatcaaatccgtgtgttgagatggtctggacaggcaggctgctggaaggcagagtatcattacagctattaagacaatgcagagggctattttggtgctcagatctgtgcagccagatggaaattgtagttcaagcttagtgttgtcagacagcagaggctgtgggcaaaggggaaggcacgggtgagcgatttttgactgtttatctctaatgtgtgtggccagtgtcactcccatctctgatgtctgtgatttattctattatactgtcaggattaaaacaccttagcaggagaaaaataaagggagggatacaaatggtgtgtcattgatgtgacagatgctatttctctggaaaccatagaggatgagggtatggaaactctcaaaaatgccacgaccaccgaatatcagaaccgaacaaacctttagggaccatctgtttcaagccactcatttgacagatgaggaaactaagactcagggagcttaggtggtgatcaaagtaacataagctcctaaatttagagcaagaaccctaactcccaccgcccagttcagtattcattcagcaacatcacctgctggtgaggtccattgttccttcccctaaattcagagttgagattcacattaagtaaaaaaagaaaaatctgtttttattttagcaagagtaaagaaaagtagaaagcacgagccggaaattctctcctttgctctccagtatccatacaatgttaacactgggactgtggtccttggctctctttgctgttgctatcttttgtggctagctcctttcccttctctgaacaaaaggagaccctagtcacctcctcacccttgttaagtgatggggtgggccattctctgcctggtgcagctttcagctccttactgcgtcctcacccatccttgcctagacctcttcatccgctgtctctctcctgctgtttcctgtgtgaatagagagaaaggatcagagtaagtcaaagtcctggcctgccaaggaacccagacacccgtctctccacctcttgcctccttcctcactcattcctctgcactaatctttcagcaactcagattttctgaaacacttaaaatcagtagaaaagcacagaatttgaagcaggatgacctaactttaagcctaatcctgatcacggtgagccatgcaacatgggacaagtctcagacaagtctctgtgggccagagtcatcttctgtacaattggtatcctagacaaagttcctacacccagtattattctaggggtgaagttcattgatgacaaaatacgttgtaaagagtgtttattagcaccaaatttttactgtgggtgaaatgcctaaattactttgtaactcctcagctctattagaaaatcgtcttgtgctcagacatgattatgcactgacagggacctcctgtgagatgtgctgtctcagcccaggagactgaatccagcagcctccaagagtgctgtgttcccctcaggccgcactgcccagcagagacagcctgtgttcacccagaaagagggccaacatctttccagctgtgaattctgcttatcacttggctggatgcagcattgcttgtggcccaaatctcaccatgttcctcatataaatatgctgtcgggctctgctcgtggtgttctctctctaagaaatgaagtctgccaaggattaagcttagaattgagaccacagtgtttccatttctctagtttctaacgtgaagacacacatacaaaactaccacgttggagacgaacaaagggaaaccattttgggggtgaaggttagggagggcattcctgctcagagctcagaatcatcaacgcccaaccttgacacttaataaaagtatcactagaattgcctggagttgtgaattacctaattttgtagggacttcaatctctatctatattgtgtgtgtttggtggggtgggtgggggggaggtttaaatgataaaaaatccaaaacaaaaaacaaatcacaaatcaccttcctatagaatgatccttgtcttctctaggaagtctcctattttgtatccctacactgaagcaggtaagtttgctttgaatatgataccagaaagaagaatggaaagaacaaagatggccgctctccctttctctgaccccactgggttgatactgcaacgtggtccctgatttacaattctctactttactatgatgcaaaagcgatatgcattcagcacacttctgacttaggatgggattaagtccagataaacttattgtacattgagaatatcgtaagtcgaaaatgcacttttgactgaacatattttcaacgtatgatgggtttattcgttaagccaaggaacatctatagaatagacgcaatctctcccaaagctcaaaccaagatgaacccctcagaaaaacgaatgtctgcaaacagctggaaaaacctctgctatgtgctttatcctcacccctttcaaaccttagggctatggaaaggctttagaacctcaaaaccaggctatgactataagccgcaggagatcactcttgtcaaaaaacacttaaggttcattttgtccctagttttgtttgggagctggggatacagatgctaagaaggtagtccatgctctcaggaaacccacaagctactccaggagaggctaaaagagtcttattatgccaataccatagagaaatgacctggtagacaaaagcacggtattatgggaggagaagccaaggcttcccggagacccttgtaggagagattttgtgctgcgagtcagagttgagtttgctgaaggtttcctgagatccagttaggtttgctctagtgtgaactagattactaaaatagacagagaaaatagcatcctgatatttaaatatatgattaccctttctttataagtacttagctggaagtgtcttcgggtgaatactaaagcgcgtatctgtgaatgtagaccatattggaaacagatttactgtcccaaagcgtagtgcttactcagccatctgatgagatgtgagcactgagcagtttgagagggatgcatagagctgttttattacaagatgctgttatgagttatagcagctttccttatgctctacggctgtcgccaaacaagttacatgaatataagcagttttatttgcaattttttgcttacattttcttagcatattcggattatagcttctcacagctccactcatgctcctgtggctgtcccagtatattgctttattcagagccaaaaggagcgtttacaaacatttgtagaaagtcctccttagagtacacagtgctagtgtttattgatgctatcacctggcacttgtttttttcaaaaaataaaaaaagaaaaaagcattttcacccttggatataatgtgtttctttcagagaaaacttaataaatacatgaatttgcctttcatttgatgcagttgcagtaactcctgtgtaggaggttttgtgtttcaggaaaaaacaaaataaaacaaaaacaaaaaacaaaaaaaacaacaaatagagtttcaaatttcatttgatcaggattgaacctgaaacaactaaaataagaaagaattaattttgtctgagagatatacaccaggcttggttgttacatacaagttataggctggaaaattagtgttgttaattcccctggaatgtgtgaaaatgaatcagaggaattgatgacgttaataaaaatgacaataacagtaaattagtttatactaaatgtaaataatggttatgctgggacctaaatgaacctgcaacagctagggacttagtatgaacccagtttattcttattttattaagcatcctctagatcaaaatattgtgttattaataattacaataaatatctagcatacagtgctcagtattcagagcctgtcctcatctcactgtttactttgggaaaatagcatgttcattagcacttggcttggtccagggcttaggggacactggacatttgaacatgactgcataaccgagcttcattgaggagcaggggacaggtgccagatgaggttttaggtaatttgaaggattagtctttaaagagtcttttaaattactttgcgctgtactcctttttgctggttataaaaataattcacatccattttaaagaatttggaaataataagtgtataaagaagaaaattaaaatagcctatcattttactgctgaatagcaattgtttttatcattttggcatatttatttcccagcctttgagttgtttgtgtgtatgtggaatgtattttcaaaattggaattatatgtgctatttatatactactctgttcattttacttttgtcatgaatgctttccttaaattgttcttctggaatatgatttctttaacaatgatgtggcattgtcatatggatatatcacactgtactttccatctaatctttttcccaatggaattttagttttcgtgcgtttttcatattataatagttcagtgaacatcttttacataaatctttgtgtatgtcactcatttcttcagaatacatctgtatttaaaattatgctaatggagaggtaataaaagaacgagtaggccaggttttgatataggtataaatgtttggggcatgcatctaaaatcaaaaatgctttttaagacaaaatttaaattttacttacaaatcatattctaaatttttcagccacatatgcaacaatccgtttatatcatattctgaaatgcatcattctgttgtaatgatattttgttaaaccaattttaaattgtatgaatgtagggatcttatgtcattttatctggagcctagttaagggggaattttttaaggtcatatgactatcccttaaacctcaatttctttgcaatagcatcatgaggactacatcctaggaaatctggagttgtaagcataatcacaggcttaattgttttcccttgaccatatgcatatattgttgtatacatacacatatgtgcataaatatacgtatgttagatatatattatataaatcacatgtaacatattacacatattaaacacaataaaacatgtacttatatatttgtgttcatgaacatacataacatcataattttaaactattatttaaagagtttgtgcataccatcacatgatttgacagatgtgatgtgttttaatcaggtgaccattagaacaataaatacaatgctttatagcaatctggtctggtctactgttagtctccacttgccccggctgtcaaatattgcttagagttcatgtcagaaggagctcttgcatcatagtccaaagcagacattcccagaacaaaaaaaatggagtcaagagacacagacaggacttccttttctgtctcattttcgatgtatctgtgggaagctttctgcctatacaacaaatcattcctagggagggctgtatcatgatatgagaaacgaacaaaaaaaagaaatgatttctgattcctatgggaaaaattggtcttatgtgaaaattaaactcagtgtgttataacatttgctacataaacctgaacaaaagaaaaaaaaaacttgtgagagatgctttttctctccacagttatctttcataactatctctttagttttgtgtgatgctgctcaaatttgttggtctaaactgcagtgttctcggagggttcagcacatgcccttccagaccggaccctggcaaagcagaatcaagcgacaggatagccctgccctcatgaaaccttgaccttgactcttttttttttttttaaatggagcctccttctgtcacccaggctggagtgcagtggtgtgatctcagctcactgcaacctctgcttcctgggttcaagcaattctcccacctcagcttcccaagtagctgggattacaggcacgcaccaccactcatggctaatttttgtacttttagtagagacggggtttcgacaagttggccaggctggcctcaaactcctgacctcaagtgatgcatcctccttggcctctcaaaatgctgggattacaagtgcgagccaccgtgcccagcctgaccttgactcttggctcaattttctctgttcttggcatctatgttcttcagaccatgatgcaagaattccaggggtgtacaatcttttggcttccttgggccatattggaagaaaacgaattgtcttgggccatacataaaatacactaatatgggccaggagcggtggctcacgccttataatcccagcactttgggaggccgaggcaggtggatcacgagctcaggagaagacaagcctgaccaaatttgtgaaaccctgtttctactaaaaatacaaaaatcagctgggtgtggtggtgtgtgcctgtaatcccggctactcaggcggctgaggcaggagaaccatttgaaccagggagatggaccaaatgtctatatggcctatagcatttattattaagtctgtgacaccaatgtacttcacttggcaagtcacttattcaccttaagcctccatttcctcccctaaaatgagatcaaaagaggcataaatgattgcccttctcccatcattcactctatctctgcctctatgtagactcagttcttgctcttcaactgacttggtagatccttgaatatatgtagtcattttaattccaaataattagtactaaagtaagaaaattctggtgagagaaaactgcaactatgtttaaatgtacaaataaaggtgaatcaatcccatttggagtaaagaacgtccagatgtcctcaaaataagtgtcctttctcctccacctattccctgtcccgagtctcattttcatgctcagcaagaccctctaccggattatgtcatcccccaccccgatacaaaagggttatgtttataaatgttgaatgactaacatatcctctcagcattgccatatagagtggcaaataatgttggaaggaaattgggcattttggaaaggactgatatgaatattaattatacaagtgtgggctccaaaatctcttttttaggtttttcccacctgcattcctacagaattgaatgtttgttcttctattatgcttatcagtaaattcttaattttgttaaggaaaaaaaacaaatccagggcaagtgcttacattatcactatcatctgcttgaagcctgaatttcattaagtaggttgttaataaaatgaggaatgatatatcacaactgcaatgctgtgtctcccaaagttaatgaagagttattattttatagatgacaaattaaaaggctgttaaaatagttggtaagactgtcaacggatttagcaacattctaattaaaaatagggcattaaagagaattaaaatcttgaatttggagaaatgagaaaatatgcttaatatgtgatttaacatagttaagagccctggaatctttacataagatgagatggatgtcgttttaaagatatcgtgacaaatttttgcaaaactaggacatcaccatctaatacaatttcacagagttgatgaacaatttgtttgccattaaaattatatttttaaatgtataagtaatattaaagcaataataacattttaatatgtattattataaagatatgctacatgtagccttaatatatattaatgatatacacatttacctgtcacccatttctaacaaattaatagttttcatttttttcattttcactgaagtacttatctatctggatacatttttatacaaaaatagatttttatacaaaagttacacttctgtctgcttttttcagttatacctcagtcttacatatcttaaatgttttcctttttaatcattaaacaccattaattgagttgatatgctacattttacttaaccattcctttcttggttagttaggtcccttccactttttactataataaataacattcaagaaacattttcatatacatttagagtaagtttctggaaatgagattactagatcaaaaagtattaatgcttttttggttgtttaaacattatcaaactgcttatcaaatgacttttatcattttacaccagtaatttaactacagttgtaattcaatgacaaggtggataggatttgatggcatcattattttataatttttgcaaaattagtaggtaaggtggtatcatatgtttgttaacttatgtttaaacaatctgctccaagaatttcacagataattagataacatgactgttttctctattaatttggttttctatattttattctttgacaagtggtcatatgcaaggtgccccacatatgatgccgtaattttcttttagcagattttggaggtattcacagaattgagattaagcatagctcaaacaaagatacccatggaatgaataaatgaaataatatttaatagagtaaaacagaaagtgtttagaaacatgttatagagtcaataacaggtatagtgaggatgatttttttcaaggtgtgctaaacttgaaaattgaccctttttatgagtatttcaggagctagagaatccctcctattcctaaaacaaaggtgaaggagaaacagggaaagacagagacctctaacaaacagaatgaatagctgaagtggacgggctgtctctgggagtgggcattctatagaatgcaagcagtgggggtaaacaaatgctgtttacatttcccatccttgttaaatgaaaaagaaaattaggaacaattatagctagagttatagaaatccaccttgtgaaatagagaccttgggtccaaagcgtctatttgcatttcactgtttctgcctggaacaagtctgttagcatggctcactccctactccctgcaggtctctgctcaaacattatctcttcctgcctactctctataaaatataaagttctgtgtaccccacttgccattccattcactccctgttcttttttatcatgcctcatgcttcttgatctaagatttgcttatttgcttatttatttactcatctatatactgcaagaatgtaagcttcataaaggcagagatatgtactgtatccctacaacttgatagaacaatgcctggcatgtaatggatgcatcataaatatttgttgagtgagagaatgaatgaatgaattgtgaaagatcaccaatggataaattacccaaactctggttgatatagccaacctactacaaatcaatgaccattccagtgcagagttgtacatgagcagatgcagtattggggccacaacactgtgtaaggttggatctggaattaaacctttcttgtaatcatatctgcctaagtgtttctttctttctttctgaagagggattaaagacagattctagaagctcactgtatattattttcagttaggtatgagtatccatacatgtttacttgtgcatgtgtgtatacgcatacatatacataggtacaaatatatacacacacatatccacacatccccacacatgtttgtatatgtgtattaagttcactttagtaaactctgtagaggatattcccttgagtacaatccgtagagtcagataatgtcgaccaatatttttctgtctttttaaagcttgtgaagaatttcttgagacattgcaatggagaaaagcctggaacaagtgaatttaaattgataattacagttagaatctggtactcatattgcataagacagttataactgtgtaaagagttctgctttattgtggctaattatgctcttctaagactgttgccaaaaaaagagcacacagtcaacaatgtcccagccttcctctgcacaccccctaataccaatgtcttcttatgtctcagtcctctcctcatcatcccttggtcacttttcagcctttattttcttatcacattgataacttgtagtatcattaacccttgacactcatcccatctacaattcccctaaaccagtagacgtccctaatttaaaatggccatggtcatcaaaggcagaaaatctgcttcctctcagcagtcaataatgcaactagaaaggatcccttcagtaggttcatgattcttcctattcaagaaatggccattggtgttttgtctttgacatcaattgattttatatttaattcttattcattttttaaaaccttcctttctcaattctaagtcaaatcagcactaaactgtctctgtggcggttacatatcttagttgctctttcatcctaccatagaatggagactcataatgctagaggagaccatgaaaagaccaactcatcaaccctacagttaatcactaagagaattgagctctcttgccatctacctttctatcaggaaatggatccctgagcatctgtctattattccttttgtgtgttgtgctcaacggaaattttccacatctccatctctgtaactccactgtcaagagcaatctcttaggcactgcctgccattgtgattattgccaatatcactgaattaaggtaatcaggccacattcatcgcatgcacttggagcagaagctgaaaccacaggtaaaattgaaatgtcctgtaatggccatttctgtgtcggtttcctgttcctttccctaaagtgcatttgcttttgcttttcctccttgcctgctgagatcattgtgtgggtgtgagtgtctgagggttcaggttgataagttgcaaagggaagaggggataaaaagccacacagcttgaataaataaatgcatgaaaatatgtggtactctagcatgccctaccgccatgtctccatcactacacaaggatgtcctcatagattaacttcagcatcagaattctgaaggcagagaagcaaaagtagcagctgtgggagctccctaaagtggaatcgggcatgacactctgaattttgaaattgcaaacccacagttcagtaggttgcagcaacacagaatgcagatggtgtgttcctttggattgtcagtgtagttctacagtgtatataaatggcttcagttcactcctgttggctctgtcactgccttttaacaccaatgtgtcagtaaagccatgttgcagtgacaatcgtgttggtaatggggctcagaggagaataccttgagaaaatttgaaattaaccatttcagaatagggaagtcttttaaatatgattcatgttagaaaaatgaggagcacagtgcactagacatacaaggttactacaataacttggattcacttaatgcatgttatggaatttaagaatagatgaagttgttcattttttttttttttacacaattacatgttttcccccacggtgtgaataaaacgagataagtgcacattataactatctcagtgattaaagcatcttcttttcatctataaatatcatataatagagttagagtaaatacaaggctgtaattaactttaaggccttcactgatacactatcaaaatagggccttactgccttccaatggcagctgagtcaaaaagaatggtttccatttagaaataatgtttggaggttttattcaggatcctatgccttatttcccaacacacagcttcagtggccagttagaaatataggttccctgccatttgcaatatctcatgcccctcctggtgttcccaacagctttgagactcagagcccacaagtggaatctgtgcatgtgagacttatttaaaaaggaaagttttttaaattttgtgaattacatttttgagactgtcagcttagagttgtcttccattaagttgatagaacgtgaagcaataggagagcagttggaataatatttccttagcagaatgttatgccttgcaaaggcaacttgtcattcgaggctttcttttatgggatatttagagattttaaaaaaaaatctgtttatcaattgatatacagttggccaatttaaaatgatgacttcatttcactaatgaccaatcagtgaaaggagtttaaaatcaattaactttgtgtggggccaggctgaatattatttgtttcactgttgtagaatgtctgtagaatatactgcatgtaaagtatattgtagttaagggtcagatgccctaattctgctttttagttatatgaccttgagcaagtgaatacatttctcagtttcagggttttcgtttttgtttttttcttttaaatggaggtaatactactttcttttggttagttgggtgtattaaattagaaaatccatgtaaaggcacttaacaagttgtctcgcatttagaagtcctcagacagtgttaacaatgatcattattatgttaattacatttacccatacaacctaggatagctataggggaaaaaccaaaagccaacaaatgatttagaatcacagatggttaatactaggaggaaaataactagattttcgtttaccctccttattgtacagttgaaaaacaatactcagggaagtctaggaagtgactattccaataacatgcatctatttgaaggaagaagctgcatcagggtgctaggttttctccaatcagcagtgatttctgctatgccatgtggctttcaaatgtatctgcttaaaaattagcaggatgacttgtctttgaaaatagaattacttcagtgtcacctcactttatattcaaacctacctagaacctattaaatggctggaatcaagggaccagttagtatgtatgatataaccagttgtaataagcaaggtcactactgtgttaaacactatatgcaaccaatctttgaccattcattctgcaaatacttattaaaacctctggtgtatgtcaggcactctactagcagtaatgatagttaatatgtgttgaacacttatgacacttcaggccacaggctaagaactttgcttatgtaatctagtttgactctaacagaaatcttaccaaataagtacttctattagtcccactttatgatatgatgaaaaacaaaaatcaaataagaaacaagtcctcattctatcttaacagatgatctgctatgcttatagcctcaggaataaaaacagtgtttgtcttctggcacatagatgattcccaataaaatatttgtttaatggattggcatacagcctaatggagattaaatacagataaaaattaatacaataaaactagtccaggcagtacaaaaaccagcacactgaaatatagttaggacccaaaagaagaaatgggcttattcaggaaaggcctgaattgacagattctacaggtaaatcctgacttaaatgacattttagatccttgccttcttttcttttgatagacacagaacgagatcattcagggcttagccatataggagtgctatggtttgaatgtttgttccctctgaaactcatgtcgaagtttaattgccattgtaacagtataagagctgggacttttaaggcatgattaagtcatgagagctctgccttgaggggtgagattaatgccattataaaagagcgagttgagccctttcatgctctcttgctcacttgacaccttgccttccaacatgttgatgacacagcaagaaggccctcaccagatggtggcactttaaaattggactttccagcctccagaactgtgagccaataaatttctgctcattataaattacccagtctcagctattctgttatagtagcacaaaacagactaagacaagggacaacttattttttatggttgttcaaatctttgttttcaagtatcctttttacttttagaggaatttcttcctgtaaagacaaacaaacaaaaaaaaacactaaaatctagaacatacctgcaatgctgatttcctgttttgttcttccaagtcacttccttaggataaaaagccactactctgtgcatttagagcccctgaaataaattctccattttcaaatgaccttacaagaagggactagaaaattgctagataagtcagaaaagatttttattttaaaaaattgatgctcttctctggaaattatattacagttctagctgtgatatgtattcacaaaattaaaaaaaaaaagataatccaagagtaagatgcaaactcatttttttggcctgtgtatgaaaatagacaaagaaaaatatagggcattttggggctgttcaggccaggataaaaaaggaaatgggtgtcattcctgaagcttctctctctggcctgctttttccttttctatctggaggctgacagacaggaatcacatagaagttattttgaaggtaattttatatggagtggagacatttttccccttctgcagtcataagccttgagaatttatcaccagcttcaaggtaagaaacttttttgccatgaatttgtctgctctaacgttccttaactttggtctctcagccaacaacttgccccttgtttccagcccagcggttaggtggtttgctaaggtagaaggggagcaaagcagcttaggctggggcagccaaaatatccatccatccctgctttgtgttatgctttctctgtatatgagctctaggttagttttacctcctcaaacttttctttgtttatttccccttaatgtctgcctgggcattgaatctgttgtcttgctgccttggcttattttttttttttttttgggggggggggcgggggggggggtggatggagtcactcactctgccacccagactggagttacagtggtgtaactcagatctcggttgcagatctcggctcactgcaacctctgcctcccaggttcaagcaattctctggcctcagcctccctagtagctgggactacaggcatgcaccaccacgtctgactagttttttttgtatttttagtagacacagggtttcaccttgttggccaggctggtcttgaactcctgacctcaagtgatctgcccacctcagcctcccaaagtgctggcatgataggcttgagccaccgcacccggctgctgcattggcttttatgtcttcttgacactctgatttgtgtgtttatgatgctcgtgtatttaagtgctcaaaaatatttgtttttttttttttgttgctgttgttttttgttttttgtttttgttttgttttgaaagaaaaaacatctatcaagggcccacagtgagtcatatctcaggcttcagtgcacttggctttgtattctggccctgttagccacccataccgtggagagagaatctctgcatttccctctctaggaaacaccacccaaacacttgggttctagattctaatatatcacattcaaatcccactgcgttgctccctgactgtgtgacctcagctatgcaagttgtgtgtaccttttcctttctttcttctatagggttgtgaagaccaaatgagatggctcatatgaaatgtttagcccagtgctcaagaactcttaattaccttttccctccccctttttttttaaatctccccattcttccttaaaggtgaaaataaacatcactgtccaaaagaaaaataggatggaatcaagattaaatgattaaagctggaattttccttttacgtacttaaccagtgggtcattcaaggtacttcacaatttgttgagagaaccattaaacaccattagtaggtcatctgccactgacttcaaaactatagtctttaaaacccagccaaatagggaaatcatcttaatagctccgatcactttgatttgggccagaaggccatggtgacagatgcactaagcatctcataaatagcggggtatttcctttagcaattataattcacagaatagaaatagtcatgtgctattattatgtaatatgatatcacttaaaaatgtaaaactgtcgcaggggcattctggccaactggccctgcacctttaaccacacttcagtttgttctggtctcatctgaatgaccctcacatcataaaatgtctttttctccttcaaattctgaaaggaggatttatactagtacagcatatagagctcgaccgaacttttgagactacctagtcttttaaaagtcctttatgagatgtattattctagtttggttttctgaatgtacagataaagaaactgatttagagcagtgaattggtttggcatggctaaatggatagtaggcggctggttcagaatttgaactgacatcgtcctaactaaccaaggttaagctgaaaaataaaacctttgttttatagatacagatatgtgtgtatatgtgtatggtgcatacatacatatataatatgtgtgttatatgtgtatatatgtatgtggatatatatattcccctccctaaaatagtgctgagatgtgtcctctgaatatctaacacctctgagttttttgttatatttttttcctaaatgcaatcagcttttactcactgataataaaaattgcatgtgctaattttgaagaagtcaaaaaattgagaagagtagaaaaagagccaaaatcgcctgaaatttcagaagtatctgtgaaaattttgataaatgttacacaggtatatttaaaatttcataaaaatataagtagaactcctggagaaaaatcaatgattggttcttattcccaggtcctaccttctaactcagagcatatagtacaggaaaatgataggattcaaaatgtggttcaggaaatgcaaatatcaacgtcacctgtgaacttcagagaaatgtacgaagtcagaacctccccaaggcttactgaatcaagagctctgagggtggggcataacgatctgggtcttaaaaagtccaccagactattctgatgtaagatcaagctagagaacctatggcatgatgtattagtctgaaagatctgagtttgaattcgtcttagccgtgaccttcattggatcatgaccttaattaagttagtcacccaactgttcctcatggtgaagtgaagataatatttaccttaaagagttttgaagattagatataagttacatgaagcattaaatccagagactagtccattgtagaagctcaatcaatgacaaccattatagaaggccaccattgctttcatcagcagctcagttacacaagtcatttttgagagatgcagtagcatgcactctaggagagaaacacactgttgttaatatttaaaatatttcaaatagcattacagccagagaaataggatccatctaattcacaatttgtattcctcagaagcaacatgtagttcttcattgccaagtaggtctcctttcaaagatggataggtaattttttttcaaaatattttaatccatataatttgagcaaatactcggggacatgagattctatgatgaaagctctgttttgatcacaaaactctgaactgcaaatgtgagagtgtgtgtaattccatctttctctttttatttatggaaaaaaaactaaatcgaaccaggtagttgaatccttctttcaagaaggattaacagtcattgggaccacgatgtatttggatagaacaagaggaaaaaaaaacatggaaataaatatgaaatagaaataaacatgattgtgtttttagtggtatttgcaatgccttacaatattactaatatgataataatcatattagtattccactttcaggtacattgatttaatgaagattactgaaatgatttataggaaaaaagaaacaaggtgaatttaataaggtgccagacaactgccctctgagtctataaaagtgttcagagggaccgaattcggcttaacctgacccagagtggcacattacaagaaactgcctcagtcttactcaagtgtgaacgtggctctagcaggccctactgggtattagttatggtgatgctgtatcaagtctgtggagtgttcattccccttccacctctgatccatgtcttttaatctcttaaactgagaatgaatggctattaaaaactttcagtgatttcagaaagattctttaaatataaaccaataaaatgaaataatgcaatgacaatatttaagcaggaatattatggcagataaattctgggaggtttactgctaatggccacttgacatttttaaatagagcgtttcagtaaatcactgaaaattagccgacaagaatttatactcatctatttaaatgatacttgtaaataagtaaatacggtttaaatatagtttgagtgatggtggaatttatagcaggaaatgtcctagtgtaggtttttgttctaattgaagatcaagtcaacaagcaactattgtagttgctttgttcccaggaacagggaagtatgctagttcctgcagacccacagaggagagaagcccaattctgcaaatccagtaactcattgctcaggttaaagtctatcaccctttaccccagaaaacctcctttccttaccacacaagtggacttacaagacttccaggttagaatttagaaatgctcctaattatatcttgtggattttagcttgcatatagttcaagagctatacactggtcaggggtttataataaatatcagtggtatattttaattatgtacatattaatgcattcatttcacaaatacttactatgcatgttctcttatattccagacgttgttctggcatagaagatggtaacagtgaacacagcaacatctgttctgccctgaacttatagtctatagttgagagatcaaccatgaacttgtaaattttttaaaaagataatttcagttaatggtgagttgttaaggaaaaaataaatggagcaatggcatagagagagtaactttggagagagataaggaaagaaccctttacatggacctgtctgaaaagatctctctggaaaggggacatttgaattggagcatgaagtgggggaagaagcttgaacggtggccaggagggtgaggggcattctgagtgaagagtggtcagggtacaggcttgaagagagagtgttctcagtatagcgcagggttagagagaaaggtcagtggggctggacttcatgacaagacagggaaactgtcctataagatcagtttggtaaggaaagcaggatatatttgatagtcttctagagaacataatttactatgttttgatattatagtgggaagtcactggatctgaggcatggaagtacatctactttgttattaaatttctggaaatggccaaaaatcgtagtaattttatacgtactcttaaaataggataaagtcagccaggcatggtggctcacgcctgtaagcccagcactttgggaggctgaggtgggcagatcacgaggtcatgagagcgagaccatcctggccaacatgttgaaaccccgtctctactaaaaattcaaaaattagccagacgtggtggtgcacgcgtgtagtcccagctactcgggaggctgaggcaggagaatcgcttgaacccaggagacggaggttgcagtgagccgagttcatgccactgcactccagtctggtgaaaagaatgagactccgtcagaataataataataattataataataaataaatatatatatatatatatataaaataaagtcaagcctcctaagtcatgttcagtttacatattggggaaaaccccaaagttacactcagtcatcacttcaatgcaagaagcatgtataattacaaaagttctcaggcagtcttttgaaagatacaatactgatgaagaaatagtttctgtctcaagtaagctgcatgctattagagaaagaagctatatataattacctatgatatacaattttaatgaaataaattctgtattggaagcctaaaggaaaacccggcaaattctgaataacattaaacatttattcttttttaaaaaattttattattatactttaagttttagggtgcatgtgcacaacatgcaggtttgttacatatgtatacatgtgccatgttggtgtgctgcacccattaactcgtcatttagcattagatatatctcctaatgctatccctccccgctccccgcatcccacaacaggccccggtgtgtgatgttccccttcctgtgtccatgtgttctcattgttcagttcccacctatgagtgagaacatgcggtgtttggttttttgtccttgcgatagtttgctgacattaaacttttattctacaaatatgttttgattgcctggcacatatcagaaaggatacaatggtgaacaaaacatgcctggctcttgctcttaatgagtttgtagttcaattggggaggcaggaattaaatatgaaatatagtcacaaattggaataaatgcaaaaagcaggaaagaatagcacttaagacagtatctggcgcatagacacccagtaaataccagttgaataaattgttgtttatagaagaaaaacagggattaacatgccttagagacagcatgttcagaaaaaacctccccgaggatttaccgataaaggtgaggtcagaagaagtgaaggaataatcatttcaaaagatttggagatgggatggcttctaagcagagggtccagtatatagagatccaaggatggaaaagagttctagaatgtgtcataaagacagagacatgatgttagagaggaagagaatggtgaaatagggtagagtattgcaggtcatgagaagttataagtcagtatgtaagccattgtggggctttgtatgtttagaagatcatcctaatttctgcaaaacgaattgactctgcggggataagagatgatgtttgtgatgatattgtatgaaattagattaaaagatgatggtgatttaggctaagatagtgagagtgcagatggatgaaagtggctgaatcaaaagggtttgcagaggcagccactggatatagtggaatggtgcaccttctgtcttccaggtatttaagctaaaagcttggagttatccttaatttatcgcagcattaagtgtgaacttgttaaaaaaaaaaaatcagttttcttatttctctgctcataacccattccaacagttcgatagtttctcatatcgtttttttttttttttttttttttgatggatttttgctctgtcgccaggctggagtgcagtggtgcaatcttggctcactgcaacctctgtctcctgggtttaagtgatcctcctgactcagcctcctgagtagcttggactacaggcacgcaccaccatgcccagctaatttttttgtatttttagtagagatgggtttcaccaagagatggggtttcttaacctggtgatctacccgcgttggcctcccaaagtggattacaggcgtgagccaccacacccagccagtttcccatatcttttgaagaattgaaactcttaagcccctaaaagctcttcccgcttattaaatttataaatcattcccctacaagtgtcccctttagttaatctaagctgcctcactggccttctcccagcattcaaataaaataatcacactacctcatggtattttccctagctgttccctctagctggaatgctcattccctagatagacacttgaagattttacttcctttagctcttggctgaaatagcacctaaacagtgaggtcttccctagtcacttatttccttatgtcctgaccctccttctcggtatactctatcctgtttctctgctttattttctttttagtgtttatcagtatttaacaaagtatatattttgtttagttttagcttttttggcttgtcttcccactaaaataagagaactgggtcttgttatttgtttattaccatatccgtgatgtctaaaatcgtgaccaatatatgttggttgaatgaataaatacatgacaatagttggagaaaggagttagtaccttccagaataaatgttgttataataactaaagttgattggccatttgaaaacaggtcagttgttgagttattggcttcatgcaacaacaacccctgtgggagatgagtctgggtagatagaattgggactggttggaagaatcttgaataccttgtcaagaagtttggacatggtcttatggagagttagaatccattagaaaatttttaaagagaagggtggtgggctgggtgcagtggctcacgcctgtaatctcagcactttgggaggccgaggcgggcggatcatgaggtcaggagattgagacgatcctggctaacatggtgaaaccccatctctactaaaaatacaaaaaaaaaaaaaatagcctggcgtggtggcaggcacctgttgttccagctacccgggaggctgaggcaggagaatggtatgaacccaggaggtggaacttgcagtgagccgcgatcatgccactgcaatccagcctgtgtgacagggccagactcagtctcaaaaaaaaaaaaaaaaaaaaaaaaaaaaagaggtggcatactccccttacgtttttgttaataattttggaaatggtgtgcagcaaggagcttgagtgggtagacattggaattaggaaaaatctgttgaggaaattattgaattgatccagctatgagatgtatgagaaatgttgaagctgaaaattgttttaaaaatagaaatagaaagaagaggaagagatatgggggatagaaattatgagttcttgcttatagtagtgattacttttggatttaaagacattctttctcattaagacaatttctttagtttttcatatccctaattcctcataaagcatttgtgtcagtggatggtcttgaacattgaaatctaccctgagtactctagtaccatttattataaaacaaattatgttactgtcctggctaaagcatctaaaactttcctgaaatgtttttcaggagcaagttcactggatttttagaaaatctccgttctttttgtttctgtcacttaccagacatatgaccttgagtatgtcatttaacttctctaaatgttgtttccttatagtataaaagaacatcttgggaagaggataccagtgacttatattcaaatagccaaagtgttgtcataattataatagccagccttaactgagtgcttgataaatgaccagccttgtgtccatcaaatcctcatagtaacactatcagtttggcatcattggttaaatattcctgttttacagttgaggaaactgagatgtagagaaggtattctgtttacatagggacgcttagttattggtgaagtctggatttgaatccagtctgtctgactccagatcttacacttttaaaagctatatgcttgctggggtagaagtagaagacttgtagcagttccaactgaatataaggaagagctttcaaaaggcagagtgagaacgagctgttttcacagagagtagtctctccctgtcataacacagcttcaagcagagactgggcactcatgagtatccagtgcttccattccaccaagtgtttggcaaggagatccaatacctaaaatggtagctgaactagatggctttgaattccttcatgctttagattagatgctccaaatctgaggatccaggagacaacagcaatgctcatgataatttctgtttcctcttatttgctatagcatttgaggtccatagcaattttctagcatttctcacttaacgttcttatgtttgtagcttattcctctatcaaaattttgaggacagggagtacgtttcattcttccatgttttctctgatgcgtagacataagttttggtcactacaggcttttaagtagtattgtgtatgtattacctattgaaaagcattatgggccaggcgtggtggctcatgcctataatcccagcactttgggaggccgaggagggcagaacatgaggtcaggagttcaagaccagcctgaccaacatggtaaaaccccgtctctactaaaaatacaaaaattagctgggcatggtggcacgtgcctgtagtcccagctactcgggaggctgaggcaggagaatcacttgaacacgggaggcagagactgcagtgagccgagatcatgctactgcactccagccagggcaacagagtgagactctgtctcaaaaaaaaaaaaaaaaaagacaagaaaaaagaaagaaaggaaaaaagagaagtattatgaagaaataatttgtttaattctacttaaatatcagttgaaagaagaaattatttcaaaaattaatggctaaatctgaaaggtcctatcaactggcaactctttcaggatagaaagatggacagatagtgcctatgagattatgatcatggccctttaactgccctcaacgcatgaatgtacctacagaagtgaggacatggaaagtctaaatctcttcatcccacttgagaaagatgaatttacaatgtaggatattctgtcatcttaagataatcaaaaactagacttttctttgttgggcgcgaagaaggaagatggagaacctcttctgtttgcaagatatattttgaaagagtgtgaatacaatgatggcaaatgcaactcttcaagagatgcaccattgaaataaaagtggtaaaagtgagacccattaaatgtgagcaccgttgagtcaagctgcatataattatcacagaagataatacggaagcagagaatgttgttaatgatttctcagagcccaagtggtgtggaaaacaactctgagtgcatttactcctccttttgtgtagcctatcacaatgtaaaattgagggggcacctggcattaaatactgtatttacgaaaatgcagtaaaaaaatcaagatagcatttagtgtattgttcttccacaaaagagagagaaggaaaaaaaattgcctttatcgaccaacgtattccaattatgatgttttatttaaataatcaccaacgggcaatttgttcaaagttatttctatattcccagcatgaaataatcccctatccactcaagtttttttatgactctaagatgggataagtagaaccataattacaggaaaaaaatttgggcgttacgattctagtccaaagtgttggggcattcactttcgtggcctcggcagtaccgtttgtctttgttgaggctctattttccccctcactttagctatgatttccttatggtattttaaattaattatcaataccttttatgcctttttatgtttttgttctatatttgtatggatagctcttgctattctttgtcaaaattgcttcctgtgcctcacgtgcctctgaactacagttggatcatgatgagggtttctttgctggtaactgcacccgcctcaacagaaacaggctttgttccctggagaacagctttgtgactactgaaccagaagcttcagtgttgcaggggaagggtcggaagatgcaaattcatgtttgtttggcagtggacgcttggctctgccccagtttcatccccatgagtagcatgcgtttattccttgggattcttaatgtgacctatcacttcaggaatatcctgtgcagaattttatttgcttgtactgggttgagttcataaacactaatcacacaaaaaaacctaattagcgcaacaatgaaaatggaaagactgaacatctgagtacttatgaatagtctttcagtgtcgttgattccgttagttatcttgtatattttatgtcctacttattacagtaaaataataatattctatagagacacacttatcaaggaagccaggaagagaagatactggctatagaggttatggctgagtcccaaactgaagagacaaattgatcctcagagttacatgaaaatacaagtgataaacgtggtaagaagtttgtttaaaaggtaaaggggaattaaagaaaaaatggatgtgaatttaaaccccagaaacagtagtgcgtggactggaaatttcaaaatgaattcataagccatcaacaaagattaaagcaatataacagtgttatgggcattaagtaaaatggataaagagaggaaaagtaatcagagaaagtctttccataacaggaaaactaggctgaattactaatggattagtaaggcaaatcagagaaaatgggagggggaacactcttattgcttcaggattctagcctcacgcctttctttctgtgagacccctacaactgcttacttcacctcttagcctcgattttctcagctgcaaagtaagcacaatgttagcacctctcgtaagattatttaatgagatgatgttcagataaagttcttaaagcaaggcctagtatatattgtggtagttgttgttattattattatcattattagaaaaataaatattttagattacctgatcagtgagccatgttcttccaaagtctttcaactgaaaagtcattaaaagaaattatatgtccttgggccagctaaaataggacatgatcgttgaaggacaggcaaatggcaacactgcaactgagtagaggacttccagtgaggtggaagagagaggagagttgccagtggccttctagaggatatgtttgttgttcttgtccctttgctccagggggaaggatggggatcaatcaacatgacagggaaggtatgtctttaagagtaggtctcaaaacaacaaggctgcaataaacctgcctcttagaaaatcaaagagatttagagaatctacatcagctttctaggctcatgagtccagtgggtaccttggcttcactctgtatggcagcaatattagaaaaaaatagttcaaatggagttataatgaagacattaagtcagggatatagattaccttgcctacatcagattatgagttgatatacatatgtattttgtaactaaatatatagcatgtaaatatttaaataagaatacactaataaatataccttatatttattgaatctttcctgtgtgccagatattataagtgcttttatgaattgttttatttattgttccaccataccctgataatgcagaatactttcattattccaattttgacaatgggaaaattaaaatgaagacaggttaagtagcttactaaagttcacttagttaggaaagggtggagttgggttctagcccagagtgtctgcaactggccccataatcttaaccaaacttaaaaactgacctttagcagatccatgatcaccatatagatttgactgaatgacagtaaaattttcttaaaatatgccttcaatgttcctgttgaaagaatttgccttttgaaaataaaacaatttctttccagatacacttaatggcataaaattattaagtaacatcgacactagctctacctctttctctgaaaattagagctaagtgacattttcagacttttctaggtagacaatgtacttgctattccaggaattctcattcaatagtgcattttctctttctttgtctctctttccttttcttcctctcttgttttttccttccttttttcttttgttctcataaattcatggaagtctgtcaaagttgtgatagcatgctacgacacattatatttttgctagtcatgaactccgttacaacatattatctggtttgcaggtcatattatttgaaggaacatgctttgctgaaatcttaaaaggataccaaattgaagctctgatttgcaagcattttgcaatcgtcactcaagccatatttgtcttttgaaatcagaatttatggaggacttgtagccttaaaatctaacaggagaagaagttgacagaatcgttgatgatatttaactcaaatttcatagcaagtattttgtgtattgccagatcagaacctctcaggttatcataaatagggcttgactattttattaatagcttggttggtgtagtagtccattctcacattgctatgaagaaatacctgagataaagtaaggaaaagaaaagaaaagatgtttaagtggctcatggttctgtaggctgtacaggcagcatggcagcatctgcttctgaggaggcctcagggagctttgactcatggcagaaggcaaagcaggagcaggcacttcacatggggaaagcaggagcaaagagaggggaagagaggtgccacacattttaaaatgaccagatctcatgagaactcactcactgttgtgaggaaagtaccaagaggatggcactaaaccattcatgagaactccgcccccatgatttatttaatcacctcccaccaggcctgacctccaacactgggggttacatttcaacatgagatttgagcagggacacagatccaaatatcagttggctggctagcaacctatggcttcgtggctttttaggatacctgttttataaacacacacccctgctttcacctctaccactactaccatttcgttttgcatacaaaagaataaagcctagtttatcacagcgatttcacaattagcaccacagatgagactcatctttttttttttaactcctttgtttgaaagatgagccaactaaagctaaaaaagtgacttgtgaaaggtgatacaaatccttagaggttcagccaagttccaaattctaatctttcaaaatccatcccagctatttccaccatcttatccaaacaaatccaactaatcaagttgctggtataatgctagtgtttattaatcatgagggctctccttctgtgtattgttctcagggaccttatgaataaaaatgctggttctcaaggggagtgagatatgttgagctaggtgtgctgggctgtgttcagcaccctgtcagcagtcctaatagagatactatcatgaccccctccctgctttataaattaagaaaccaagacttaataggctaactaactatctcagaccacacaatagtaagtcatggagtttccttgtaatcccatcttattgatgccagactctatacagtgctgcctcccttgtctcatgctagaacacatataaatggtgcctgcacatttacaaaaattcatccattggctcatccaatgttcttttcatttctccttttttttttttttttttttttttccggtcagggtaagggtctaggataaagggtggatgcagtgatttgtagtttctctgttttttgctggctggccacattctatagcaagctgatctcaacgagccctacttgggagagctgcttggagtgtgtaccaagctggggcagccatagcctttgattaagaggataaaaaggcatctctggttcctgtggttttttttttttctttgcttttgttcttgtccacaggagtggtggggatggatactgaagaggctcagtaggctgaatgtgaagaaagttgaagaaagcccctctgttatctaaggaataaaaatcacatgtcagaagtttacaaatggaaatttgagcagaacggtagagaattccaaggctccttatactctttctaatcagcagttacaaagcatagtccagcaaacttaaatgccagcatatcaaaactccctgtcttatcataccctttgagaattcctaatctgaaaatctgaaattcaaaatgctccaaaatcccaaactttttgagtgctgacataatgatgaaaggaaatgctaattagagcatttggattttcagattagggatgctcaatgagtaaatataatgcaaatatttaaaaaaaaaaaaatcggccgggtgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactggggaggctgaggcaggagaatggcgtgaacccgggaagcggagcttgcagtgagccgagattgcgccactgcagtccgcagtccggcctgggcgacagagggagactccgtctcaaaaaaaaaaaaaaaaaaaaaaaaaaaaaatcaaaaatctgaaactcttctggtcctgagcttttcagataagggatactcaatttgtagtgtacgtaagacatacagcagggacaagaaaaatgaaagcaagcaagtttacaatttgtttccccttaacaattaagaaaaaaattaaactctatcaacataattattcacctttattaagcagtcaacattttcaggcagaactagtttgtaatttgacatattcacccgttcattcaagaagtatatagtaactatataacacaataagtaagagatgttttcagccaacttaaaattcaaatacaaggaagagacatgttaaaagctgatttataatgaagaggcataagtgctggaatagagatatccataaaatgatttgggaatgtaaagggggaaataattatttgtaaaaatgttggccaaggttttgcagaggaattgacagttgagttgggttttgtggaatgagcagtcatcttccagaagatgaatgggataactctaaagcagatgaaacccattgtgtgaaagcttgacgttgcaaaaagacgtgatccatggaaggaaaggtagatagttcaaagtagtggggtgatgtcaaggagtggtatgacaaaggaggctaagtgctggccttggaaatgtagttgagattataaaaggttcataccaaaatgtgaccaatttcaaattccaatctcaatatgtgttttattataaatcagtgagattaattttctgtggttcatcattaaaaaaatactttgcaatagtgttaaacaaggttaggtaaaatcaaaagttgttccaaaattatcttggatctgggtagacatttgtaatacaatcttgaaagcataaaatgaaattttgtgatttctcactggattacaaaatcagttggacaatctcataattaaaatgtctatattgttacaaaaggtcaacatgctgtacttattactgtatctggattatatgcccactgtggttattcagcgggctatagcagaacgttacaaagtttcttattattgttgtttgcttctgcttttcctaccctctacccacaggactaaagggtttttgtttgtttgcttcctatatttatttatttccccaccccatggaactaagatggctttatcaaccctaacaatgaaaagtctcagtgatttaaacaacacattcattctcacttacattcgtgtccattacgggttaactaggaacttcactccccactgtccttgctccgacatacagcctgatggaaacttcaccatctgggccactacaagttgcagaagcaattaaaatagaacgtggggagaatcatgatctttcttattaaaggctagctgtaagggtaataaatgttacccttgctggtatttcattggctaaaatatatcacgtggttttcccttcttttaaaagagactaaggcagtacagtcctacagtgtgtcttgagggaaggtaaccccaattatatggggaccacactaccttgcttgctatgtattagttagcatggtcttttgtcaaagaagcaggaactgggtggcttaaataacagaaatttatttgttcacagttctggaggctagaagtctcagataagggtgcagacatgctcaggttctggtgaggactcttcctggcttgcagatggccccgcttttgttgcattcacacgtgacagaaagagagagttctggtatcttgtcctcttgttttaagtcatcagtttcattggctccaacctcatcacaccatttaaccttaatcattccctatttccaatagtcatttgggaagatgaggcttcagtatgccaagtttagggggacacaattccatccatagcattccacccttggtctccctagatttgtgttcttcttgcataaaaaatacattcattgtatctcaacagttccaaaagtcttaactcattccaacaacagccctaaagtctaaagtccaaactctcatctaaatagtatctaaatcagatatgaatgagactcaatgcatcttagaaaaattctctcctgctgtaacactgtgaaaccagacaagttatatgctttcaaaatacagtgatagacagtcgtagactaaaacttcccattccaaaaggaagaaatgataaagaaggaagggctgacagatctctgtcctctttagctgaaactggcagtgttgttaatgtcatctctattcctggtttcctgatgagatggctgattaagtccatgagtcactcccatgctgtctttatcaaataaatggttgtttaaccatactcatagtgttgtcttcagaacaagctttctcattcatttattcttttttttttcaatatgcatgatatgaggattttccagatcttcaaattctggcttctttttatttaaaacttcctttttcaattcatttttttttttattttttgcattttactataagtagtcaggagaaacaaaaccattctgctatggtatgtgtctcccaaaattaatgtgttgaaaacctaatctccagtgcaaaagtgtggggacttttgagaggtgcttaccctcatgaatgaattaacgccgttataaaagggcttgatggagatagttttgtttcttttttatccctctcacttcccatgatgtgagggcacaagcaacacttccctctggaataaccatcttgggagcagaagcagctctcgttacacgctgaatgccagcaccttggtcttggactcgacaacatatagaactatgagaaatacatttctgtgctttataaattacccaggctcaggtattttgttatagcagcacaaaacacactaagacacatttcttcagccctttgcctaaaaattttctcagccaaatactcaattgcatcacttgtaagttctaccttccacaaaacactggaacacagatcagccaaatccttcgtcactttataacaaggacacctttcctccaatttctaatatttccatctgagacctcatcagaattgcccctaacatctgtatttctataatgcacctcaaagtgcttctagcctctatccactaccagttccaaagtcacttctgtgtgtttagttatttgctacagccacactctacttcttggtaataaaatctgtgtcacttccagggtgcaataacaaaatatcacagattcgatggcttaaacaagagaaatttattttttaacagttctggaagtccaagatcagggtcccagcatggttgagttctggtaagatctctctccatgacttgcaaatgtctactttcttgctatgccctcagatgacagagagaggtttggtatcccttcctcttcttgtaagggcacccttctattggatcagtgcttccctctcatgatctcatttaaccttagtcacctccttaaaggcccgctctccaatatactagcactggactttagggcttcagcttatacattttggtgggacaccattcagtccatgatatattttttatgaagattgactgaatgtaaacttggaaatgacactattgaaattatttggtgcacgtaaaagatggattggtgctataatagcataaatcatattaatcatacagacaaaatattaaactgtgctctagaaattgttagttaacaaagtcaagacttattccccagaatattcctgtttggggtttattatttttttttgtaacttatttcaccaggattctaaaaacgacaagtcagaatggagaagaagtgggagcttgctcggctgtcatgctttctctctcctcccgtccctcttggtttgcagaccctcttggtttgcagaatggaggcagttctgctgacaccctacagattcgcattcgatgagaggccaaccctgaagatggtttcagtgttcttcccaggtctctgctgttcctgtttgggtctaactttagactaagtgacaggcgtgccaccgtttctcaaaaacaggtcatggcaggcccctgtgagttgttctagtttaattgtgtgattaaaattagagaaggggattttattttattttatttttagctcagaacctaactgagtcattggtttgtcctaaagataaattctctttcttttctttctgctgctgatggatttttcagtattttttttccaaactaccgggatatctgtgtgaaagacaggcaaagtttatccatagatttgtttacttattttatgtttaaactgaattatctagtactttggcaaaggacaaattttacagcttctttttttcttttcatgtattgttttctgtttatgctttcatttttctctgagtatttcagttagctggtgctactatgttgttaaataattcatacagaggtagggcatgaccatttatgaagtacttcacatttgtgatgattgaaaaaaaatctgtcttaaatgtctgtatattattgttgaagatgaggctgtagatctctttttcttttggttcattcattttatatatattttatatagaatatatatttaacaaatcgtaatcatacataattatggagagatctctcattctgaactaaagaatggctcccatgcctgaggcaaagtaacagttgggacattatttggccaatttagctgggattaaggagagaaaaaataagcaaaatttacatttcaccaaacaatttccccaattcatctccccaaatactcataatttttctcttttacattttgatcaaatttttacaataaactttttattttagagcacatttaaatttcagaaagttttagatgtacagaattattgcagagagagtacagagagttcctgtgtgcctgacacacccaattgtccaggttgctaacatcttgcaatagtatggtgtcacgattaataaatcaatagtaatacattattattaactaaagctcatactttatacagatttcctcaatttttctctaatatccttttctgttccaggaccccatcctggataccacattacttagccttcctctggttgtgatggtttctcagtctttatttttgaccaccatggcagttttgaggagtcttgattaggaactttatagaatgtcccacagttgagatctgtctgatatttttctcttgatcaaagtagagtaatgtgttttgggaggaaagctacaaaggtaaagtgccattctcattatgtcatatcaagggtacattctgtctacatgacttactgcttatgatattaaccctggtcatctgactgcggtcgggttttcaggtttctcaactgtaaagttattctttttttttttttttttttttttttttttttgagacggagtctcgctctgtcgcccaggccggactgcggactgcagtggcgcaatctcggctcactgcaagctccgcttcccgggttcacgccattctcctgcctcagcctccccagtagctgggactacaggcgcccgccactgcgcctggctaattttttgtatttttagtagagacggggtttcaccttgttagccaggatggtctcgatctcctgacctcatgatccaccctcctcggcctcccaaagtgctgggattacaggcgtgagccaccgcgcccggccaaagttattctttatcgtcctttccatgatgcatttttttttttttttgaagaaagtcattatatgcaactcacactttaagagtagggagttatgttccatctgattggaggcagagtatttacataaatgatttggaattcttctatatgggagcgttcttctcctccatttatttacctatttaattatttatttatgtcagtatggactcctggatatctatgttatattttgggttccaagttaatactattttatttactttgttgctcaagttgttccagctttggttcctgggagctcttgcacctggctcctgtgtccctttgctatacacccatcattgtggggttttttgctttttgttttaagcactttcttgctttctggaattacagggtatatcacctgtatttcttgtccctatccctagaatcagccatttctttaaagggcactggtttctttaccttgaaaaattatactggacaccaacatctgggtgctggatgtgctcctcttaggccaatttttgatgtgatatgtcccattttctgtttgattaggtgttagctttaatattggctggccattgagaacttgatatctctcccatacagtatggagaagaaatattttgttttattcccatttatgctccatatgaactttaggttttgcctccagatattttgctttatttactaacacctctaaaatcagactcatataactttatttaaaaagccatactttgttttagttcaagagaacagagctatcttctgcagtctgcccaggtgttaggaaaagatcagaaatcaaactgtaattgataactaaatacttgtactgcattttttaaaaaaatgaattaacacaagaagtttgttctttaatttaagatcattatacattaaattgctctaagataattatattttggttttattttcttaaaccctaagttatgatggtctatcttttggtagatccagttgagaaatgtcataccatagtgaaaggcagtgggcttgggatgggcaaattcactggggaaatattatttattatattacaaaaattaccaccatcataagatatattcattttagagtggaaaggaaacttaaaaactctctcctctaactaatttgtcttaattttgaataaaatgacttgcctaagttcattcatttatctagctgccaaacaggatcagaattcacttgtcatgagatgagcaattccatccagattagaagtttaactgttcaagaacttatatatcagttatatatattatattatttatatattgctatatgtattttatatatatataaagtagagaatacacacacacatattgcagagatatgaaactgactgcataaagcattttggagataatatatataacagagaatacacaaacacatgcacgtgcacgcacacacacacacacacacacacacacatatatatatatatatatatagatatattgcagagatatgaaactgactccataaatcattttggtgactgaaggcatggccatctgaattgcatttgctatttttaccttaaattcagtgactagaaccaagaaatgttgaaaagaaattcatctctgcttggaaccaaatgtactaaggagaaattaacttatttaaggaaaaaaaaatacacagctaactaggctgcttttgatgattcaccaagaatacatcctttaaatgataccaaaaaatgaaaataaatgttttctaaagaaagccattaatatgcttgcattgcctttaccctttctagcaatcagccaggaactttggatctaataactcaatttctcattcctatggcttctttctgattcttgggattggtgacagggaaagacaccatggaagctagggcacaccagagacttgaggagattcagatgtcataactgctctttaatttcttggaacagccttccttgcttcctggagtccccacagaaagcagtggggcagccacctggtgacccctttatctgaaggtgaaggtgggtaaagaatgcccattttgagcttccaaaatcagcctttgtcttcctggtgtttcagactctaagatgaggatgcagaaagagaaggaaaggaagtacagcctccttagaaggcagagagagaatctctgcttttctaagcatcttcctattgcgttgctgattagaattttatagggaacataaagtctgaaacccttactctccacatttgcctagtcagggctgtttctcttggctttgcactcaattattcaaaagcagacatcactaagaaactcaggaggtgagcccatggaagccagggaggctgacagtcagcttgtagtgtgcagtgtagcaagcaaggcttcacgtcacgattgcatgagaaagccatgcttacaggtcctctctccattcggctttagtggttgcacgtgtccatcagcttgtggctgagcgcaaggaagcatatagctttcaatggggacacaaatgttctcaaaagtgtgtttaactcaccttcaatcatacatcatttacgcacccagggcgttgaatctggggaacatgaacagacagagatgacagaaagaaaattggtatcaaaaagaaaagattttatttaagttatgttttgattgttgttttctttgttgaagatttgaaactgctttatgagtgggagaatgaacagaatacttgaagagagatatgaatacagaagtcgcttttggtaaaaataaggttttttactggcatttacaaatttttattagcagaattttaagtcattcacataggccccactactgcaaagaagctaatatttctgattcctttaaaaactatatttggacaaaccaaaagaacatgaatcagaatctcaatgtaggagggaatgttatttggcaacctgctgaccctagagaacttctttttgagaggacacttttttttcttatctctgaatataatctgattagctctcatcatttaattcaacagagtaacatacagccaaaaaaaaaaaaaaaaacaagtaatcagtgaaaggaaaacataacatgagttttaccaaatatctggtccctaaataaattcttccaaaataatgcagcagtaaatacgacctaaggaaacgtgtaacgacattttgccaggggtgggacagaacaacatggcctaatcatgaaaggtcacctacccaagtccgccaaatagcaagttacctaaagaagtcatttgagaacaaagtatttttatctatttgtttaaagaggatattggactacaggaaaggatctcaacctctttttttcctttcttgaaccaaatgctttgaaaaatgaccgtcaaacaagatgcatttattacattatggttagttaattttctcaacttatcaattacaggtaaatgtaactgtcaaccagaattttttatcagcatgagatagctcctattcatacacggagctgcttttattccagaagagaatgagggaagtaatgagctactttatttggtctgcccagttatttttattaataaacatatgatttatccatgaaatctgttttaaatgtacaaatgttttctcttagactttttaagatattaaaatttgctctcatgccacatattggtaaataggcaaaatagagttctccgaggtcatttcatcctctgataatcagtgataaattgctcttgtagcctctgccaagaactgtgacggttctgagatttcaccctacttgtaagctaacaagtctgccagtttcatggatgctggcagaagccataagcctcctgggtcagagacagagggcagttttgtacgcacagcaaggaatgtagccagaatattggcatttgtgccagttctccaagccccaactatttttttttttcttgagacagagtctcacactctgtcactcaggctggagtgcagtggcatgatcacggctttctgcagccttgacctcctgggctcaagcaatccttccacttcaagccccaagagtagctggaactacaggtgtacgcctccacacccagctatttttttatattttgtagagacagggtcttgccatgttgcccaggctggtcttaaactcccgagctgaagtaatccggacaccttggcctcccaaagtgctgtgattatttgcatgagccatcaccaagctccagcttttacagagaaacacgagaaaagccagatcatacctgtgtgcatagtgaggtgaattacaagagaaaaaaaaaaaaacctgtgtataaaaagaccgaatcttttttaatggatagtacgcatgcctgctcctttgctccagaacagataatatcttgatcatccaagtctgtaataaaacctgtgctttgctatggtagaaggcactatctttgtcttctatggctgtttgctatgcaatttgctctgaaaagatagtccagaccaaaagcagtcagtgcctctgcttgcaaaatgtgcagcaacaaaggagaagcctagagaattgtctcccaacagcttccttatcgataagtgtagtctacattggcaaatattttcattggcatagaaaacacatcagatttattaccaaggaaatgaagttaaaataatgtatttgtcatctgccatgtcccagctactttactaggtactagggttgcagtggtgagagcattctggaaaatctaatggggtacaaagaaatggtaaaataatttctcacatccacttctaaacctccttcttccttccatccttccttccttcctactttatttttttatcctttctttctcccttcctcccttcttcccttctttccttttttcttcctcctcctgtcctatcaatctatttatatttatttatgaaaaaccttctatttatatacccagtactgttgtaggtgctgacaacatagaaataaattagacaaggtaccttctcccttcatggagattgaatcatggtaattagctttcatgcaggtgatgtcacaagactacggcagatggaaacacagagcattacccaaaagaatctacaggggcaaccaccaaacagtccctcatgtccaccgtgccctttgagaagagagaagagaagtgatcgcatccaaaattctgccagcaggcaagggaatgttcccatatgccttttaaactggactagacggcgtgttgttcgggaacatctctattatagtagtcctgctcggagtttgggaaagaattgttcaaatcatacgggaggcagttctttgaaagccccagctaatgttaagagaaaacagatttacaatccgaggccaaacttaataatacataacgaattgcagctctgtttgggaatccccctaggtaccgttcctaaggatttcgagtgtttaattgaaatttcttctgggacagtagtaatcattcacttaagcattatatttatatttgtgcatgaagaaaggaagtcaaagggctaatagaccgactgagtagaatggctgctttcagctgtgggccattgacgagccggcaattctccaaggggcgcttatcctggcgacagcttgcttaggttgtcctccagggactgtgggaggaggacagcactgtgactgacagctgtttcttcctagactgagatagaatacatgatcccagtgtagcccgtttaatcaaactgtttcagtctacaggattaaaaaacctcaagatggaaaagtattccggtagagatttattcttagaaaggctattctttttaccctgatggttaacatagagtgttttaaccccaggggacttgtgccttcatgatttccaaagcaacattaatgagtaactattattctaggagtatttcagccactaaaattggcaatggagtcaaaatgaaagtcatgccgttacaataatactgccttcttggcatcgtcagatttcctatcttctttcagttcgtgatctcagagaattgcattaacttcaactagtttattgcatattctgtaagtcttaagagttgaccccgttgttgtttgctggtttttacaggtacaattttcacctacatacacagaaatacttaaattcaactggtttagtttcttcacagctatattgaggtatagtttacaaattataaaattcccccacttcaagtgtacaattgaattaactttagtaaatttctaagctgttatattctgagttgcgttgccacaatccaattttggaccactgccatcactccaaaaggattgctcatgctcacttgctcccaccttcagctccgggcatcaactggttcaacttcaacctcaccttgtcatggttggtgcacgtcatctaatagatctaggtgtagtttcctcagatgtgagctatagtctgtatgtctgaatacagtagctattattatccttattttataaatgcaaaaactgggatttatagagaccaggaaatatacccaaggtcccagagctaagaagctacagaatttgaacttagtttattctgactccaaagcctctttgcagtgtgccacaccatccctcctagtctgagagtgagctaattgtggatcctactagaaactagagattactcaaaaattattcttgttattattgtgtgcatgtatatatagatacatagtaattctcttttcttatttctcaattatcttattgtaattactatatatacacacacatatactgtatatatacatgatctgtatatgtatatgtacacacacagaatatgcagtatatgtgtgtgtatatgtaaatatatgtatatagcctgttacttttttaattttggtgattgtgttagtgtttgatgcctaacagtgttctgatactagcttaggtaagagttattttctttcacattaaaaaagttatgctatcatctcttttcttatatacatgaagacatctcatcaaaaattgctgtattgaaagacaatattgcctatattgaaaaattataattttacatattggtcagcaagttatttatgtccagctgaatatttaggaatacttgaatttttcagagtttttaaatttatagtacaaataatcagaaatctaacatgtggcatatcagaatggtgtcaaattatatcaatatggactcatacagattttaatagtcagttgtcaacacgtgatgctccagcaaaaggtggaatagggcagtgagaacttttttggagcttccaaaatctgagtttgagtccctgttcttatactggccactttcatgtccttcccttgggtcacttaatttccctggtcctccttgtttgatacaaaaatgagtctgactaaatggcagttattggcatcagccaactcacaataggaagtcaataatttattttttggatcacttagttgtatacctttcctataaaacacaacttcaaacaattcaatactttctgcatcatttgggataaattgaagtgatggaattatgaaaacccatatacatatatatgtgtgtgtgtgtgtgtgtgtgtgtgtgtgtgtatgtatgtcccatatatatggggtatatgtatatatcctatctatatatatacaagatatatatatcctatccatatatatatggaatatatagacaacctatccatatatatgggatatatatagatatatatatgggatatatatatatggatatatatatatgggatacatatgtggatatatatatatgggatacgtatatggatatatatatgggatacatatatggatatatatatatgggatacatatatggatatatatatatgggatatatacatatggatatatatatatgggatatatacatatggatatatatatatgggatatatacatatggatatatatatgggatatatacatatggatatatatatgggatatatacatatggatatatatatgggatgtatacatatggatatatatatatgggatgtatacatatggatatatatatgggatatatacatatggatatatatatgggatatatacatatggatatatatatggggtatatacatatggatatatatatggattatatacatatggatatatatatatgggatatatacatatggatatatatatatgggatatatacatatggatatatatatgggatatatacatatggatatatatatatgggatatatacatatggatatatatatgggatatatacatatggattatatatatatgggatatatacatatgggatatatatggatatatatatatgggatatatatacataagatcaaccacaattaatttcttattcccatgaaatttgaaatcaataatgctgatgactaggtgcatctcctccaggtagtgactgacaacaaagcgtctttcttctggtgacaccaccatcttgaagccacacttgcatcatcagggaaagagaacatggagaaatttcataaggtttttaagttctcttgtttttaaatgacacacattacttctgcttcacaagaactagacacatggcctgacctagatgctatgggttcactgagcaatagctcctgacagggcatagccactttgcagtgacagttctatggaaagggaagcactaattccggtggacagttagttctctctgttgctcaggctaagtctcaaagcagaacatatagaggtgatgaaaaccggaagctgaatggagccttggacatcggagctatttgatattgggggacaaggaatggtgaataacttggtttatttgcctaataatgaagggatggtcctaattagctgttttcaaaagtttgctggccccaagtcattatttaaggggcagctgtaatcaggtcctcacctgctggaggctatcgcagagtccccagggatctgggaacaaaaacaaaaaaacaaaaaaaaaaataaaaccacaatttcaaaccactggatgaaattgctttaggagtccctctctcaacattctctgatttgaggtctttaatatctctctctcctgttttattttttaataaaagtgtatttaagtgatgagtgaagaaaatctagagcaaagactgaagactggcaacttaaaagcctatttaatttggactgtcctttttcaaattttattttttgctatcatttatcaataggtaaatatcacataaaatctagattttaggcttttctagaaacactgcaagatctagcaacataagctccaccttcttaaatgacagaagtctactggagctgaatagcagctgcttttcccaaagggacctgcactctttcctatttttccacaggcccccactgttccttattgccttctacaatggctgagttagcttctttatgttaactgccttgattttgtaagtcatttgaatttgcaaaatgtgatctaatgaaaaattgcgtgaccttgttgaaatttttatctttttcaggtaagcagataattattaaaaacttatgaggaagaataaattgagtctttgattattcttcaatctattttgcatagaaagttttgccacgtgatcctcccctttttggaagacatttatttgtaaaataaatttacaataattgttctcccccattatctgtgttattccctttagcctttgggcttacaggattttaggcttctgctccgaattaatttacgtagtgattttctgttatcagacaaaggatctacatagcaacaatacatatgagaaaagagatgatagcacaatttttataaaaaatttggcaatcttcttcttagagttgtagctaataacgtctttgtgaggttgtgtagtgaaactctgacatatgtcatggttgtcaaagtcggcattaacgcaaaataataagttatttaatataggattcaactttattattttttcaagtaagctgtctatcaccaagttctgaagtggatttctttaaagtctccctgtctccagagaaaaaggggaaaaggcaatgtgtccctggacaggatctatgactcattacgtcaatcaaaccccacttcagaagggaataaagagatttgtatctcaaagcggcgcataacgactcctcggcttttcatttcatatttatgagcggtttactttgaagtgtttatcagccaatgcgcagaaacatgagggaggcttgcccgaaaccatactcatgcctctaatctgtgaaatgctttctgagcagactggctcatcagcgcatgccatgcaaaaataaatacataaataaactttttgttatttgaggtcttggagccatgtctttatataaactataaaaaagggataaatggtgctgaacgttttgaaattggtgtaacacaggaaacttgactctgtaatgtgcaggggggtggtgggggtgcagaaagtttattgcttgaaataaaacctggtagaaagcagacaagtaaaaatacacaaatttttacatacatttctcatctgatctaaggctttgggtccgtccaagtgaccacatgatggcagtgaatagtatatggtgttttttgttgttgttgttgtttttttttttttttttttttttttgagacggagtctcgctctgtcgcccaggctggagtgcagtggcgggatctcggctcactgcaagctccgcctcccgggttcacgccattctcctgcctcagcctcccatgtagctgggacaacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccgtatatggtgttttatttaaaagaaaatttttttggagatgttattttcggagtggttggagagagagcactgccaagatgttgaaaccaaatgaatgaaatctgttttataatttttatctgtactagtatcccatgcatattgtaaaataaataaatgtgtagaagaaaaatggaagatgaagaagaaagaaacatagaataaagtatacattcttgatgaatggaactacgaccttttctctgctttcagtctaactgggttatacattaagcaaactacctgtgtgtttattgagcaactactacactagatcctgggtttacatgggtaaagaccagccggaactgccaaggcagatctggcgtgatgggagaggatgccaagtcaacaagtcagtgtccttatggtgtcacagttcctgagaccaagggccactcaattctctacttctttaaattagatctcttgcttttgtgctcatggctcactgattttatccaaaaagaatgtttaaaggcataagcctaattcactttaataatccacaaattaggtcagtgatttgaacagttgttgggagaaaataaaatttaggagtccataaaccattgtcttataaaaaacagtttcatttctgtttgccctttttctatatattctctacaagctttcccttcaccccctcccctaaaccctcccccatcttccagtattctaatgggaaaggggctttatgtctagtccctggctagagatagttaatcatagaagtttaaagctgaaagtctttatattctagaaagcatggcttgtgagagagtatatagcctttgaagtcaaaaaagagacatgtttgaattgaagtttccccacctactcgttatgtggccttaggaatattatttctttcttttgagctgtatgccttcttcatagttttgttctgatatttttcatgtaaagtgtttataagtctgacacataacacacgatcaataaatattaagccagaaatgtttgttgaatgaagaaatgaatgaatgatgccatccttttcatcccatccttttactttcaaaagaatcggaagcctcaggggattaaggacacatatttgccattgagtacaggctctctaaatgacaaagaaatagttacctctcccctacgctacccctgccaatgtaggtggggtgaaaataaaccatcaggaataagatacgatattgtaattgcatatttctgtttatcttacttattagcttatgagatccccaaaagcaaggacacagattttctgtctgtttccgtagttggttcttagcacacctttctgtctatttgtggagccaaattgaacgaagcagtctgaaacacgtacagtggtgcccgtgggtctgtgtgtgcagtataatggcaactattcttggggagacttaagtacaaagaagcatacgacctgccagatatgcaggaaagtcaaccaaagcctttgtggggtgtgtttctgataatgctgatggatagactttctgaaaggaccattctgattttcttatccgaatggagattgaacacaccgcgcacaagagaaagtgatttggagccaattctgagagagaggaagttgaagcaagaaataagtgtttgaaataataatctgctgctgatccctaaataatctgaaatgagagcacaggaattaatgaggctcctaaccccttgtgacacaggaatagcagacttgtgccagtgacacagcaatttccctggtggtctgctcatgagccgcgagggagcaaacaaaaccattgtctcctttgaaagcaaagctattttaataagggaaatgtggcttctcagatgaaagctcacaaagtgccagatagtgcaaatgtttttcataaagcacctggaaaacctcaccaaagagaaacatctcaatagagaacaattgtcagattggatttaattgcccgtcattctagagatggagcagttttgctgagaaaagttggcattttaaaaaagaagcaatctaaaagaaatgacccttaattttttttttttttttttaaagctaggaagatggctgggtgccgtggctcacacctgtaatcctagcactttgggaggccgaggcgggcagatcacctgaggtcaggagttcaagaccaccctggccaacacggtgaaaccccgtccctactaaaatacaaaaattagctgggcatgatggcgggtgcctgtaatcccagctactcgggaggctgagacaggagaatcgtttgaacccgggagacggtgtttgcagtgagctgagatggagatggggccactgcactccagcctgggtggctgagcgagactccatctcaaaaaaaaaaaaaaaaaaaaaaaaaaaaaaaaaattaaaattaaaaaaaaggcaggaagatgcaagagggttgcatctctattctcagctctgtcagagatatgctttgtgacttctggaaagcccagaaacctccctgttttttgattctcagagaaggtaattcttgtcacttcccatggaggatgttgcatcctaaggcagtgggctttgaaaaactctttgataaacctcctctcggaatgctaaatagtagaagatagcagagtcactggattctgggagatattttgaaaaaaatgaggaaaggcaaggaaagttgcttgcaatgactaaacagttattgagccctgggtatgccttgccagaacccctgagaggaggccaggcactgttgcttcacctctgataatggccaaatggccagagtatttgatgtttatgcaggggagtacactgtttgtgcattccaggatgatatcaataatagaacacagtacccatttctcataagaatcctttgaggaggttggtgttttgattcagagtgattttggccttccatacacatgagaattttatggaggaagcatggctgcattatacctttcatgggccttaggcatgtttgtcttcatcaacccctttctccataaaaagacatttaaaattatatttctccactgccttaatatgaaagcaaatgtattgcttttgtatattaaaacattctctctgacctaaaagtttatttcttttgattttcatagaacttaaagcttttccgtgggtgcctgaaagtattgtgggccttataatactgagcctattgtgtccaatggataagttggctctgggaggaaagctttgttcaagtcgacattttttttaaatctaaatgtatgaattccaatattttgaggaaaaaggccttgtcttaaagatgaatatccttatctgaaaatagtagaaatttgtaacgtaatactaattgattactgtggattcagaatttgtagttataacttatacttcaggaataacatggtccacatggagcacagagccctcgttgctttgactttttcccccttatgcaagagccatcctttctttttttttttttttcttgttgcccaggctggagttcagtggcgcaatctcagctcactgcaacctccgcctcccaggttcaagcgattctcctgcctcagcctcccgagtagctgggattacaggcatgtgccaccacacctggctaatttttgtatttttagtagagacgggatctggaactcctgacctcaggtgatcctcccgcctcagcctcccaaagtgctgggattacagatgtgagccactttgcccggccgagccatccttcttaaggacagtgtttccacattgcatttcagattgtcttattttttaaaaactcaatatagtcaccacaatttaattattttatgtgaatcaaggcaaggctagtgaatgatgacttgagtgctatgtgtgtacgataataaatttgttctcatatgtttttgaagtttattaaatttcaagtagtcctttgattctgttcttcagttgtactaaaacgcctggtctatgcattctctcactcttccagatgttgcttctaagcctccagcacctcctcctcatcttcaatcagaaacgaatttcgaaaccacatctaccatccacacactcccagcttctgtgcccacatactccaccttattgcctatcactctaagtgaaaaacttctactgttatcccaggtaaagcgttcacctgtgtgcaacatcacggtcccactggtctattagaggttgctccaggaattctacctgcctgtctcctaaatgaaccattctttgattccttctcgcacaaaaacctgctgttcttttccctgacttacattcacccacttcttctaccagttactgccacattcctttactacaatttgcagccaatctcagaagagctgtctatcacattgcttctgattactctcccccattttctcataaacacaatccaatcagactttcacatatacccctccacataattgctcttgccaaggtcaccaatgattactatgttgctacatcataattgtccattctcagttctcttaatgacccatcagcaacatttgcaacagttaatcactccctcctctttgacatactttcttcatttagattccattctaccatacactcgtggctttcctcccactgcacaggtcactcctttcttctttttttttttctgtttatagttatttgacccttgtggtcttatggtccctctttccatactcctttactgctttctcttcttcactccaagctcttaataggaaagtgacccggggctcaattcttgatattcttttctatctacatttattccaaactggggattttctccagttccacaatgttaaatagtatgtacatggcaatgactcccaaatctgtatctcgtatatcagacctgtctcatatattcagctaactgatcagcattttcacttatatgtcaaacacccaaagtaaactcaacatctcgaagactgaaattctgatctgcacacacacacacacacacacacacacacacacacacacacacacacaccctgctgtttttacagcctaccccatctcaatagatagtaactctctcttagttttcaatccaaaaatgatgtcacttctaacccctctgtttctaccacaccctgcgtgtaatccatcagcaaatttcaagactgcccaccccgacactctttccatccggacgggctgtaatcgtctttcccatgcaatcttaaagtgtattttaagtggtctccttgattcggttctgccacattcctttactactctttgcagcaaatctcagaagagcaatccttttaaaatgtaaattagatgatgtcatctttccctcccaaaacaatgcaatggctatttcactgaaaccaaggtccttaaaatcacctccaaagccacacaggacccaactgtctccttaactctctgatgtcttctcttaaggttgtaactttgctgccttcattccagccacaaagtcccccttgctcttcctagaatgtgccaggcatgctccttcctgagatctttgcaccattggcttcctcatgcagcaggtattggaaagattaaatttcccaatttacttaagtagtttttttaaagtcactttctcactgagctttcctggatcagattattcaaagtattcatgaatggccttgcactcttctactttctattttttttttcttttcatagtacctaccaccttttaagatattacatacttaagtttaattagattccatttgttaatttttgcttttgttgcgattgctaggggcatcgctgtcacgaaacctttgccagttcttacgtccagaatgatattgcctaggttgccttccagggattttatagttttgggttttacattcaagtctttagtccatattgagttgatttttgtatgtggtgtaaggaagaggtctagtttcaatcttctgatatgactagccagttatcccagcaccatttacaccatggaatactatgcagccataaaaaggaatgagatcatatgagccctttgcaggatcatggatagagctagagaccatcatccttagcaaactaagacaggaacaaaaagccaaataccgcattttctcacatataaatgggagccaaacagtgagaacacatgaacacaaaaaagggaacgacagacactggggtctacctcagggtggagagtgggaggagcgaggagcagacaaaagaactactgggcactaggcttagtatctgggtgatgaagaaatctgtacaacaaaccccggtgatacaagtttactcaaacaagaaacctgcacatgtactgctcaacctaaaataaaagtttttaaaaaattaaacccattatatccaagtacttactgtagataaggcactgtatcgccctaaaaaaggtgtcagatacttagacattatgttaactgtttaatgtctgtttatctcagccaaaatagaagctctgtaagggcttgatctactttgtttgctgatacatttcaagcccttagaaccaggcttagcatttagtaagcaccaataatattggtcaaatgagttaatggatgtactagtgaataaggctctttgcctttgttcttccggcccagggtcgcattcttttaggttctatgtctcttctcatgtattcccagctcccatatggtaggctgtctttctgctcatggtatcctccatttatggtgtgagataatgacataacaatgtatgttaagaatgaatattcattacaggaaaaagaacctgaaaatttctcctactggttctgctgctgtttctactacaattattactctgcacaattttctaaaatattttattcaggaccccctattctggttacactgctaagtgttttctagtcacagataacttttatctctataggcttatgaggataggtattattaagcatgtttcatgaatgagaagactggagattgggagtggaagtttaattagagtgcgtactatcaaaccataagtagtggaataggaattcaaactctgggctactcgcttctacaatattcttaaccacagatgtacacagtctctcacctagggaacaaagtgcgtgggtttcctgacagtatatcagtcatattgtgatttggttatgtgtacttttgctccataactttagcccaaattgaatggaacttgaaaagacatacgaatgggggtatttctatgtagtgtaattgaacatatgagcagggacatgctgagtgatgtgacataatagaaaacattatgatatcacaaataatttaaagtatggaactaggatagacttatccaaggtttttattttcaaaatttttaaattgatttttttaaggaaagtcatagaaaagtacagagaagaaagcgagcaatgagtatcacttgtaattaacgagtgttaatattttgtcaaatttacctcaaatcctctttttttcctaattgcattcttctccctccatctccagaaataattgcgattaagaatttgatttatatttttctagtccaaacttatctctttgctatgtatgtgtctataaacaacatatagcactcattgtatctttcttattgtgtttttgtaactggacatttgtaatttgacatctatccctcttaagaccaaggctattatttctaataattctctactcctaaaattgccactgtgtggcaaatgatggccagagttaaaggccttaagttctttttgtcactttttcaggagacttttttcatctaaacatcttttgtaataagcagtatatgaacagtattatttagcacatttaactctgtcaacagttttcagtggatagtgtgaagaccttttttaaaaagtcataactcgatgcctctggatatgctgaaatcctcatgaagctgttgtctctattatatgtgaatacatccattaagtgttgatagtaatggttgtaaggtcctttggtttatagctctaaccacatagggaatgatatattttagtggagaattagtctctggcattgctgaaactgattacttatagcaccactcaccccatgtatataacaagtgctgatggtgtagtatttcagctgtgatgacataagaattttttttaaccttattgagccagcttctgccttctattcttgaactcctttttgactttggctgtatgtgactcaacaactctctgtaagtcaacagctgccagatgctaagtgtaattaaggctttacatgtatttgtaacctacgacatgtgtttggaacacaggaagcaaggtaggaaaggaagaaaaggaaaactcttgactcagtttcaattatcctctccctgcttaatggatgctaacacgcactaggaagctatggtcttgccattttttataagctcaatggctggaggcttagtatggttttagacaagtatctacatcctaactgtaattggtgatgaggcagttgatttaaaagaattcttttacaaacaagagtatatcattaacatttcccctcaaatatttgtggtctaatatacggtgtgattacttactgaggcaaagtatctgctatacatatattcacctgctgatagactgtgatccatccatctcactagatgtcagaatgtagatgagttaattaactcttgagatctagaataattcttctgtgataggaaagtcaaagtgttttcaaaacatcaagcacatgatggaaataggcaccttggtgagtgctgtaaatgcaagtgtcatgtgccttttggttaatttcagtaatgttagcagcgtctctactgatatatcatactttttgtatttttatggaaaagtaagatattgcattacttaatggaataaacattaaatatatctaaatatatgcagcttaactaaaaactgcattttatttacattgtggcagaataagctgaaaatagaaccccatttcattgcttatcattttgtagttttatatttactattaagagtacaataataataatagtaacatgaataataatagctaatatcgatcgacttattggtgtgtgtgtgtttgttacacacacctacacacgtatttattgcatgtgaccacaagatgcaagtactattattcttccattttacaggtgagaaaatggaaacagaagtattaaatagcttgatcagaacaacaacaacaaaacagtcctcacagcaagtaagagaactctccatccaggcagatttaaaacaaaatagaagaagaaataaaaataagcaaaagtcagaaatctgagcattgaattgttagcccacagtaggttttcattgtgagcaaagactgctaccagaactgcaattgggaaatgacctgaggcttagagcaacaaggacatgaaactgagatttctgtagtaagccaggaaacctaaaaagaggtatgtgttcaacactaccacatgcacattgcctgtgtagaatcaaatacaaattttttagccggcaagaatcccagtttaggcctgtgtgatttttgaaaattaaaataaaccaacatatctaaaattaaatataattaagtatgtaaggatgggcacggtggctcacgcctgtaattccagcactttgggaggtcgaggcaggcggatcacaaggtcaggaggtcaagaccatcctggttaacacggtgaaaccctgtctctactaaaaatacaaaaaattaactgggcatggtggtggacgcctgtagtcccagctactcgggaggctgaggcaggagaatggtgtgaacccaggaggtggagcttgcagtgagacgagattgggccattgtactccagcctgggcaaccaagcgagactccatctcaaaaaaaaaaaaaaaagaaaagaaaaagaaaaaagagaaaaaggaaacaaaccttcatagttaagtgtgagcaagtccataaataattgattttgacctttaaagttttaaaacattagaatttatcatttacatactattaactatgtataatagaaaaactaaacaacaattgaaaagcaatatcagttttataaatgaaatgcaaattgttgaaattaaaaaaagtttagtacataacagtgaatatgagttcaagcacaattaaagaaataataagagtaatcataagaaatcagcaacagactgcacagagagaaaagacataaaaatacaacagaagcatttagagagaaaaagggtagcgtaagatcagctgagtttaattggtgaaaagaatagagtatggaagtgaataaatatataaaagaggcaatgactgagactttttttatattaagaaatcatgaatttacagaaatagaggcacaaaatatatcaagtaagattagaatgctaaatagactggtacaacatacgtattgtagtccttagagcaccactaaaaaatctgtgaaaagatagacaaaaagcctagacaaaatttaaatgaaaattttaaataatttattaactgacaacaattaggcaaagaaatacagagggaggaaaatgcagggagcacaaacaggaaaacataaataataaacctaaatccagtcatatcaataattacattaaatataaattgactatcataccaattaaaagacagagattgtcagattacttaaataacaagacctaattatatgctggctacaaaaggcatatgtcaaatgtaaagacaacagaaaagttgaaagtaaataaatggaaatagatgagtcacacgtttattgcttacaataaaaataagaaagctggcttgactgctttatgtaaggcaaaatagactttaagatcacgagaattacaagagaaaaagatgagcatttcaaattgataaaagggtcaatttattctagggatataaaagtctatgtgcctaataacatagttttacagcgagaaagagaaggaataaaagacaaagcaaaattaacaaaaataaaggaggaaagagaaaaaaaaactacagatttaactcttttctcagtaactgaaaaaatatctagacagaaatataggatatagagaatttgaaaaacgttgttgaccaccttgacctaatagacatttataggacactacacacgagaattctcgtatcacattatttttcaaggaaaaactctgcaatatattctatatgttgtgctataaaataagtctcaataagtttcaagatggaaatcctggagagtttgttttctgtccaccaagcatgtaatttagaaatcggtatcaatcagacaagtcccagatatttggaagtaaaattacacacttctaagtaacctgtgggtcaaagaagtagatgagaaatttaaaaattttggaactgaatgatttgcatgcacaatacattcaaattttgggggtacagataaagaggaaaatattataggtttgcaaatttacttaagaaataaagaaaatatttcaaatcagtggtctacatttctaccgcaagaacctagagaaggatgagaaaaaaaaaactcaaattaagtagaaataaataagataagtgcagaaattagggaaatggaaaataaacaatacaataaattaaagccaacagctgtttgaaaaatcgataaaataaaactccagtaagaatgatcaatttaaaaaaagaaaggatccctcatatcaaaaatgaaagaaagaatactgttagagatttacacatattaaaaaaagtcataaatgtttgtgaaattgacaaattccctgtaaaacacaattaatattagaaagcatatattacctcagaagtctttattagggtcaccatatattgatgataaaatgttcaatccatcagaaagctataatgctaagcttacaacaggtacctataaaataaccttaaatagacacagagcaaacattgacaaaacagtattgagaaacacccatcacagtaagaaatttcaatatgtatcttacaattatagatgggacacaccaacagcaaattagtagtaatgcataaaatgtatagcatgaaatgcttataataataaagaagaatggctgaacattaaagacataaaggatcaaattttgaaggtatagaaaacaacaattgaatgaacttaaagaaagaaataatttgtatacataagggtagaaattgataaactaaaaacatacacagacagtaggtagagtcagaaaaacagaattttttttcttttgaaagaaaaaaaattttattggtgaaaccaattcagttaagaaaaagaaggcacaaataaatattatgaggaatgaaaataaagacagtattctacaaacctagcagaaatttttaaaaagcctaaacaatacatggataacctattgtatttatgtcaacctatttgaaagcataaatgaaatgggcacattcctagaaaatttattgttcctaaattttctaaatcaactcatgacaaaatagaaaatagtaataattctatgtaaagaaataaagcaagtttcttcctctgtagactgatgatcatcataatagctacatttgttttttggttattctgatgcaggcaacaatctaagcattttccgctgctttgtgtcattcagtaccctcctccaccctgtgaaagtaggtgctatttttatgtcccttttataaatgaagtcagcagaagtaattaattctaagactatctggtcgacaagtatttttaaaacagacattctaactcctgattttcttaaccttaggctatatggtgactgttttgtagggctgcttttttaattaaaaggggaaactatataaaagcatttaggacagtgcttgacacattttgaagccttcagtaactgtaaactaacctagtagccttgcagctaactcactactctctctttccctctctttctctgatgaaaaaaattgtttatggaggaagagtctcatatagtcaggtgaatgtacatgtttgtaatgctctcacataggataactgattggtatagtttttaatactgaaattgatttttaatttcgttggaattttcatcagcagaaaaccatctccaactagccaggctcctggacatttcatttttatttatgaactgccagtttttcagcagaacccttttgttgtggctgattttgggttttccaaattgggctttgttcagattggaatgggaaaatgccaccacatcagaggagaatgccaccttcacctttttctttgaaagttataagcttacaggaaaacctaggatactggaaactcttctgtcttcactagccatcttggtgtttccttgatttagtatgtgtttattaacattggaatggttctagttacaaattgtaaatgtttggacacatcagaagatatttatatagattaaaataatgagtctaaaagtttacaaatatcaaaatatcaatctcttaggtgtcatatattaaaaaatgtaattcttaaagcacacttctgaaatataaatatttggcttaaacttttatgaataataatgcatgtacacttactctgttgttttaagccagaggattttgggtgaacagttttatcaacatttgggaaaatatctaaatatgtaaaaacagatgaactttaaaaggtcattaaaagagagtttatgtgaagacttttaggatatacaagcataaaacattagtattcataaatacttcctctggtgccttccaaaatggtgatcattaaatatgtaaatatgtaggcttttatatttgtataaaaataatattttagataatgttgataacggttttaaaccgattattttgtatggctcacacatatctacaattggccaacatttaaatataacatatttaaatgcgagataacaatttggcatttcattttgatttgtcaaacagaaataaaattatattttatcacttacaactgctacatttttcttgataactttctatgggcaaaaacttaaggcatcatgtcaaatcacttcaatttctttgataaaaagtactataacgttataatatctatctttttcttaaatatctgctagaaaaaattgtactccatattcattcttgactttaaaatgtacgctctaacatttgcacaagaaaaatgacccatgtttgtttacaagggattctctttgttttaggatgaatgattttagaaaaaggccgcttaaaaaaggaatcaatattcaaaagaacaaatgtttcaaattaaatagtaaaaataatttattgcaactgtatcttgaaaaaaataaacctaattatcaaaactatatttcagtttgtttaatttcatttactattagaactaggcatattttgcatagttcagtttaaatttaatattattcactatttgaatgatgcatattttttttcaaagtgataaagaataacagtttgggggtggggcatatatagtcatgttacagcaaaattgtttgattgtaccacattatatccttccctttaggcttgcattttgcagcaggatcatagagggtcattttttttccaaaaaatacttgatgagttcattaattttcctaagggcttctcattaaccttttatttaaataattatcaagttgagattttcttggtacgcgatatgaccaatgatttttttactatatcctggccaattgaaatattacattatgaaaccctggatcgtatttaaatcttctgttatagtaagcctcttctgacactgagccgatgggaatagtgggatactgtgtcttgacagccaggtggatgtaaaggtgtactttgtgtatactgtgtgtgtattttgacaaggtgaggaagggggtgcagtgaaagagcgctgcttcgtcgcggcagggcagagttgagattttagaaccctcccctacccccaccccaggcctctgctgatgacaacctcgctgagagggagagagttacctcctaccattcccctcaggtcctcttctgatcatggtggtgaaattatatttaacatttagccttctctgcccccagcaaggagagagggagggctggggataaaagtccgggatccccgcgctggtctccacggacaacacttggtcttttaaaattttactctggtgtgtttgtaaaagtgtagggatggggctccttgctacagcaggctgtacttggggcttgttttgtctgctgccgtttccaatttgcaggtttctctagcaccaggtttggaacatatgaggcaaaaataaaccccagggaactcaccaccatgtagttcctgaggctccaggaccctgttaagtctaccttgtcctgtcccatttttcagaaactgcttatgtgatttttgtatgtaatgtccaggggttttagctgtacttagtgggaaaagtagaaaaggggaacactaaatcttggtccagaaccagatgtctgtcaaatcagattttgaagttcccatcgtcgtgaccacactatttctatcttctcttgttaactgacttaattctgttagattttcgttattctgtgacctttttgatgaactattttttttttgcataatttttcttgacttcatgaaaatctgcaacttcccaagctttacaatctaattatagattggcaccatattactttctgctatcagcaagtaattaattacttagacgttgatacggtagttgatgtgagaagagatactaggagaaagtgggcagggatgggtagggattaattttataagtggtcattcgtgacttttcatgttattacaacttttatttctctgtataaaatgacttctcttaaattcagggtgcttgcataacaaacatttagacaatgaaagttttctgtattgcatacagttagcttttatcttcttgcccttgtagtataaaatctgttccaatgctggcattttcagtgctatttgtgtatcctggtattaccatgacatgataattctgacttaactacatatgtgcttttcctagttaaaggttatttcaaagttggtaaaaacttagaaaataaagccatgatcacaatgcaaagacatatctctccttaaaattgcatcccaaatagaattagtgggtcaaagaatgacccttgaattctgttgcaaaatttctctctaaaaaaggcatggaggctgggcgcggtggctcacgcctgtaatcccagcactttgggaagctgaggtgggcagatcacgaggtcaggagatcgagaccatcctggctaacacggtgaaaccccgtctctactaaaaatacaaaaaattagctgggtgtagtggcgggtgcctgtagtcccagctactcgggaggctgaggcaggagaatggcgtgaacccgggaggtggagcttgcagtgagccgagataacgccactgcactccagcctgggcgacagagtgagactccgtctcaaaaaaaaaaaaaaaaaaaaaaaaaaaaaagacgtggagaggatctggattatacactgtggttacgatcaagaaaagacaatttaacgtccaagatatttatcaagagagttattttaagacttgtgttcccctcttttgatcactgaacagtttttagacattaacattctctcccaaccttaaattacactaaaattgctttatgtaaatattatagattgcatgtaatcgtttatctataaaaatattgattctggccttgataatgtaccatggggccacactgggtgagttatcggcaacagccatagagcacatacctgaaataaaatgtattggcacatcatctatatgcacttttatcagtgatatcaggagactggaggcagatagaagataaataatacatatgtattccatgaatactgatatattgtgcctccttgttatctttctgaaagatagtaaagaagaatgaagggttcacggctttccactagaaatcttagcttggagaatcacacaatgagtagtttctctctttcattcaaagctgccacagagcttactgaaaacataattatgcgagatgaattagggcaaaatcagtctcccatcgatgagcaaagtaagtgcaaaacagtaagttgagctagtattaaaaatgcttccatactaatttacattctgagaagtctgtatagaatgcagggcttcttgctgtaagataaaatacatggaaaacaatggttggaaatcaatccatatagaagaatatttgggaaaactgggtatggtatgagcaaactgaagtaggtatgtgtgatagcttctcaatagagtaaatccccagtcctttggagtgttcaccccaaactagatgaacagctggtgaacaggctgtgaaggcatgaggcttccttgcacctccttgacctgtgcaaggcatgaggtcaccttgcaccacgatgtgacctccatggctccctgttttttttttttttctttcttttcttttttttttttttgaaacggagtttcgctcttgttgcccaggctcaggctggagtacaatggcgtgatctcagctcaccacaacctccgccttccgggttcaagcgactctcctgccttggcctcccgagtagctgggatgacagccatgcgccaccacacccggctaattttgtatttttagtagagatggggtttatccatgtttgtcaggctggtctcgaactcttgacctcaggtgatcagcctgcctcggcctcccaaagtgctaggattacaggagtgagccactgcgcccggcctgttcttttcctatgtaatatttatcactgtatggattgcactttgtttatgtgattctttgattaatgcctttttccccgattagactgtaaatgtcatggactatatttttataatgcacactgttatatccctgatgcctcacacagtactaggaacaataaatatttgttgagtgatttaataactggatagacccatttttatttctttctcctgagtatatggctcaccagcttcatatgttaagccagcatacctggaaaaagcttggtccagaacctgttccaggtattaatacttacaatgaggttcctattctttaagttagtggagagtagaaagataccaaactaggaattgtggggaaatggtggcattggcaaggagtgaacctgttggaaagtgaagatgaaaaggtaattttaaaaaaaaatcaatattgattttagaggaaaatcttcctttctatataccaatgtaaacatactcatttagcttttcctggcaaattcagcacagaccttccaattttctttacaatgctgttcctttgtggctcgggggctataagcttgaaggtgaaactcttaaagtgcactttttcttttctaacatttgtggttactttttaaatgtatgcaaatcttacttgattcctgaagacctcaagtttgttttctcataaaaataagatttcaatttcttatctcaagtaattttaactaaagaaggggcactgtgtgtactccatgtcctcccatggccctcagcccactgttacctctggaacccaggccaaaaaccacatgcagtgctcttcacaaagcctcctgtcctcatacaacttttccttctttcctgaggaggtctttgaaactagttctagataatgagatgtgggaaaaccatgttaaaagttgtcttaatacacacccactccattttaaatgggattacatagctacaaatcctcacatgtggaataaaaatatgtgttttagtttgggttttcatttattgtgggaaaatgaagcaacatatcttatgactctgtccagaaggaacttgctctctaaggacaagatggaagaatattaatatcaaatgactttttttcaatgacttaaggatgagaaaagcaacaatagaaagatcttgtaatattgtgtatacacacatacacacatactcagtaacttcattttcatagactactgagactgaaatataaattttaatgtataattatgagacagtaccaaggatgcaaactggaacagaatactctgggcagagaatttcagagagcatgataaactgtacccagggaataaacagcagcacttagcagtgtgctgatggcagagaggacttccctcttcactgcacaggtagtgggtaatcaccccatgctgacaggaacctgcacttgggttagctctccaatgaataagtttcattctgaagagacaattatgtatagaattgggcttgattccatttacacaaccaaattaggctgggaaagctcagtgttcagtgaagacaagaaaaaagctcagaataaaaagacatatgtctattacaaattaaagtcccactaggttaatgtgagctacacagtggtttggtggtttgtaaaataaaaggtaaaaaatgatatcgagtatgtaggctaccatagagtgtcaagttacatcaagagtttagagacagaatgataaggaatgatcttaatgtaatagatatacgtagagtgggtaaactcttggctttggtgttatttatgaggttttctccactcatagcagagaagtacatttcttcactgcatttttttcattgtcataaattggttaaagacaaaagaaatcagcattatacatcagtaagtagagtggaccacatgattctatctgttttgcatggaaatcttaaaacatcttttaaggagccaagtagtaagcacaaataaataaactgcaccaaaatgttgccaggtttgcttttgctggagactgctgacactatagaagcagcacaagttgggagtctgcaggtacagaggtgaacctggatctgctgtgtgcccaggtgtgaccttggacatggtgtttaacctctctttgtaaagtggtgatgtcaacacctaaaatgctgggctatgatggtatttaaatggcataaagcctaaaggtatctggcccattttctgacacctaataacacacgtttatagaacatgacaacgtgttcaataaaaacctattctctttgctccctgtcagatcatgagttccccctataggtccccatgtgcacacattcactttccgtaagtgaggccaacttgtggctttaaattgtgttagcaaagagagattctttgataccatttagaaaccaaaggactagctcttcatccctaggatgctgatttcagtgacacattacatatacatacctaacataacctcatttctgccaatgatggaccacatatacaacatggtcttgtaggattataatactgtatttttagtgtatcttttctatgtttaaatacaaagatacttgccactatgttactttgcctacagtattcagtacataacatgctgtgcatgtttgtagtgtaagagcagtaggctaaacctaagcctaggtgtgtaataggctagaccatctaggtttgtgtaagtcactctgatgttctcagagcaaacatcacctaaggatgcattgctcagaacgtatccctctctttaagcaatgcatgatagcatttattaaaaacgactagtttggcacatgttatatgaggcacacaatcaccctgagaaaattttaagagataaatgcccagatattatagatgagaaaattggggttcgtggagttaagggaattaccataaatgagacttgtcagtggaaactaggacgggcacccaggtcttctagctgccactcgtattcattagagggttaacgctgtatgacctgaaccttaatctgatccctgcggagggatcagatccaggtattgcgaccatcaagatgcatggccttggataagtgccttaaatcctctggtccccggtttcctcatctacaaaaggattacagtaatattatcatcttcataaagttgcaaaacattaaaaaatataaaagttgcaaagtaaaatgtgcacaagtaagcacttggtgtatattagctattttgatacgttccgggttttttcagctacatggagctacctagacaacagggtcaacatgcctaaaaatctctgaaataaaatctgagcattttgtcctatcatcgatatttactttctttcttttgtttgtttttcaaaggtatcccactgtcctgaatactcttgtccaagatctgtttctgtacaccatggtgaatttgatgtatctgtcagatgggaaaagtggctgcttttttgtaaggataaattttaactttgtaaagcatctcacaaattttaatcagcttctctgtcactgtcaccctaggaaccaacttcacccttgccgaactgggcatctgtgagccctccccacaccgaagcggctactgctccgacatggggatccttcaccagggctactcccttagcacagggtctgacgccgactccgacaccgagggagggatgtctccagaacacgccatcagactgtggggcagagggataaaatccaggcgcagttccggcctgtccagtcgtgaaaactcggcccttaccctgactgactctgacaacgaaaacaaatcagatgatgagaacggtaggcctgcttcttaaataccttttaacgttctgtgcactgcaccacgtggggctttgaatgtttttgttttttaatgaagcggcgtcataaaaccattcattttctttgaaatcgaccttgtctacccagtgtgagctggggggaagtaaaccagcaaccctccagcacacaagaaatgagaagagaatttaaaaatcacattctgatgataacacagcattcaggtgtagtcagttggtcttattagcaagtaaattacattgcaaaagaggcggcttgataaactatgacctatacctagaaaatgtcctctctccacaagtttctaggtctttgtattgatttccccttcccagtaaatggaaacctgggttattttttttcgtgacgatctcttaagaatcccaccttatcttagactttcatttccaggcggcaatgcctcatatccgtattgaagatcaaacttggaacaggtgctctggagcttaataatgacaaataggaagagacttgtcttcagaaaaagaattctttatatgtttacttttccccttggcaactatgtaggttaatggtttcccccatcttctgtcacaaatcactattgcctatccatcagctttctaggtggattttaatgaaactttgaaaattaaatccttccgatcattaagcagtaaatatagagaagcctaagcaaagtcattaaagagataaggtgcttttttgtgggtttctgagcaattccgaagtgtgtttagtcaaaaacatttttttaaaaagataaattgcattaggttacagctgatttaagacgaaaacatcaaatgctatgtggtttgttatgaatagatggcatgtttgctaaaagaattaccattaccattaaaatgtttacaaatagatcagttaagaatgtttatataaaatattagaaacttctgccagagcagctttaagtatttcctttcatttaaaaaagaaaaaggaaatttgcaggtggacagcttgttgtgaatgcaaaagcatagctaaatatcatttaatctcaaaactgtgttgaaaatacatcatttcctgggtaagtcgcacatactcaaaaagatgtcacttttttgaatttaaatttatgtttaattttgaaataatttattctacagtggggacaaggggatgtgtcttacttatgcctccgttcatgtagctaatcaaggtgtactctcaaggaaaaatctgtacttgactccttttgaattttaacaaaattctgacacttggcacatttgacactctgaggtgcttatttaataggaaattacttttagaagtttccataaaagcatacgttgaatccatttactggtgtcctttttcagcttcattgtgtgtgtcatatactatttaaatgaaggcaatttgattgcctaataaataaaatcacttgtaatccaagaatttatggcacattttaaacaaggaattttagcaagtccctcatagttggtattcttatacctatagagggaaccgtctatacagagttatttatacatatttatagacctgcaccttctcccatttaagttatatgcatctaaaaaactcatctaataagggagggtttctggtgaagccaagggcacaaaaaatgcttgccatgaatttacctaggagagttatggatgaaaaaaatctgaaattcatcatatatttggtagaccaatagtagtttcatttttttcatattatttgaaacatcgtatttgaataatttttactttctgcgagtctatgtaaatccctgcatactgataagaaataaacccttgatatagtgtcctgattctttcctacagtactagttgcaatgcagtcagaattacatgaagagaaatgtacttagaagcactaagcaactctgtatgtgagtgtggctggcaaggcacaaaggaggtattgaagccagagttcaaactaggtgagagatgcttattttaaaatatacaggtagaatgtctttgtttttctttttaaaacattttttcaatattttacatattcaaaagaggtacataatgtatcttctgttctcattcttggccagaaataaaaataagaaattttacacatcacatcataaactctttaagcaaatacaaattgaagtgtgagcaactctgcaggcagaggtgttaacttcagtaaacttcttgctctttctctctgacaaattctgtttagctcacaaagaaatcaatgctttttcacatcactgattttatgaagtttgggaatgtattatcatatagattgacagttgccccactggttccacaccacggcatggacacttacaaagccatcattaatttctcacacttgtacccagtgatggcttcctccataataaacactgtgtccttcagaaccaaatcaataaccttttaggtatgcctttcttgaagaggaagtaacaggaatctatactttgagaaagaagctctccaatttgattttaggttttaaagatacatggtcagaaaatgaatcttttctgtggggttccatatgttttaatttcatttcttggtgggattttgggataaatggatttttcaccgtgtttacttaaaaatctcccttaaaaaattccagttgtgattttgctaagcatagttaatgagtgaagacagatctcagaaaccaacttcctttttggtaatatgaagtgtatattcagtctgcaaagtcatatagtaaaatctttaattttgccaacagttctccctagatcaatgttgattgtgcttcctacatgctgctgtgacaaaaatgacccattggataacttgacagtcccatcaaacagatgaacctgtctttcttttctttcttcttcttttttttttttttttggtagtgtagacaccatagtgcttcatcctacactcattgatttagcctctgcattaacattgtgctggcttggattgggttgcttcaaatatataaaactctcagattcatgttatcttttcaggttctttaatcctatcttgaagtcaataatgatttggctagaaatggcaatgagagttgagaacagcccggccaagtttttgctgctgtgaaatttgaaagggctttcctagtaactttaaattagagtccatacttttgttcaataataaatgtcccacttaaaatatgtcctctctaaggccatttgtattatatgagttatggagaaaaaggggtagtcagtaatacagaagaataactaattgcctccttaaagatgcaaagcagcacaaactaaaaaatcttgtctatgttctcttgactcccttaggcgatttcttcaccttgggacttaaaaatttccttttttttttttttttccttccagcagaattctagtttcagttattttattggaaatccagaaagggaaaaaacaaaaaaacaaaaaacaaagaaaataaagttggtatgaaataggaagctagaaatggcagtaagtgaaatctggtgttggttaaacatttaagaaaattattcttcccctcccctctccatgtccacccaaagtaaataagtacaatgttcattttcatctgttgtaattgggaaatttacaatcctcataatgtactttgaggttgagatataaatgttgggttaattccattgcatttcacaaaatgcatttataaaacaagctggctctgggcacgtaatggatttatgtaaagcgtatttgtgaaacacagattctattagattgagtccttttggcaaaaggtctgtagcgtatctgtctcctcggcagagttccaacacacccaggtactcactgcttgttaactgagacatgaggaatgaagcctgagggaaggaaggattttccttagcaccggggacaatgtccttagattgttactgccaaccaagttgcattcatttgtcatttaaggtgagttacttaaatttttctcctttctctccagaaagcggcctctcaataaatctagcattggagcgtttcttaagtaaacacaaactaaacatgcgagtggaattctatttctactcccactctattactcttacatgctcaaattaactttgtattttataacccactctactcctttcttctccctaatccctcacgtaaaatcacagagaatgcctggaacagacataaaaacttactaagagctccagacctagccaaaggcccataattttgctgttaaggaagtgaaaagtcagtggtaagaatagtgaaagaggtagctacaaaaagcatacattcatatttgactgtgcttgatgttgatatgggatgatttcttttccagccacattttatgaagccaatttccatggaacctaaagaaaattgtctcaatttcttaaaaacaaaacaaaatttaaaaacataccaaaaaaaaaaaaaacccagaacaaagttttaagccatttggatgacattgatttcaatttgtgtttttaggctttattttatatacctgtacatttaaaagaataccattataaagaagagtatgaaatgagttatcatggatttaaaaaaacgaaggacacagacacaaaatatcataggttctgtgttttccattcctaaatgaaagaatgatctcctttacatttttctaattcaattccctcaaagtccaggtattggaagctatagagaaaacttatttttaaaaagtttattcatgggagtcttaatatatgattactatgatgctaaaacacagctgataataacatacaaccagaggcaaaatgtaagaatatcacattgtcacatggcatgatatgaaagctagaagtgaaaggattgatgttctgcaaatggactcgtatgagactttagaggtttacgtttttggcaaattaagcaattcttacgttactgtaaaggagaacagagtacttcaaggagcgtaggagcctgtgccttatttcagtactgcactttccagattataaactttagtggcatggtctttagttatttatatatttctttctttcctttggtagtttctttcatgtttgttaatgctcccaggggctatcaaggaatggctccattcaataaatacaataaataaaatgaagaactaagccttccttttggcaagggcagcctgattattacatgtgtaatctccaggccttcagggacacattgggcttggtggataatcatttggttttaagctgctgagttcctgatatcagtactttaacttcagttgagttgctctttttactgcgaaggcagtaaaatggtaagaagcaaaatgtttttgtctgttcacgattggaagcctcttcagtcagaaaactctttttttgcttattgttcagtcatttttttaagtttagttgttgtttgtcaatgatcaaattaagtttatctaataggtgggagagatgtgccatgcattgagaattaaggtcataaataagatgagttaaagctaaggaagttgatagtataagttttctacagacaattgaatcagaagaagcctgctcagaaaataatatcaaagtaaacgggttagagaagaatgtatgaggagtaatgaggcacttcaattagccattcggaaactgagacatagcaggtagaagaaaatttcaggtattaataatagatttgtaaataggatggaaattccacatatgtggccattatgtatataggcttatacatgaaactaaaaatgttacttgtgatttaattttgagtattatttaagtgctagctgtgagaaccttctagaaaattattctttcttgctttccatcaactcagtttgagtaatgttaaaggagtttaaggtgtggctaagtggcttatgggatatttaacaacagaagttaccaactgcatgttagtctacaggctgaatccagtttgaattgtttaatttgcttagtgcagtatcaaacatttttagattaacaaccaacattttaaaagtaagagattttatattagaaatttttatttttggccgttctcaaaacataagaagattcagtcacactggttcaggttttggttgggacagatcagattagaagcagtagcagttctggatagattccatgtctttgaggtcacctgatcttcctccaggctacactgttgtttaaggtctgacttagcctttgtagtcccttgagttatcaaccctgacctacatacagtctttatggaaatcagatataaaaattgtagaaagctagaactcagcaattttatgggttcatgtattcagagctagaatgttacttcttttggtaagtttgctccatctgcaaagtgggtttaattttgctctactaaatttctaaaatggttttaaggcatttagatttaaatgcttcagataaaattaaatcaaattacaatcaatttaatttggaaagtaataaaatgattgtatatgtggggggtgagtttaagtgggtaatatgtcaactccattttccgaagtagtagatgccctgaagtactgaaaaattaaggtcagagtatttgatttaacacataattttaaagctattttaatgtaaaagtatttaggtggactatttggaaatagatggagggaaaacctactttaaaaactttagctacttcagctgattgaagaaaaccccagggcttttcaggaggaagccatttaaagaggaggaaaatgactttgtgctaattatgttcagttttgatccagcaaatggtttatggggtctgtaacaatgaagttggagacaataaagcgaaggctagaagagagacatgcagtgatacacgaagacctccagtatgccaagagagaaagacatggagcaatgttagctaatgctgaaatgggaaccagcgagtcagaaacaaacagaacagcgagtgttccacaaaccaggaatgttcttcaaccagtggataagcaggatagccaaggaacattcaggagtgactctcactccccatcctcatttcttatttgtgaagaagaaaagataactgaaatatgagcatgtttcctaaggaaaggggactgaaatatttgagtaggcattctttgaaaaagagtaggttaacagataacctatgcagagttataccattctgaggggaataaaaaagataaacaccatggcagtctttccatctgtgttaatcatgagaaaaggggcctgaactcacttacagtgagaaagttaggcactggaggagttttgggaagtattttttgtagtattttatgcaagaaatagactatgacacattcaataatcaaaaaggatctttgaaaggaatttttaaagaagaaaattggtgtttgaaaggtaccacactatgcttagatatgaacattttaatatgcacacaaatatataaaactatgtgttgttttattcaatattggtgaaaaatagaaaagtactctcagatgaagagttgtgttaatttggggtggggggacttatttctgaaaagatttcaagtaattgctaattgctctgcattggacgaagccattgtgtgtatgtctctttgtatttgtgtgtctgtgttgtgtgtgcatggtggggaaggtgctttgttgggaagagggatgttattgagagggatagaaatcaataaatataaattgaccaaattccagggaaatgaaggccatatacgaaaatgccaaaatgagcaatgtagacattttgtagcatatagttttggggggagagagagaagagaaacctgtgttgaccttcgtgggtcttgaactctatgggtcatcttacatcaaggagcatgccctttaaagccttggatcccttaaaccaatgatgctgtctcacccatgtaagtcagaatccacagaaaaacacccatgttttctcaagtcccacagaagaactcttgcctctggggagctctgaaccagttcgaatctgtcagataaatatttgacttggtggggaatccgctttccttgaaatatgtccctcttcctttcccaactttcgtctttcccccaacatcttccctccccacctgcatccagcagggcctaatcacctactccatgagctaatttttttattattacattctgtcctctcgttaaaactagtgagatcatgtctctaagatatgatttgagcatcatgataaactggtgcaggataaaaaaaaaaaaaaaaaaaaaacttccgtataaatgtaccttcattttcccttgttctttaaaattttaacttttgaatatgttttatgatgcaagtaatttattggtatatgtatatacacacatacacttgcacacacatagcatatatgaacaggttacataaatacagaaatgtatacattggagatgtgtccaaaaggcttatgctgattgttttagaccttttatttcccaggtctaattaagcctaagcaaccactcactcctcaaaatatttggataattcattattttgtggcaacctgtttggttgtctttgtattggtaatgaccgtatgtgctaatgatacctaactatgttatagtaaaatttgtatttttttcttctaattctctctgctgactttcacttcctagatgaatagacaaaaatattgactttgttgtttcttgaagaaaccaagcactcctatgcatttacagagacattcctgtctaacctcaatagggagagaagaaaataaacattatatatgttagcatactggtacagtaagggaagctttgagaaggtatggttttaattaggttgtaaataggggtcgggacttttatgtatggaaatgagatgatggatattctaaatgaagaaaagccagagtgtatggtggttggagaatgggaggtgaggtgaagatgatgatgatttttcaggggacactttctagtctagaaaaaattccaactccagtcaggataatgggaatatagtgatttgattgagtagcagtagaaatagatgaatagatgtgtagcaatcagatgaccaagagctgtgagcttcatcttaaggagttaaagtctgatcaagcagataatacagaactattgaaagtttatgtgagcaaagactgcaatatcttaggaagcatctgattaaaacacacagatacagcgcgtgcacacgcgtgcgcgcacacacgcacacacacacacacgtttggatggaaagtaacaaagttagaagtgatatcagaaagagaagcagtagtccaggtagaaggactccagaaacccttataccacaaagagtctacctgcttcttagcatttcagtagcagaaattaacctctgactaccatatgaatgctgaatattagtaactaagatgataaaattcaaaaagcatataattttatgctgaatagcaggaaaatgggaggaggtacataaccccacactcccgcagtacagggagtgttccttacagtgcaatctattctgcttacatgtagaatacagtattacaacaattagactccagtgtttataatatttaaccaaatgattaaataataaagtagcatcaaatattgctttgcacaaggaaagaagtcataatattatttttaagggcacagtaagtgtgttgtaggtgaacgttggctagaactattccaggttgattaatagtttcttgaatattatttctgcttctatatccttgccgcttcttcatgagtcatattctcatgcaatttgtttaattgctcctgtaactatagttatgtctcccttcttatctctaatcttttatatttttatctctcatttttttaatcagacttgaaagagatctattttttttcaagctttctgcttgtctttatttactttaatttttctttctcattacattcatctttattgtattttttaatttcctcattttaacttttggagtatattgtggggtttttttaggtttaatttttttttttttttacttccataggttattggagaacaggtggtgtttggttacatgagtgagttctttagtggtgattgtgagattttggagcacccatcacctgagcagtacacactgcatcctatttgtagcattttatccctcagccccttcccaccctttccccctgagtccccaaagtccattgtgtctttcttatgcttttgcatcctcataccttagctcccacttataagtgagaacatatgatgtttggttttccatccctgagttacttcacttagaataatgctgtgaaagctattaattcattcctttttgtggctgagtagtattccattatatatatatgtgtgtgtgtgtgtgtgtgtgtgtgtgtgtgtgtgtgtgtgtgttacagtttctttatccactcattgattgatgggcatttgggttggttccacgtttttgcaattgtgaattgtgctgctataaacacgcgtgtgcaagtatctttttcatataatgacttattttcctctgagtagatacacagtagtgaaattgctggatcaaattgtagttctacttttagttctttaaggaatctccacactgttttccttgctggccgtactagtttacattcccatcagcagtgtagaagtgttccctgttcaccgcatctattatttttggattttttgattatagccattcttgcggcagtaaagtggtatcacattgtggttttgatttgcatttccctgatcattagtgatgttgagcattttttcatatgtttgttggccatttgtatatcttcttttgaaaataatctattcttgtccttagcttactttttgatgggattattatttttttcttgctgatttgtttgagtttattgtagattctggttgttagtcctttgtcagatgtatagattgtgaagattttctcccactctgtgggttgtctgtttactctgctgacttttccttttgccatccagaagctctttagtttaattaagtctcagttacctatctttgtttttattgcatttgcttttgggttcctggtcataaaatccttgcttcagccaatgactaggatttttccaatgtcatcttctagaatttttatagtttcagatcttagatttaagtccttaatccatcttgagatgattttgtataagatgagagatgaggatccagtttcattctcctacctgtggctagccaaatatcgcagcaccatttgttgaaaagggtgtcctttccccactttatgtttttgtttgcattgttgaagatcagttcctgcaagtatttgggcttatttctggcttccctattctgtcccatttttatatacctatttttataccagtactgtgttgttttagtgactatggccttatagtatagtttgaaatcaggtaatgtgatgcctccagatttgttctttttgtttggtcttgctttggctatgctgacttttttttggttccatatgaattttagaatttgtttctaattcagtgaagaatcatggtgatattttgatgggaattgcattgaatttgtagattgctttcagcagtatggtcgttttgtaatattgattatacccatccatgagcatgggatgtgtttccatttgtttgtgtcgcctatgatttctttaggcagtgttttgtagttttccttgtagaggtctttcacctccttggttaggtataatcctaagtgttttgttgttgttgttgttgtttttgtggttattgtaaaaggggttgaattcttgatttgattctcagcttggtcactgtcggtgtatagaagagctactgatttgtgtacactaactttgtatccggaaagtttgttgaattcttggatcagttctaggagctttctggaggagtctttagggttttctaggtaaacaatcatatcatcagcaaacagtgatggtttgacttcctttttactgatttggataccctttatttctttctcttgtctgattgctctggctaggacttcagtactatgttgaagaggagtggtgagagtggcaatacttgttttgtttcagttctcagagggaatgctttcaacttttccccattcagtattatgttggctgggggtttgtcataggtggcttttattattttgaggtatgtcccttgtatgctgattttgctgagagttttaatcataaagcgatgctgggttttttcgaatgttttttctgcatctgttgagatgatcatgtgatttttgcttataattctgtttatgctgtgaatcacatttattgacttgcatctgttaaaccatctctgaatccctggtatgaaacccactggatcatggtggattatcttttttatatggtgttggattcagttagctagtattttgttaaggactttaatatttatgttcatcagggatgtcggactctagttttcttttttggttatgtcctttcctggttttgatattaaggtgatactggcttcatagaataatatagggaggtttccctctttctgtatcttgtggaatagtgtcaataggattggtgccaattctttgaatatctggtagaattctgctgtgaatctgtctggtcctggacttttctttttcggtaacttttaaataccattttaatctcacttcttgttattggtctgttcagggtatctaattcttcctgatttaagctaggaaggttgtaccattccaggaatttatccgtctcttctagtttttctagtttatgcatagcgttcatagtagcattgactgatcttttgtatttctgtggtgtcagttgtaatacctcccgtttcatttcttattgaacttatttggattttctctctttctttagttaatcttgctaatggtctatcaattttattcatctctgcaaagaaccagcttttgtttcatttatcttttgtatttttttgttgcaatttcatttaattcttctgtgatcttgggttttttctttcttctgctagatttgggtttggtttttttttgtttctctagttccttgaggtgtgatcttagattgtctgtttgtgttctttcacactttttgatgtaggcatttagggctatgaactgtcctcttagaaccacctttgctgtgtcccagaggttttgataggttgtgtcaggtcattcagttcgaataattttttactttccatcgcgatttcatttttgacccaatgatcattcaggaacaggttatgtaatttccatgtacttccatggttttgagattccttttggagttgatttctagttatattccactgtggtctgaaagagtgtttgatataattgtgttgtgctttttctaactttttaaagatgagtactaagttttattactctcattctcccttatgttatcagagtaagtatatttatcaggtcctatagaatttgataaaaaatattgttctctgtgttactttctaaagatcctcagcccatttggactctcaaaataaaacagaatcctaatgctaccagtttttcactttaatactaacaatttctgaaaaagtccaatttttattgttaaatctttatgctgcccaaagtaagatatctatatgttttatatgcattatttatagatatacgtttgtattaactatataacatagaattatgcaaagcatatgtgcgtatatatatagtgcatttaaaatatatatatatatatatatatccatgcatataggcatgaaaaagaataaaaatcacctataatttgacaccaacaataactatggttaatattttgatgcatatatccttcagtctgtgtgtctatctgagagaaagtgagagggaaattaataattttacagagttggcatgttttacatgccctatatagcattattttttttggaaataaactaaaatcatttccccatgacattaaatattttctccaatatttaagagggacatagtactcctttaatgtaatccatttcctcaatttcctttcattgtacatttaactaatttttattttagttgcagtaaagagcaatgtgatggataaaatccttatagctacattcctgtggacatccctgactgttttcttaagatgaattcctagaagacttagaacatacacagttatgtgaaattgcaatccttttcaaccagtgtcctcagaggaactcttgcaccagcactgtgggaaaatcaacaggcacacggaatccttgagctcaggagtcactgggaatgatcattaatattttaccaaattacggatcgaaatatttttattctggcttcccttcactttaatctgagcaactcttcatgtattcattgtctacgtgtattttttatttcatgatttgtatttcttctccatatggaaagatagtgggacgatgcatctcactttttagtttgtattagctttttacaatgtctacagtgatcccagatcaatgtctacagtgatcccaggtcctattgtaccttattgtttatacaaatgcttaaaaagtgttcacttattggtgtgaagatcacttggctgcattttcaaaagcatgcgacttattttctgtgggatagaacaccaaatgtatttacggagttgatttggtttatcagaaatcagtgctaactagaaagcaatttaaaattgttgcactgaccaaagaagaaatgctagctctgagtagagtggggaatttctttttccatattaagtatgtcagctattgtttggaatgcaggactttatatcagattgttaatttataacaaaccaaggatagaattgcattccacatgatgaaaggaaattcacatctactaagacagtctgcaaggcaccttgaggagacagaatcgagtaaattatgtattaaatattcttaaaacttcctccatctgcggtgcctttgattcaatgaggttagtaatcataaacacagtggtggccctgctattggtattttcacaaaataggtagttctgcaggcaagataaatatctcagtacataagaaaagactctgaaaataagcatgtggaagcaattactattataataagcatatggctctgctaatatacagtgttgcttaataattgatatagaaaaaaaacagtagaaacatttctatattctggggcattcccttgtacatttagaatggaaaagaccccagtgaaatgcagaacaattaagagagtacaggttgtcttccatttccactgatacacatttatggctatgaacaacaaggcacgtcgagaaagcaggaagtatacaaatcaacttaatctgtcccactgtggtatttcaggccctccacaatatagtccaattttatggttttagcccttgctcccacttctcttctaaatatattttcagctccagctcaactgagctacttattttttttccagagcatactctcttcctctgtgtcgttgttcaccctgttctttttggctgcagtggtatccccaaacccacctacccatcacatacctatccattatcaaagaattatctaaggtgccatgtcctctatgaaatcattctgttttccttaactacaggtgtactcccactcctttgaaattttttttaacattttatttatccatttcatcaagaatttaggggaaatggtgtagccttcaccaaagtagagaagtaaatgatttgagatgaattttggagctagagtatacagaacttgatgatagtttgaatgtagtagttgagaaaagaaaagcaagagctcttgggtgggcatagtggctcacgtgtgtaatcccagcattttgggaggctgaggcgagcagatcacttgaggtcaagagtttaagaccagcctggccaacatggtgaaacaccgtctctactaaaaatacaaaattagctgagtgtggtggcttgtgcctgtaatcacagctactcgagtggctgaggcaggagaactgcttgaacccaggaggcagagtttgcagtgagccaagattgtgccactgcactccagactgggaaacagagcaagacttcatcaaaaaaaaaaaaaaaaaaaaaaaaagcactctcaaggatttctaactttagccactggatggattcctaagtattaagatgagaaatacttgaagaagataggatttggggcttattcattttagacattgttaagtaagacaactaagtagaaaggcaatgtggataattgtgtaattattaagactggaacctaggaaaaagatctggactggagatgtcaatttgagaatcagcagcataggagtggcccatatatatccaggaaagtagatgagcttacccaaggggaaaggtagagagagaagaggagggagccaggagcaaactctgagtagtccttaagtgttgggtggagagactgaaatcagtggtttgcagaaggtagttctttgttcattcttgttggtgtgatttttctttagggttccctgatggcttccggtgttggtgtggcttttatcatctctcaacccacagtcttttttcctttccattattctgtttcaaaggaggcaagactggctgagcctcatcagtacaggagaaagagaaaaggaatttaaaaagggatagggtcacaggaacaaaaataaataagataagagttctcatataattgtaaactagtttgatggttgattttatgtgtcagtttgactggaccgtaggatgtccacgtagctggttaaatgttctctgggtgtgcctgagaggttgttgctagaagagattagcttttgaattagtggactgaggaaagtcaatggtctcccccagtgcaggtctgcatgatgccatccactgatggcctgaatagaacaaaagatagaggaaggttgagtttactctggctgattgtttaaagtgggacagcggttttctcctgccgtcagcatttctgtctctcaggctttcagaccaaatctataccataacctctccaactctcaggccttgaaactacactacgggttttccccagcttgcaggcagcagatgggatttctcagtctccaaaatcatgtgaggccatattttataatatctcttcattagatatatattctattatttttgtttctctggagaagcctgactaatatgttgtctgtaatttcaaaatgtatcgagtaattcatggcaataacatttaactacaaacttttattgtactcagaatatttatttagttagttattgggcatctattgtctattatgcttagagtatattcattaacaaactagaaacacattttcctctccatgcgggtggatcaggaggtcaggagttcaagaccaacctggccaacatggtgaaaccccatctctactaaaaatacaaaaattagccaggtgtggtggagggcacctgtaatcccagctactcgggaggctgaggcaggctaattgcttcaaccaaggaggcagaggttgcagtgagccaagatcatgctactgcactccagcatgggcgacagagcaagactccatctcgggggaaaaaaaaggaaaaaaaaagttaatttttattaggcaataaaaaatgaacttgaaataaagaaaaaagagagaaaatagaagagagggagagataaatagaagggagggatgaaggaaataaagaaaaaactatgctatgtagtgataaatggtatgggaaaaagaagacagtagaaatagataggagtttgtgattgtgagagttttgcagtagtaaacgggagtcggagggccaaggaaaactttattaaaatgctgacatttgaatgaaaacctcaaggaacagagaaactagctgtgaaagggaattgactatacagatttcaggggtgtggcatttcagtcaggtggaagagctagtataaagattttaatgcaggcacactcctgctgtatttaaggaagttaatgtgattgcagcagaatgcaaattgggcagaatagcaggaaaccagaacagagaaatgaaggtgaagtcaggtcatagagggtgtcacagattatttaaaatggtggcctttgctctgagggaaataagcatccagacagagttttgagcataagaatgtcatgatctgacttcccatgtaaaaggatagctctggctattgtgttgagaatatagtggaagaagacaagagtagggagaacaggaggctattgcagtaaccaagacaagagatgacagtgtctgtctgggacaatagcggtaggaagaagtgatctgattctcaatgtattttgaaggtaaaggtaggagtatttctggatgtattggctgagaagtgtctgcaaacaattccttgaagattactctcaatcctgtgcacattttaaaataaggctatatggttttctgatattgagttgtaggagctccttatatattttggatattaactccttaactcatatatggtatgcaaatattttctctcattccgtagattgcattttcattttgttgctagtattctttgctgtgcagaagcttttgagtttgaggtagtcccacctatttttgcttttattgcttgtgcccgtgatgtcatgttcaagaaatctttgccaagaccaaagtcatgaagttctttcccaattttttttaggagattcacagtttcaggtcttacattttaagtctgtaatcatttcacatttatttttgtgtatggtgtaaaagataaggatccaaattaatctttttcacatgtgactgattcttctgacatcattttttgaggagactatcctttcttctttttgtattcttggatccttgttgaagatcagttgactatataaatgtggctttatttctgggcattttattttattctattggtctatgtgtctgtttttatgccagtatcatactgttttgaacactattttgtgtgtcagtttgacacatagacttataaataaatataaataaatgtatgtatgtatttatttagttagttagttagttttgttctttggagacagagtctcactctgtcacccaggctggagcgcagtggtgtgatctcggcttaggaggcaacctctacctcctggggtcaagtgattctcctgcctcaatctcccgaatagctggaacttcagactcacgccatcatgcccagctaatttttttttctatttttacagacagggtttcaccatgttgcccaggctggtctcaaactcctgaacttaagtgagccaccagcttcagcctcccaaaatcctgggattacaagtgtgagccatcaggccaggctgtaatgtattttaaaatcaggacatgtgatgcctccagctttgttcttctttctcaagattgctttggctttgaaccaagattatggttctacgtggattttaggattatttgttctatttctttaaaaaatgtcattggaattttggtagggattggatgcattggaggtgtagattgcttttggtagtatggacattttaacaacattaagtcttccaatccatggacatgggatgccttctcatttatttgtgtctcttttaatttcttttataaaagttttatagttttcactgtacaagtcgttcactgccttgagtgagtttattcctaaatatatttttgctgctattatagtgggattttttcttagtttccttttcaaatagttcagtgttagtgtatagaaatattactaatttttgtatgttgattttgtatcctgcaactttactgaatggtttatcagttctaacaggttgtggggttgggatatttttcttttgtctttagggttttctgcatataagattgtgtcatctggaaacggcgatagcattacttcttcctttctaacttggatgccttttattcccttttcttgtctacttgctttgctaagactctcggcattatgttgaatagaaatggtaagagcatgtatccttgtcgtgtccttgatcttagaaggaaagtttttggtttttacaaagaagacattcaaatggccaaaaatatagcaagtcttcacttaatctcatcaataagttcttggaaattgtaactttaaggaaaacaaagtgcagtgactcttgaatgatgccattttgtttgacatccctagggtataaagttgatgagaaaaaaaatgatgtggttatacatcctttcacttaaactcagtttccaggaacctatagataattttaagtgaggacttgctatatatgaaaagacactcaacatcactaatagccagagaaatagaaatcaaaactacaatgagataccatctcatacccctgttaggatggccattatcaaagcagtaacaaaagagataagtgttgtcaaggatgtggagaaatcgtagcttttatatactgttggtgggaatatataaaatgatacaaccactatagaaaaaaatatggagtttcctcaaattaaaaatagaattaccctatgatctagcattttcacttcttggtatttattcaaaagaattaaaatcagaatctcaaagggatagatgcacccccaaagtcattgtagcattattcacagtaaccaagatgtggggagaacttaaatgtccatcagtgtatgagtggataaagaaaatgtggtgtatacatacaatagaatattattcagccataaaaataagaaaatcctgccatatgatacaacatggatgaaccttgggaacattatgtgaagggaaataagccaatctcagaagaacatatacagcatgcattcaattatatgaagtatctaagataatcaaactcataaaagcacagagtagaatgaaatttgccaggggttgaaagaaggagaaaatgggaagttgttgattaaataggggtgtcagtgaatgacagcaagaataagaggtaatgtggtgataaaatctgatggcaagagatgcaaagctgaggatgtctacagagcagtgaagcatcatgctgtatcaaggacaagaagcagtgtgtatctcttttatatattcagtgccagtggcatgagggcacagggaggaaaaactgccaccacctgtaactactccagggaaagtagtgtccttaggaagaacaagatttctactggagcgagaccatgaaatgagcatttggagaaatggttaagacttttttcagtgattgacatacagagggacagtagacatgacaagggcgaaggcagacagtgaaggtaaggctttgaatgtcaagggctagggagagatgcatcttgggcacctttcttaactcctgatgatggatggggttagaagaaccagcaaaagtgtggttcagtcctggtggagagtttcattgttgatcctggagaaatatccccaatctatttctcaatgaaggcagtgataaacttttgatgctggagaagtaatggaatcttcctttaataaaaagagtcaagatgtccttggtgagtgcagagagaaagaagaaacattttctaacacactgtaagaaatcttgaatatagggacaacatcttatttatgtgtgtttccaaaggctaccacgttgcttgtcagaatgagtcacaaaaccatggaagggagggagggagaataggagagaatgcaggaaaatgaagaaaggaaagagaaaggaaaatagaaaggcaaactcaaaaaaaatgaaagataagaaaatattatcttgttaaaaccatactcatcaggagacttaagtccttattcatttaattcaacaaagtttttctcaaaataatcacaaaaacattctgaaaattaactaatgaaagaaaatgatagtgaaatcatttataaaacaatgtatatggacccgtgattgataggttttgttgcaaaccgagcattgagtatgcgtgtgtccatgattcaatataaaactgacccttctcattttgaagagataacaattttcttattttgaagagattaataatgtggtgaattaacaaaccatcatggaagagattgagagaaccatgggaaggtgattatatcataccttgtaaagaaatatgtatcttattcatagggtacaagatactgtttctattcctgctgaaagagtaggttaagaaatggtatctgcaatttgaagataccagaatagcaacttgatctcatatatctttgtttgcttctctgaaattcgcatcaagaaaaagtctctaaaacatgtctcagaatcattttctctagaatccactaagtgggctttacagctttaaaaatatcaaagatttatattactatctctcctaggaaaactgtgcctatgaccatagtcttgtttcaacttccaatgtatttttatgaagaaaatatgagaactatatatactccatgcactgtgatgatgtaacatactaatgggagaggtccaagggcttagtagaaaaagtctagagatgtaatttcttgtcctagctctgcgactaactagctatatggccattactattccaagggcaacagacctaaatctctctgggtgtcaatatcataatttttgatatgaagacaatcgaggctatagtgcagaaattttggagtcagatagacaagtgtttaaaccttaattctgtcctttatcagctccatgacattggcaaattaccaataagatctcaaaacactagtttcttctgcaaaatgtggataataattgtccccttcccttattctttccttctttctttccttctttctttctttcctttctttcttcctttctttctttctttctttctttctttctttctttctctctctctctttcttactattttttttttttttgagacagggtcttgctctgttgtgcaggctggaatggagttggcaccatcttggctcactgcaacctctgcttctcagattcaagtgattctcctgcctcagcctcccgagcagctgagatgctgagattacaggcatgcaccaccatgcccagctaattttggtatttttagtagagatagggtttcaccctgttggccaggctggtctcgaactcctgacctcaagttatccacctgcctcggcctcccaaagtgctgggattacaggcgtgaggtgctaggattacaccagcacccagccccctttcccttattcctgttatgattattaaatgagatgggctagtatattaagctcttagcgaagtgcctggcacgtagtaaacaattcatgcatagtaccgattatttttggtgttactgtttttaaaataatttttgccatatttagtcaatgtagactgctttgaaagcttatagatttatcacatgcaaatgattaaatgtgatttctgtgtctccttcataacccttggctgtcaggtccttgggcagatatgtaaatccctgctcttgaatcgatccgacattaaaggcgatggggattagataattttcacttaaagtgactgtcctctttttctgggaacctgtcacaagcgggagttctgcctcgtatatcaaaaaggaattctagaaggtgatttcatttttgctttcattttgttcttcaaggaaagggagttaaatattaattaagaagtctaatccagtaaatatagagatgcaaccatcccagactcacagagttgatgataaaaggagctgtgaaagggatcaaagccaataataagccaggatgagcagagcgaggagcgagcgagagatgtgggatcaaaatatgcaagaagcccaactgcaggctgtagtgcagagcgcctttaactacagcagaacgctgcagcatcactcattctgaacacaagttatcaaacatttattgaatatctactacatgctgagaactagaaatacaaagataaatttcacaaaatccctgcccccaagtaattcacatcctcagaagaaagtcctaaatggtgacaggaggtggcatagcacaataattaagcacatttctttggaatgagactgtctgggtgtaaagctcagttttgtcacttcctagcttttgggatgtggaaacgacttcatctctctgagtagagttttctgcactggtatgatggaagaaccaagtcatgactttattgtgaagagtaaattagtaaaatatttgaaatgggctcaatgtagtatctactacctggtataggcaacattttacatagtatgccatgattaaaggttgcacaaagaagttaatatttgggcctggctttgagctagaagaacattgttcttgtaaagaaacagaatagatcacatcttaagctgagaatacaaagatactgtaaattcagagctcttacatggtatgatcgggaaataaagaaatagtggagtgagagagaaattgaaagtgagaaaggaaaatactagaaagttaatcctgagccagctcttggaaaatgtagaattgcatagcaaagtattttgactttaccatggaagcaaatgtgggtcaccgaaggttattaacaaaggagtggattgattaaatttgcatttagaaaaattattctaaatgtggaatctacactgagagaagcaggacttgaaccagaaggaggaattagaatgccaagagttgataatggtcccatttgggcaatgagagtgatgggaaggagtgaggtggaggagggaagtttcagaggcaacttgacagggattagcaactggtccaagtgggtagagacaggttcatagagagagggaggattctagagtgggttttaaggactacaagtaggatgactaggttagagtatagtcaataaatgagatggagggtaggaggagaacatctgactgggaaacaggaagtttggttttgaaaaatatgaagtatatattttcttgggcttctgatgaggatgtggaaataggcacttggaaatgtttttatggaaataatcagaacgtgaatctggaaattaagataagaaaaccatcacccatagattataaatggggctacatcaggggatgagatgactggcagagggaatataaaggtaccagggccaaggacacgaccctagaaatgctcccttttaggggacaatccaaggaaggtgagtcagtggaagagatggagaaaggatactcagagaatagaagggtgaatctatcctcttcttggcagaagggactattaagtagagcaaggtcaaccatgccataagccacaaaatatttaattaggatgaagaatgagaaaatgcctttggatttgacactggtaacatctgatggaatattctaaagtgaggtccttgtaggtgcttgattaaaatgcctaacaaaggctgggcgtggtggctcatgcctgcaatcctagcgttttgggaggctgaggcagaaggattgcttgagcccaggaggttgaggctgcagtaaactgtgattttgccactgcactccagctcggggtgacagagtgacactctgtctcttaaaaaataaagaaatttttacaaaacctaacaaagaggagggtataaaaaataaaagctgagcgaacactacgtcctgtacatatgtagagatcttgcattttctgtactaatgcctcatatacagtagacaatcgaacggtgtctgtcccatgctgtacatatgttgaagttttcaacttcactcctttgcctaaggagtgatgctaactgacaattttcatcatattctgtccaggaggaccttgatccagggcaaggatgcttatggacaggagctgatgcttggaattcctcaaattataattctaaaaattgtgtttgttgagaatcatgagcagccagtaagattctcataatttatatagcatttgaggattattattgaacaagaagtctttaaatttttaaaaggacaaagtgtaaaatgttctgaataaaaggctaacacacttagcttaaaaatgtagtgcctctgcaagcttaaaccgtgaattttaatcaaagccactgccctctttgagggagttactcagaagttgcatcagattgttgatgataaataggcttcagcgattcatttaaataatatttttaaatctaagaaaacccctattttccagctttaggtatggaaataaattatcctattagaacactgacattctaaattttgagaaatagcataaaactcacggacgaaatcagtttgtattattgttggatagttagggttgttttcagttgtaactttctcttgtctttgtcatttccctaagtgacagaggagaaaggaaggtggataaaaacagaacttatagaggatatattctccttcccaccccatgtcacctccccaaccaacaaatgcatatttaatggcccttccctcctttactttgattatttaatcatcatatagtgctacagcttttttaacagtccctttaaaataagagaatattgtcagtaccattttttaaaataagagaagcagttggttttgaattgagacagacctgaatttgaatcccatctcttctaagtaaaagctgggtggtcagctgattttttaatctttctgagattctccttggtcaccagttaaatgacaaaagagaatataaatatccattttaaaaggttgttgtgggattatataagctaatgtattatatgagcactgcatcttccttgggttctattctcaaccaggaggtaaaatcataatcataggtagaaacatttacccctgacaaatcccttaaactggctctaaatttgagaatgcatgggttcatgcatgcagtcctattcagtgagaagtatgtatgaaggtttaatgcttataataatacacagaacataatgatgtgaacatgtatcaagtatggatatatttagagttttgagaaacacatatggtaagcaagagttagaaggaaatgacatgtctgacttatgaagagattaatgtctcccatccttcattttggctgaagtgtagattctctctttctccttctcccatcccctaacatgagggaattttccagtgcacatagaatggacatcatgatacaccaaaggcatgccacagttcctagcacataataaatggtaaatagccattcgtatttttaatgtcttttattctcctatagaagggattttcaaacgaaaactgctctgtagcttaacaagggtttaaagagacttcagagccagcagcatcagaacaatgagacatgcagccttgttgcctaattcactcttgggtgaccagtcttaaatgatgcaatgtgaaatcatttcaattaattttggtctgtctctgtagtcttctgagggccttataaaagaagtatatgcttaaagctaatacacaggaaggcctgaaagctccaaactgtgcagcttttggtggatttgaggtaaaccctttatgaggaacaagagagaatggatttgcttatggttatagtttctctctctaaagatttaccagcttagaaaatatgtatatatgcacatatgtgagtgtgtgtgtgtaagtgtgtgtgatagttattattttttttaagcaaaacaaaatttccttaattcatccctgatattgagagaataatactaatacatttgggccatttgtgacttctttctcaaaaatgctttttgggatgccaaaccaagctgaaatgtctgccacccttgatttttggtagtaaaaaaaaaacagtttgaagtagcctgaagacgaaacataaatcaatgttattcatagcttacttatgctatgctaatatatttgccataggcaagaagtactcctaactaataaacttactttaaatcattagttgaaatgtctggatattccttctaatgatttccccagcttagttttgtcaatgcttcgcaggtcttcatgccttctacctgaacgtatgggtcatggtagatagacagaacaaaaaacttttataacattttaaaaactgggattagaagatcctaaaaccttgtctgagtgctctgctgttgatttctcagaggagtaaaatatacgtggcaacttcttcagaaagaacatattaaagttgaagtataaggatttttagatcaaaaggataatgattttttaaaatctttactatgtgataaattattctgaaggcattataaagatgtacaagcttgcaccagggaataacacagaaagttggtggtgactttgaaattagtatagacataacactaacctccttccttccttggccaagtttctttatagcatgatgccacaactgttttttttttttttaagtaattttttcttatcaccaaaagattttctttttcttctttaagtgatatacacaagaacggctgcatgttttaaaacatgtggaacatgataggctcacctattttccctctatttaaaataatggtttcatagagaattgtaaattatttctcctcttaactttcatgaagaaaatgacacttatattttaaaccaatttaactctcaagatgtgccatctgtgcctctcctcttgtctctaggccaagagagtgttattaagcttgaggatgggtagaagagaagagtggcagagagaggcactggaggtgtttgagagaggcatgaggggagatgaaaggcccgtgcaattggggaatttcctggtgcatttccctgagaaaaaaactaatgatggtgatttggggttatgaaaaatgactgaccgtccatcagcataggataagatcagaagattcttcataacgctagatacaggactcctgaaggcaaataatatgattgactatcacatgggtctcatgcaaggagagttcatacgagttaaaaggataaaagccctggtgtagcccactggggagagataaacctttgaaggaagcccttttaaccacattcatcagtaaggccataagggacttccttggaagtttatcacaattgcttttgcatgaaactgtatttttcaccatggtctccaatgaagataaacccagtgctgctcatatcattgaaatctacagtggagatctacaatgaccctctccatgcgtgttggtcatctctttctgcttcttcatgccctgctcatgtttcttcatgttcctcctgcgacttattttttgtaacagcatgattaagacataattcacataacgtgcaattcactcacttaaaatacaaaattcaatggtttctagtatatcacaggcttgtgcaaccttcagcacaatcaattttagagtatttttatcaccccaggaagaaattcagaactcttagcagtcattcccattcccctccacaactgccagtcctaagcagcatccatcaatctactttgtgaccatagatttgcctattttagacatttcatgtcaatagaatcatgcaatatgtagtattttctgactggagtctttcatttagcatgatgttcttgaaattaatccgtgccacagaatgtgtcagttctttattcctttttgttgacaaataatattccattgtatgaatatagcatgtttattttttttcattcatcagttgatggatatttgtgttgttttccttatgggctgtttctttgattttttttcttcttggcatcgtgtatgatttccgaatagcatggtgcaaaataggccttgaagtttcctgcatctgggtgcaaactccagttctgctgctgataagcaatggggctctggtcaagttatgtgacttttgtgatcctttatttctcattttgcataaatggacagcccacagggtactgctcatattgccccttggcccaatgtgaggatataataactattgaacatttttttcatttattgaatgagtaatcacataatatgagccttcccaaggagctcttatatattgtttataaaggtaatctgggtaatgccgggctcttacactctattttaaatcaagcaagtgaaggcttcagagacatctcttcgtattgacagtgtgctctgcaaaagattcagcaaagctccatgagaactgtttctgttcatctcttcctaactcagcctcaccctgtaattttaggacataagccccacagacttttaccttagatatagtgcaattcaaacacacacacacaaacacacacacacacacacacacacacacacgcacacagagatgccaaccattcctgagaaggaacttgcagaatcttccatttcatagcattatctgttgagacagaaataatgtgattgatttgccaggtcatccaggatttcaaaaacccccaaactaagccattttacattttagatccaaagtgttgtttatcataggctgttaagactttctcattttaatttcaaccagagaagaatacattgaatataaacagggcctcttagagcagtcagagagcatactgagagtttctctagtaatagagtcaaaaatagtgactaaccaagtctttaagtagaaatgctacccctaaataaatgcttctaaatgagatggcaaaaacgaatagactcttgtttaattaaaggtacttgtaaagtttgcttagagtttgcagtaatccaccttgtcagttctcatccgggatgtttaatgatgggtttgctttagtttccaaatggaaatcagctgctgcttctttacagcctgacattaggcaccctgtggaaattgtattattctccacatgcatattcatagaattaagtattatcaatggacttaaagagctcaattattttttgcaattgcatgcttagttgcttattctgaagtagagtagattgagtatttcggggcctggtcaaatccttgaaatataaatgtgaatgtatatcagcagaaaatcaccagctttactttatcagttggattgttaagacaattgccaacaatattatcccttgatttatagttcacaaaatgtcttctgttataatgagcatagtttttttcctcacagaactctgtgaacaaaaaagcattctacagatgaggaaactgattgtcatccaagaagaatctcttatctaagattgtataagtactgaagcaagattaaaatctagacattcctgacttctagttctttattgcattttctgcatcctattgcttccctggggaaggtcttatttctgtatgtttggaaatacctacttactttagatttttattttagcttgtgtatgtgtcatggtggtgtcattttaattaccaggccactgaaccacatggacatttggtaatagacagaatgctgcatttccagatgctagagttagtgtaattcttgattaataatttaatagaaaataaggtgtttgtttacaatgttaactaaacattcaaggaaaacacacagcagcaattgagatgagaaaacacagaatgcaaacaggaaaacaaaagaaatgaggatggattaattctacatgcagttgaaatataccacctgctttgcccttgcttttgggacattcaagttcatctctctttctccagtatcattgtcattgtgttagattattactgtggtttgtagagctatagggactttgtgagcagtgatctcaaactcaaatatctataagaaccagactaaaaatataaataactgggtatatgctggttatagatacctgtatctatgttctgcaagtgatggcatctttagcaaactagaacataggtactagttaaaggagctgagctgtgttcccagctggttgttgctctcttggaattagtacagaatttcccagatcttgtaattttccaagtaagtccagatatcaatatattttttaacactgtgaagtctcttactacctgaattaattaaatctaatgaaaaagaatcttttgtagaaaaaaaaatggccagatgtggtggctcatgcccgtaatcccagcactttgggaggctgaggcgggcagatcacctgaggtcaggagttcaagactagcctggccaacatggtgaaatcccatctctactaaaaatacaaaaattagctggtgtggtggcacacacctgtaatctcagctactctggaggctgaggcaggagaattgcttgaatgtgggaggtggaggttgcagtgagcagagatcatgccagtgtactccagcctgggcagcagactgagactctgtctcaacaataaccacaacaaaaaaccacaaactggcagaaattggcctacaggccatttatttccaacttcactcaaatggaccttcctcctagaaaggaaaaccatcctcatttaatattaagggactaaaaatgaaaagaggtgtcagtatatacattctgatcacatccgtacttggaagttcatacaatgaattcatcaaactctcattcttcttctggggaaatatctaaactccattgcatttccttattccactgtggcccattgtggattgtgtgttatatttgaatatatcaaatctagcaaattgacattgaaaaccaaacatatcagagacaaactatagaaacacaatagagaaaataaatccacctctgccaaagtatgatctttccaatcatttcaactcctaaaagtagaaggaagcttggaactggaggtgttaaggagtttgcttggaaaaagcaatgaaataaatattgctgtctttcaagaatatatatgtctaactcacctcagggtttggacctgggtgttgaatgaactgaggatctctttggcaagaagctctagtagatgacaaattcttactcttgttgtattgctcaaagaatgccccctacttcttgatagcatttctgaggtgccagagcttcaggtgataaatgacatttttattcttgacatgttactctttattatatcattgagaaataaagttcaataagtgacttctgataatactttactgcggtctttatgaaagatcgattccattaagtaggtacatttcagttgctattacttcaagtgatgccataatgtacttgaaattcagtctttagttaataatagcaagcttattgagtgtattagagatgtgctaaagtacttacttttgggcctggtatcagccaagacatagtattttagacttgcaggctttccatgtatttcccccaaaatcttatacatatatatatataatttaatatgtatctatagtgtatatatatgtctaatatatatatgacagagtatcttacatatggcatagcattttattatatatgtcatggtgttttagacctgtatgctttccatgtattttctcccaaatctaatatatatatatatatatacacacacacacatacaatttttgaaatgcaaatatgtgtgcaatcattttttagggtattatcatttaatatactaaggtaacctcattgattaaaacttgaaatatgactttactcgaagtcacttgggaaatatattgatggtcatgctattcataaaaatgaactcaagtctacctgtctagaaactgagcaatgtcacttgaaaagaatacagcagtaagaataagaaactaaaccaattatagtttttacaaataattattcttatgatcaggagtaatagttgtgtgcagtgaaaaagggtgtaatattaactaaagactagagtttgatttctctcagcttttagcactcaagaaaatgtgatgagaatgtctgggctaagcaggatggataaactttaacaaaaaagttgtaaaaacagtacaaggaactttcatatcctgaaggggcaattttaaaagtaattgtgaaattttaataacatagggaagtactcattcatctattgttaagttaataagcagcctaaaaattggcttacacattatagaaccaattaagctttaaaaaaacaaagagaaactcacacagaaaggagactggaagcatgtgctcaaaaatattaacagcggcatgcatacataataggattatagatgattttatttgtgtttttcatttttctgatttgttaaataataaaaaattcctgtatgcaaagaaagcatgtttaagtaaaagtatattgtattggtagtgttaaatgtgcttgtgccatttttattcaggtaggggtgtgtgtgtttgtgtgtgtgtgtttctgcacattgataatagcaaaataccagttgtatcagtgatccatgatgaaattgttaacactgatgatgctatttcactgtggaattttcttgtgatgttgagaatcttctttgttagtttttttagaagtaaaagcttatcataaggaaagtatcaaaaaattaggatttgaaatttgtaattaatattaatttaataactcaactaaacaaattacaaattttaggatttcattatgatgtagcttcattgctttagcatgaatttctctctaccatcagaaaataaacttcttacctgtccagtatggagcatgtagacaattttgtggccagcatgaaatttttacagtgatgataccagcaaacacctccaagatataatgtcagatctggttaatcagtatgttaaaatatgtttgaatttgtcttgattagaaaaatagcaatcaaagcattcaactcttttcacttgttgagacagatggcctatctttatgaaggcaaatatccaaaaacaacaacccactaccttatctttcaaaatatggtgctcagaatcatcttggaaaagagctatttaagcctaataagccatatgcttgatgaattgatttattccattttgtagtatagacataaaaatcttctttgcagcatctttatcatatctgcattctctgcaactcatttataaaaattagcaaaacttccaaataaggaataaattattatagagaattcagcttctgtgtcttacaaaagaaaaaaaaaaatgtgtctaagtgaacagtctctgatttgccagatattctccccataaagttctgtgtatttgaagagcaaataaactgacagcttccttggtatgcataaagcaggtctaaaattattccagaaagaatccctcagagaaatgcaacttccctgtcattcttatgtattatttaaggtagagattgaccatgggcatagaagaaatatacaatgtttctgggtcctaaaagaagagagttcatatactttttaattttatgtattttaagatatatgtcagtgcattgtatttagcatggaaaagaatgtcctatcaaaataagcagctactcctgcatgtagtttagtggcaaacccacctattaacctctagccacaaccaaataaccccacacttgaaacctgaggttgattagatgaacctttgttccccataaaattctttaaaattatacatttcattaaaagaggaacatatttggtcaacttagaaacacattgttgtgcaatagaagagcatggctttgttattagatggagatgcattctaaatcggaatccaccatttgcttaactgggaactgctgggtacattatataaactccctgaggctgagagaggataggaaactgtgatgaggtaaaaaatcaaaactaaattttaaaagtaaagtatacttgacttttgcatgggatattatacttacataaatgtggctatttctgatcatctgaggtactggatttccaattattagatcaattacaaattcctttgcccaataaacacataatatttgagaaagtctttctttccactttaattgtgaagcataaacaaaagtgtaacctttgtggagtacgctgagtctttaactgaaagagatggcgtatcattgttagaagagagaccaagaagttggtctaaattatcagtctccaaaggctatgatatttgttacccaagttgtgtctgtgtttgtgtgtgcatgtgtatatgtaggtgagagtgtgtgtgtgtgtgtgtgtgtgtgtgtgtgtgtgtatgtatgtgagagagagagagataatgaggaccaatttaagacttagcttaaaatatctctacaggattccaggagattggatgaagtttaagttatgaagtaatctaggaaacattaataactctctctgttggtctgcaaaatcatgttattaaaactcaaaccatttggcaagaatcatcatcaatgtatcgaatgcacctgaaacaatcacgagttaacttttccatctttcaattatcatattcatgtctaaatacatttgtgttgactgactgctgatcaaactacatgtgtgcggaaaaggacaaaagatagaaatgtgaatgttggaaaaatacttactacttaaatgcaagtattttgataaaaaacattatcagtgagctcaccaaggaaatgttatctgggtgctggattggtaaagaaatatctagctatcaaattgggtacagtgggatttaagggttcacctggaagctctatcaaaagtttgcttaactctagcagaccaccaggatccctctggttccagtgggcttttagaatctccaaagctcttagacttgaaccacatttcgtttttggaaacagactcagaaagaaagaggaacaggagcagctaggaagtgtttttagtaatggttcagaaagtggggtcccaggagcagcagcattatagcctgaggagaaaagagagggacttgttagatatggaaattcttcggccccactccagaccacctgaatcagaaactagggttagcaggccgggcaaggtggctcacacctgtaatcccaatactttgggaggctaaggtgggtagattacctgaggtcaggagtttgagaccagccatctttcagtaagaaacatgattactggaggatgtggtataccacctaggtttgtgtgcaactttttttgccgtgataagattatctattactcaatcttagaagtagcaaaagaaattatggaatgctttttaaggcatacttcttccttgaatcagtaatcaaggaaaaactatggcagggaaaatagaaaggttaggcaatttgtatttcccaatggtttgaaaaaacagtggctgttgcatttctgctaaaggctgctaaatccaaattgatgaaacttttggcccagccttgcagaattccctttgaaatgttttgtcatgtctgtcagtttagtcatagtttaagatgttacatgtttaacttagggagatgagtgcagagtctgaaaatatgtcatcgaaagcaaaaaaaaaaaaaagtgacttcaatttatgacaaaaatacagcagagggactgaattggaatcttcagagagcatgagtatttgagcccctgccaaatgttaatccctttcaatggaaagaaggattagaaatgtacattggccctatatcttcatttaattcaggactactagttatctagaaacatttttgttattgtgtctaatttcgcactatttttggcatcattttcaaaaacctttaccctggtttatttatttattttttggctctgatcatcagtattaattcaattctatttgttttctacataattaaattgttctatgtgagcatcaatctattacagtgttacaagttagttcattgtttcaaggaggtaatgttagtatatctctgaaataacatgtaggtctctgattgagtaatgaaatacgatgtattcaatttcttctctctatttaacctacctggaaccatgtttgtcagactaactcaccacagagtgagcatggataaacttgtatgaggtcaaagcccataccactgaggatactaatataaaagattaccaatttgtgacaccttgctattgcattattatccatgcttacgaggctggttgcagtgagatgtctaatttgaattttctgaaccatgcctttaaggctcacatacctgaggtatttatccaaacacattgtaggtttacctccctcaaatatccagccatccatccgtttccttctgagcagagcaataaaaatcaagccagaccctatgctttacgtatagaaccagtaagatttacagccaggctgagtataaaatcataaaactttcagtacgtggttaatatataaccatcaaaataacagagtgcaattctaaatttatgaggctgaacttaacactgaatatcaaataagaatcacattgatctctgtagcggatgacttaaaaacacattaggtggcataaactgcaagacagtacattgatttaagcataaaatgcatagcgctcaatactttaccacctaacgtttctcagtaatgaacaaagctgttgtatattgatgaaaggaaaattatttgttttgttatattacagtgctcacagagatgccttgtatttaggctaggcaaacatggtttgaatcacatttagcaaagggtcacattggatggacattttactgaatttatacttgtttctcaaaataactgtacagaagcattatcacgatgacagttttctcattttctcttttaacagaggaaagattcataccaggtagatacggactttttgtagaaatacactttactgtaagttttctgataaaggcaattacatggaattttaaggttgatctctctaagtgcatgaaatgatcttgtaaaattaccatattcagaaaatctaaaagcatattttaaaaagaaacaataattttatggtaaatacatattttataaaaatctttactgtagaaggatctttaaaaaattgattggaatgaggaatattaggaaatgttaatagctacaggtgtgtccatgtaatatagatagcaaaatggataaaattggttctgatatggggtgaaaaacaaaagctaacactcggcaagtgatttagggtgatttatggcgtgatttatggaggtagtaggggccctggttcgctagagagagagcacccacttctcagcttcctctatctgattgttgtgtctgggtgtatgaaaatatcagatcttgggatctgcaataaaagtgagacatacagatttatctgtgaagtctcctgattttaaaacactaacagatgatttaaatgggaaataagaggtactgatcaaatgtaacctatcttaggtcgatttccagcactcacactgctggttaaagatcactcatcttcaggcttctgggaacgttgcttcatccagaggagcaagagttatcctttctgttggtggaaaaaataatcagtggaagaatccgatattcaaattttcataatttgcttgggaaatatcaccttggtacatcagttaatattttactaaatgagctgtgttgtattataagtttccatcaggcgggtggtagcttcaagactttggtgagaaaagctcctttgcaagttggttctctttcctcacaagtatccacaggtaaagaattttgccaggactcagagaacagcattcactcactgaagtgttaatggcaaagcaaatctaggtgcaaagttggctgacaggtccgccacaggaagatttctgtctatcaccatttcaactgtaggataggtaagtcccttttcatgaaacagtgctgggaggaaattgtatcattctttccaataagtgactctttaaatgaaaaaaaactactacagctttaactttacattcaaataaatgatatatgcatatttgtagcatgtattttacctgttgtacactttctagcattatgttttcaggctagttttccttcataataaattaacttattactcttcatgacatgcaagatggactgtgatgttaaagaataatgttttctaattatcattgacatttgcagagaagattaaaatttaataaaattaattgtccattcttgaatggcttactttgcagttaatcatagaactctgatttctcttactcttatgaaaacttctgaatttcctgtgtcttattaatatccatagtaaacccagcacttagaaagtaagttagattttttccttctgttgacattgttgaagcaaaaaaaaaagtactgattttgaaaaaattctatggttgaagtttttcaactgaaacctttaccagtaatctcacccatcttattaggaaaacctaacttctggaggttatgttgaatggtgaggaatgtatcctcttcgccgtggtacatctctagtaatataatttgaagtgctagggccccttgcatccatttctgaatctattattagttgattaaattagctggctggatcagtacagtgagaagagacgcagtaatgatattatagaattagtatgctatgatgaattgtcaggagaagtaattgtgacagccctgtggccatatgcacttagccatgcaatttatagtcatttggagagccaaggacttttcagtttgggttaggaaatttgctcctgcttttgacatagtttgagggatatgtgtgtaagagtgaagggggtgcttagcagcgattcaggaagaaatcaaaagtctcacttcttagccattggcatttggatgattttcagggaataagccagtgtgtggatgcctttattgtaacagtgccaattcctttaaatagatttatatgatagtgccgttactttatggttgctgaagataacgttactttgggtaagataaaagtaaatgcaatctggtatcacaatttcccttgttatggaacactgtaaattctcatccatgtactgcatttacagcaatcctgaaaacattgctggggttgttttgatttaaatacatacggggctcctaattgcaagtagtttttaagcaacttaaaatataacgttactttttgtttgtttgttttgcaactatttgcaagataaacggactgtcaggtgcctctaaaaggcttatgatgacagcagttggcaatgcaaatattggcacgacaccacattagggcaaatttattgcagaattaccaaaacatgtataactgtgaagtcacctcagtacaactattatatgagaattactctcttgctgtttttgtttttgtttttgtttttgttttgttttttcattttatgactaccaggctacagtaatattcagtagtacaatgaacatgcttactgacattctaactccaaaccagattcatgcagaaaactactcctttttcttttagctgtctatagatattttctgtgtataatcgatcgcttttatttctcaaacaggattttcatttgattacagatgattgtttcgagatcattcaaatcaatcaaatgatgtttgattacatagattgtttcgtttttcttttcttctcttgtcattgttttatccattgttaactcaatgtcaatatttcaaagataatctataatcaaatattgtcttaggatcttattttatgtcttagccccttctccatgtccctaatcttaatcacccagaattacacatttagaaacacttcttcagtaattctgtagttgcacatttcactttgaaggtaatagaagggtgtctgtcacttcttcatttctgtgtccttccagctcactagcactcttatctgggagttatttttgactctcctccttcaccttccaagtctaatttaacaccaacacttgctgattccttcccagcacagtccatccctggcccctgccatcattctatactggagtgcagtgctcccctcttagtccatctctctgccatctcttcccagaccagtagaacctatatatactgaattgccagatggatctcttaaatttttattatagcccctcatatttcctccatgtgacatgaggccttttgcttattcttattccagcctacagaacttatgtgctttttctctcctctatcttaccctttccctagcacacatagatggctaactataattgtaatttataaatttttgtgccaggtactgtgctaagtgctttccatacattatctagtttaagcatcatggcattcctacgtggtaagtggtgtgattccctttttatagtcaaagaaacagaggtgtgaaacaacttgcccaccaaagtgaaggtgtaagaggaagagccagggcccaaaagtaggtctgtctgactttgtagtgaaaccatcaactaccgtgcagcactggcaccctggctacacgtggttgtgttgctgtttccctggtgtggatttgcattcaatattcatctttttgataatttgtgttcctcctcccctttgtgtacatttggagactgaccccacctttcattttgcattttcatatttgttttactgcattaatttgcattgaataatgtgtcactaagtatttgtgcttgtacacgtacatcctcacctagaccacaatcaaattaaactgctttggagagctgggcacggtggctcacgcctgtaatcccagcactttgggaggccaaggtgggtggatcacctgaggtcaggagttcgagaacagcctgaccaacatgatgaaaccccatctctaataaaaatacaaaattagcagggtgtggtggcacatgcctgtaatcccagctacttgggaggctgaggcgggagaattgcttgaaccccggaggtggaggttgaggtgagccgagattgtgccattgcaacaagagtgaaactgtctcaaaaaaaaaaaaaaaatattgctttggagaaacgtatagaatcaaaatattttccattcttcaatacaatactttggacttacagtccctaatgaaggtggacattcaacttactaattgttcctctttgtcagggtgactttgttgctatattatattttaatattttcatttggtaaattgcaggaaaattagattgtcttctatgaagcttgagaaaagctaagttttgcaaacaagctcctgaccatacagcagtagccagaacaatgaacaggacatgaacaataaagaatctgtgaccaacaggaagatatggagatttgcatacttttaaaaccttatgtgattaatattagattcaatctttacatttctttttacaacattttgttccataaaaaatgtcaagcgtgtgtttgctgggaagaggaagagttcattattcttatggttttcttcattatattttgaaaagccaaggatggggaaatcaacattggtaaaagcaattagtgatgtgggttgaggtgcgggaattacatcctatcccttggcatcaagaataaataccaattattatcatatatagaagtgtgcctgtgtcgcttaaaaaattatgattgcttcaagatagtttaaacattatcatctaataaaagcatattgagaaattagataatttgactaaagtatataactatactaagcaacctaaacttaaaattatgtatatatttacatatacgtttcatatcataaaatacaacatactatatgtatatacacacacacatgaaaacttagatgtgtatgtagatagatagatagatagatagatagataattatttaaatatgttggtaggccaggtaaggtggctcatgcctgtaattccagcactttgggaggctgagatgggcagatcgcttgaggtcagaagttcaagaccagcctggccaacgtggtgaaaccccacctctactaaaaatacaaaaattagatgggcatggtggctcatgcctgtaatccctgctacttgggaggctgaggcaggagaatggctgagcctgggaggtggaggttgcagtgagctgagatggtgccaccgcactccagcctgagtgaaagagtgagacgtcgtctcaaagtaaataaataaatatagatagatagataattgggcagatgggtatttagaacgacaaaatttcatcagcatcttttcccgtttcacttaagcttctgaaaagcccttcttggtcagaatgactgaaacaaagtgatggccttttcaaagttacataatatattttcagcacatcccctgactaacactatgaaaagtgcatccattctagagtcagacaggcctaagttacaattctggatttactcatcactttctgtatgtttttaaatgagttatgcaacttctcttcagtaaaccaagaataaatatacttatgatatgaagttaagattatccgaaaagggaaaactcagccctcatttgaactaaaatcagcttaaaaggcaaattgtaagtaacaagaggggacttccaatagtgagcaagttctaccaatatagtaagcattcctggattttgcagcagcagagagcatgattggaacatttcaatgagaatttatttggcataaagggagttagaattaagttgaacttcgaagtaagtgtaataattaaaataataaacgaaaagaaggcaaaaggaaaagatgtaggtatagagttttatactttgcaaaaggtcaccaaaattcctggtgaccagttgcttaataggaatagggaagccagatgcaggagtagtttgcaacttggaaagcacgtgtccgtgaaaagtggagagcttattgttaccctgtgtgaaggaaattgtaggctatgagaccttttaatttttctagactatcttaaaatccagttctcaaaaacaatctgatttttaaatgatgtcaaattattcaagctttctgggaccaaataaactatgtggactccgggatggtggcctctctactgtactgtgaatgaggacatgtatagctggtaataagtatgatggcaagtggagtggagtgggctttacacccttctcagcaggggagccctggaagttctatgacctcacctcctaccagtattcttctcactcactcactcacttccagccatgcggtctttgaataagccaatcccatttccaatttagggagttttgcactaagtattcttcctgcctgaaatgttctgcctcaggtatcttcatgtctaatgttgtctccttcaagttcagatgtcaccttctcaataaggcccaccctgaccattgtgtaaacttgcaactgccttcccatccctgttttatcatgatacctcgtctttttccgacagcaccatcattctctactatagaatttactcccctatcacaatttcttcttattatcaccctgtccctactggaatattagttccagagtggcaggaatctttgttttgcttactaatatacctagaactaagcctgatatgttgcacacactcaaaatatttgttgcataaagaaatgagtgaaggaaggaattaattcaattgttatttaaagaccatagtaaaaacgtggacacatacttttgaagcacaagactaaactaaattaattggagacaagaggactttaacatttaggattggaggcaccagcatagtaagaattgggaaaggcttataaaattgtaaaggtgttttgaggtcgtggttaaacagtaatacgtctatgctaaaactttaagagtatttgctaattaactaacctcatatggaacaaaacccccacattgttgatatctcaaaagaaatattagtctgacttaggccactgatccatgctactcagtgttgtttttctgacaatagcaataaaggtaattatatttgaatattaatggttgttttgcaaagcattgttctgatagagtagtcacttatattgaaattaacatttccagtgtacacacgttaaccttgtcctcagtcaacagctaacttaaattaagtgcctattagagctccatttaactagagatcagaccagcctcggcatgggtgttgtccctgaggtgtttaaagagagccaagcttctgctcaacaggtggccctcctctttgaacttctagtgagagctccagtgaatatgtggagatacgttcaatgggcattgtaatgtggcaggacagagtgtggacgttggcgactaataaactggatttaagatggctcttccacgtccattagctctgtggactcctagatagttcacaataaacctcagcatccttacctataaaatagacaataggaacatctactacataagattcttgtgaatataacatgagctagtatatacaaaattccttatcacactattttgttggtagtattctgttttttgtttgtttgttttgagatggagtctccctctgtcgcccaggctggagtacagtgccatgatcttggctcactgcaacctctgtctcccaggttcaagcaattctctgcctcagcctcccaagtagctggaattacaggtgtctgccaccacacccagctaatatttgtatttttagtagagacggagtttcaccatcttggccaggctggtcttgaactcctgaccttgtgatccacctgcctcaacctctcaaagtgctgggattacaggcgtgagccaccattcccggccggtagtattcttaagaatgttttgtctaccctctccattaataggatatatttatgacttttacaagtaaacgtcgtatttgtttggcacttgcaatagtggtgattagttcgacaaatagcacaattattctgcttcagtaggatgtaacctcatatcttaaccaaaatataatgtggctagcaattttacaatgttcaaaatacttcagaaatccacaatgtgcagttcaacataataatttctcattttctccaatcagcatcccaggagatctagttattcatgcagatcaacacgtccatgatttaagccgtgagcttttaggaacttcactggcccaaagctaataggtgaaaagatatatacctaacattttaagggattttcaactcttgatgtcttattttgcaaaagagctttgcagcaataatttatcaggcagcctctctgtccacattggagtattctctagaatgattcttatgtttattttacatttcccttccctgcaagaagacaactccaggtaaggagaattgtgagttaataagatgcatgccactgatagcaacagtctatttgatgtctatttccaaaagaaaaatgcaaagtggagtgtgtaatcccttaacgtaagatacctccatgaatcccaatgcctccacgtgaatcctgatgccagagctgcaaggagcatacactgtcagggtacagaaaatgaagacctctctgcttgaaagtttaaatgccctgctcagcaggaagtctagaaagatttgttcaactgaaatgagcttataatcaggctttcatccaaagataaggaaagacaacatccagtagttttatgatgcactcttaccaggaaaacacaaatagttttgtccatgttgtgcagcgttgactcctgtatagcatatttcaaactgcaatcatgaaaatgttccatttccgactaagaagaaaaagtcacccatgaaacttgacaccgtaccttcattttttttttagcaatgaacaaaaaatacacattgttagtgtcacccattctattttttcattttctttttatgatttagaggtgttcctaagacttgcaattatttaaataaaattattgtagcatttttaggggtcattggtacatttactcagcaaagttagctgcctgaaagacagattaactgctaatcagtgcttaatgagggctttgccacgccatgtttgagcacttgtcagtataagaatatcgattagtaaagccaccttttggacttattgttggtaaactgggttgatttctgaggtggataaaatgcatggctagatattctgtccactgtgctgttggcaggctgttgtttatcacaaggttttagtgttcttaatgaactgttaataagctgtcaattatagtgtttatgcaaattagggaaagagacattgaaggattgatgtgcctagcattaaaaatgccttcttgatacgttataaagtaaataattccccttttaataattgtccttaaacatttgctcttctttgccactgaagcattcccacgttgggcaccctggaaaacaatagtccaggacttctttaagcattatactgagaaaacaagacacatctatctctaggatgtactttgctttatgttagcaattctggaatcattttcattcaccctcggccgtaagtgaagttcaatatcaagtgttctgaaattcatgggtagctattctatgattctcatgtggggcatccatttttgcctttcttcccactggagaccatcgaccatggcgaagcaacctcctcaaccccttaaatgtcctgcgctaatggtagctgtcccaagtcccatgtgctttgtagtgcctcagattatctctttagtacaaatcctttgtgtggttataaattgtcaactgaaactatttcttttaaaaatctgcttctctgcctctgtcccggcagaaatacctgtctttggccagaaaatccattaattttctattctgggtttttgtttttttatttcatatgcccttgaatgtgttgacctaacatgccccacctgacgtccttcaaggacctatacaattgtcttgttctctcagtcattcttccggccccgtttacccaggcagaataaatcagttcctttctgcagcagccccagagtactttaaatgagttagatatattccagcaccccccacccctattctgcacacacacacattcagaaattgtgagctctttcagggcttggcctgctatttattcatcttcagaaatcatgtcattcaatgttagaaaatagctacctcaagacactctggaagaaattctgctcagatttccattttataataaaactaaggttattaaatggttcccaatatttaaaaggataataattttgccgcaatctcgtcacttttatttttaattgttgtgatcagaattctatccagatagttattatgggagaacaattcctgaagaatgcttaacctctcaatacaattaaagtagacatcttttaaaggctcttaatattccccccagaaatgtaaaattacatcttgttttgtattgtggaagtcatgttttgattatatgaaattggtattttacgtgaaaaaaaaaatcttctgttcagcttggagcatgaaggtttgtgcagttgttagcacattacttattccaaaatcattgaaaatattattcttgcaggtttggggttttttctaacctcattcgctcagctctgggagttataatgtttcataaaggaagtatcataatctacagcaaaaatcatgcatccatatcagttgaaatgatggattaagctgttttattataagtatatcacaaatgcaataaatatttgccaatgaaatgcagttatcataaggttttgcacagtgcaatttcatgttaatgtccaagtagaatatagatggctttatatgtttggttatagtacctgctttgcagtttgaaaaatttatttgtaagtgttgaaaatataaatatgagagttcaaagtatctatgagttatttctaaataccacttaactcctcccaaggcagatgaggatagtataaaactgcaattctcgtgactgataaatcaaatgaaataatccaataaactggaagaaaaattgtgaattggtcttctgagaggcaagagagcatgctggtaagagcttggactccgaggtcaacaagtatcttgaccttctggcaccttcgtttgtaagtgtggagataacacccagctcctaggatggccttggagattaaatgagtttgggataacaaatagcactcagtgagggcttactatgtgccaggtactatccaaatgcaaatttcaatttctaaattttaatctctctctttaatcaaacatacagcttttgatatttgatatgcattcttgtattttcctcttaggtgcttttcagttatcttcctgagaatttgtgcattttatgtagaaataagataaaatacacaagatataatatcctactggtccttaattccacagcttaataactgtatgaacatgggaaattacttaatctctctgcgtctcagtttcttcaactataaaataacaatgctgctgctgctgctgctgctgatgatgatgatgatggtgaagatgatgacacctatttcatggggctgttgtgaaaattgagatgatccctgttaagtatttagcagagtgcctgacagtgagtgctcaatcacttattattattgctggtaatactgtcgttagcattacttttgctgttattaatgtagtgtgatttatttttaaattagggtcaattgaaggaactgggaatattttgtgagtaagggtttttatgtatatcacattcgttcttctcataacctgccaccctcctcatttttgttactgggaatgaaatcgacttcaaaataaacctaagaacccggactcccttggatctgacactgaccccagacgccaagccacagaggagtatgctgcagtcattctctctttgaaattctaattaaaaatacattttaaaagttttttaaatgcatgtttttcttgaattctgatatgagccatgcaatataaaatggcactgtaacatctcttcaaatatgcgcacttctattcacaatagtattttaaaaagtaatcttacaaaagttttatttaaaaataccttgccaggtgtggtagtgcatgtctgtagtcccagctgttcaggaggctacccctcttgggtttgttttctctaaaataaacctgtccttaattgtcaagacaccgttcatgtttctttcctctttctttaattcttacaggggtgggaagattgcttgagcccaagtgtttgagaccaacctgggcaacatagtgacaccttgcctttacaaaaaaaaaaaaaaaaaaaattctagatttaagcattttggtaatgcttccatttcactgcttctttcttaactgttttggtgtgattgcgatccattttgtagttcactaatttggtatttaactgaactgatctgtcagatctatcaaaacatgggctgttgatacaatttgagctatttcttcatcgtacctgtgtttactttgagagtttatcagcgaatgtttatcaggaatttggaagcctagcagcaaggtgaattctagaagaaaaaaaaatcaacaacatatgctctacatttttttcaatactaaattgatcatctcaaacattattttcactacaaaaacctccatgagtcacataaatagcttgtcctttcaagatcatagaataaaaactacaaggacagatgtgctctagatgtcatttcccagctggggcactgtgagcaacatggcaggggtgaaagaacaacatgtggtcaggatgccttcgtgtgttcagtttttattttcaaagaaaaagtaaaaaaaaggatgaaagaagtggggaaggaagagagggagggagaaagaaagagaaagaaaaagagaaagacaaaacaaccaaaagaaacagaaaggccgggcgcggtggctcacggctgtaataccaacactttgggaggccaaggtcgtggatcacctgaggttgggggttcgagataagcctggccaacagggtgaaaccccatctctactaatgatacaaaaattagctgggcgtggtggtgggcacctgtaatcccagctacttgggaggctgaggcagcagaattgcttgaacccaggaggtggatagtccagtgagccgagatcacaccactgcactctggcctgggtgacaagagtgaaacatctcaggaaaaaaagaaaggaaggaagggaaggaagggaagcaaggggaggaagagaaggaagggaaggaagggagggagggaaggatgggaaggaagggaaggacgggaaggaagggaaggaaggaaggacgggaaggaagggaaggaagggacgggagggaaggaagggaaggaagaaaggacggaaaggaagggaaggaagggacgggagggaaggaagggaaggaaggaaggacgggaaggaagggaaggaagggacgggagggaaggaagggaaggaagaaaggacggaaaggaagggaaggaagggaaggaaggaaggacgggaaggaagggaaggaagggaaggaaggaaggacggaaaggaagggaaggaagggacgggagggaaggaagggaagaaggaaggacggaaaggaagggaaggaagggaaggaaggaaggacggaaaggaagggaaggaagggaaggaaggaaggacgggaaggaagggaaggaaggaaggaaggaaagaaagaaaaagagaaagaagccaacaataataattcctggtttcagtatctggtattctagtgtatttttccattcagattcactaattcagaattttctctattccctcctttttttgtctgttactattaatttatgcaagtcttttactatctcaatttaaaatgagtattttctttctataaaaggcaaaatgctatagatacagagatcatgctgtctcctcaatagatatatgagttttttaaaaaattaattactattatggctacattgaaatgattagtaggaaatgaatctaaattgcttctaaaacaataaagtttaagtgcctcagtaaccctatcctttgaataaatacaaccaaattttagttaggtaaattttgttttgcaaacttctacaggttattgaaattcttaaagactgctattgtgtttttttaaaaataacattttggtcttcaaatacgttactaatcagcagcattcatttatggtatacctaaaacatgctagtaaaactgtaagcttctttcttccttttttattttatatatgctcattcaaatttgactacttcaaagttttgaaattgagaaaaaagaatttgaaatttcacatgtgcctttgcaaaaagtaaaatgattaatttgcctgcaatgcttttacagtgtgtcatactgaaggcttgaaggatgtatttgatcttatcttaaaattgagtggccttgttttagtatataactctgaacaatgaaaaaaaagagcattttctgtatcccaggttgcttttataaatgatatccaccttcaataattgttcaatcgaggccgagctcagtgcatagagacaagaatgtatttcttctctttcttaacagtggtcagggccttacacaaggatgtgttcatgttttgttcctttgggcttcttgaggctcatggtagttcactgagaacatgttccatcactattaaaaataatgtccttcttcatcagtaacatcctaatgtcctttaagtgttaaacccatccctttctgcattcccagaaagtatttttatacacgtgtgtttttttctctctcctggcaaatctataaatggaatttttgaatggaatcctatgatataaatatcttttaaagctttctcatagttttacctgctttgcaatgagccattttctcttcaaaatcaatgcctctcattaagacaacttctggcagggatgaggatctagcatcagtttatagaaaagtggtcatgattttgcctctgggtttgttttaattgttcctctccatgcagcaagctctgtggtttgagtagcagagaattcatttgtaagcttgcctcctatgtttctcaaaagattgttgtgaggactaaattaatccatccaaaattacttactgcacatctcctctgtgccaggccctgctacaggtgctgcagacatccgtgtaaacaagccagtccctgtgttcatggaatgtaatttggaagtagggggagcctgaaaatgaacaagacaaaagcacaagtgaggactgaagaatagaaaataaaatataacttgtggggagagccgtggaggtcatcaggaaggtcagggaaattctctttctctctctctctctcttttttttttttttttttttttgacttagtctcactctgcccaggctggagtgcagtgaagcgaccgcggctcagtgcaacctccgcctcccaggttcaagcgattctcctgcctcagcctcctgagtagctgggattacaggtgtccaccaccatgtccggctaatttttatatttttagtacagacagggtttcaccatgttggccaggctggtctcaaactcctgacctcaggtgatccaccctccttggcctcccaaagtgctgggattacaggaggaaactctcttaaaatacatcatgtaagctgagaggagacttacaaaaaggagatagccacaaggaaacctgggagaagatagcatggccaaatgtcctgagaagaatgaatgtggagtgctggtagaaggaagggaatgagtggctgaggtggagggcagaaaagattagactggtggggagagtacaggggcaaaatcatctaaggctgtgatctctaaggagttttgattttattttaagtggcagagaaaccaacggagaggtttgtctggaagggaataatgtgatatactctacattaaaaaataataattatgtatgtaaaaatctaccaagattgaatcctgactctgccacttacttccctaagcctcagttttgttatctgtaaaatggccatcacgatcaatcaaactcgtacggtagagattaaataaaataatcaacgtaatgtgctttgtccaccataagtattcaacagaaggaggtgttcatttaggtttttcttagaagtccccttggttctccagcctgggccgttcattagtttattttgtgctctcctcctgtcccttaatatctgaaatttttgacaattttctctgagattcctggcatttgggcttccggagatggcggggggtctggtttgctgtctgttaattttagctattctccgctggaagtgccatcacaactagaataaccagagagaatgggaggtggtgcagcctattaagtggccccatggggctgccctagcagcaaaaatcaaaacaaacaaacagaatcccaaaacaggtttgggctttaggggttttgaaaaatggacatttttcccattaataacatatccgttaaactctactgtgacagctctcacaaagtttcttctaataacaacatttctaatccaaaatcattcattctgcctacaaatgtcagagccaaacaatacctagcagataatttggtccacagttttcaagaatacagggagtagaaaatagaaataggtaatctactgctatgtcatatttccaatgtttctatgcaagccaatcactttatggagcctgaaaaattcaagaattttaatgattcgaaatatctagttgaatggctggtaatcttctctcttatttggggaatcccaaagctaaagttgtacataaagaaagaatttaaacctttgaatatagaacaaatgatctacgaatctttattgttagcctagccataatattactatgaaattttcatagtgagggcataacatttagattttaggtcattaagacaattatcaatttctttttatctgaaccattacatatggaagaaaatgatgtaccttatttcattgcttggttaatatcagcctgtgaaagagaaagatattttcagaagagatacaaaatgacttaggttagttcccccatatttaggttgatagcaaagaaggcaggaaaaatatttttagaatgttaaagctgggacaaaagtgtatcgcaagtaatttgggtatcaaggggaaaaacattaaaaatctttgatagaaagtgaagaaaattattttaaaaatgagagtacttcttaacaaccaagattcaggaaaagtttgaatgaaaggaaatttaagacagttgttttgcattacattattatatctctcctttctctttgcctagctaatgttgtctaaaaaatagattgcattcaatcttgaaatatatatgtatacttccctatctacatctatctatatacacaacaacagacatttatcgatttatatatccatgtacatattaatcataacttaggaatgacaagataaacttgtttttcctaccacccagtgttttttaaaaaggcgttctctgttaatacagaataactgcaaataatattttcatgactatgtcatatgaataaaataggaattttaatcatttatgtatttacagtgagaatcattatgaatttatgattttacatttagctcatgattccaaggtgtgatatatatatatacatatatatatacatatatatgtatatatatatgtatatatatatatatatggaagttcaatgctttctgtaaactggaattttaagtgtatatctacacttgagaaaaataatggtcaagataagagaaaaatatatggaagttaaattctaatgcagtaaaaacccccctggaaacaaactgttacccctggtcaattactcacttgccaccatagatttttaggagagattcgcaatatgggaaagcacagtgagtggtttacctccataaaacagctcatcatcaacgtgaactcgtatttaaatctgaattaccagcatctgaatttttcagcatgaggcagcaaaagattgaaaagcagtgttttctgatattgctctaaattatgatttccatagatataacctttatcatttcttctccataccggaaaaataaaaaccggttaaggtaaccccactgcattcttttcttctgcttgttgtacacttcacagtcacagagtgaatcagctttgctaaacgcattcattagtgcccaatttgtttctcttcatctctttgaagaaatcttgcaagctgttggaacgcttattttattttgattccacagtggaaaattgtattcacataagtaagcatataccaaacagcaataaatcattatttctcagatgaccaatatcagcaggaatctcatatacttctctgctggagttgatttccaaattcattgaataattattggtgctgcttttcataagtgaaaaacattttttcctttctattccagttaacttttaaatgctacctttctccctcatttccaccgcacatctgagaattatttgtaaaggagggaaaaagtcaaactttgtattcagcaaatgtcaaggtggttagatggaatataacccttgacaactgccccaccagccctgaaatttagacgttcatagtatgtactttggtcaaagattgaatatcatgttagactgttgataaatgaaataaatacacgttattgctttaatgttttaaggaaaatctgagaatttattagagtgctttaaaatgcaacatttagactagtaaatttctgttttcttttgctctgccaaaagacaacaatttattgttgtttcacttcccaaagtattaattggattttggtaataaatattgaatttttttttttagtaacagacacatgcatttctgtattttttccttaacaaagtttattaacagcaggtaatctgtatactttgacctgaaaatgaatttataaaatatctgttggtgtcaagtccattttaatacagattaaatatcgtggccatgttctacaaagtgtgagttctctactcagtatatttttaatggcttctgtacacactgtattatgttaggtgttgttataaggaaacaaccaaaaaagattttaaaattaatttcagaacttagacttgagaagggtaacagtatcaggtggagattaagactaatatgtagattctttctgtttatgctgttactctttcaaagattattttcccctcttatgctttttattgctgttcttgatttttttgagctactaattgttagctaagttaaagcaatttaaaggatatatatttctaaattggtttttttctttgagttaaaacctgaacatagctaatacttgagcataaagtaatgtgacatttgtactattggtatcgtcctatcaagtatatagtctttctattaatctccacattgatcttttcctcctaaagtgaaaatatggtataaatatttacataattcaaaaaataatgataaactctaagaaacattttcgtgtaaaacatcattgttcacattatgatcttatctttttatgaggaaagcctcctaatctttaaattgatatatttacaaaaagcacaatatagttcagatctttgaaccatccagggtaagtcaatatgatatttttaataaaacggtatagatgtaactacaaaattatcaatgtaacatatctttgtattatcttgtgttgagatcctttagcttctacaaaaaaatttaatatgaaaatgagttttaattagcataataaacagcttacatttcagatatcctactacatcttaatataactcttattaaataagtatatattggaatcatattaattcattcagataattagggctgggcgcagtggctcacgcctgtaataccagcactttgggaggccgagatgggcaaatcatgaggtcaggagttcgagaccagcctggccaacatggagaaactccatctctactaaaaatacaaaaaattagctggatatggtggcaggtgcccgtactactcaggaggctgaggtaggagaatcgattgaacccgggaggcagaggttgcagtgagctgagatgtgctgctgcgctccagcctgggcaacagtgaaagactctatctcaaaaaaaaaaaaaaaaaaaaaaaaaagacaaataatttaataatataggaaaacatttttaaactagacaagacaaaatttttaatgtttattctcaaaatactcaaccaaattgttttcaaaataagtattttatatttcagatgtaatctcaaaaaatgaatttttattcaattatggagcttctgaacttcatacattcatttaaaaatcattaaaaatgattaagaagtccacaacacaatactctgtcttgtctgaattttatgtggatttagtataatgaaaactttagaagtatatgacaggacattaaattcatgactccatattaataaagtagctaaggcttaaaatattagaatatacagccataatatattattatttatggacagcatctattctcatgcaaagaaaatacacacgtagttcaaattctgtgagtttctttgaccttatggaaaagaagaaaattatagattcagatgtagattagttattgagttgaatatgtcaaattacccaactaccttcttgttcagaaattaacaaaatagcagatagaaccacttgactggagataacttatctagtagttgatgccaacgtagtggcaatatatatagcattccaatctagattttctatacctcatttatggatcacctgtttattttcttaagcaattctccaataagcagagtcattttctattgtacatcttatcagtagtttcatgggggggaaaggaataatgtaatcagagagatctggagaatactgtgtagtcaatgccttagatactgatatgatttagctgtgtccccacccaagtctcatcttgaactgtaactcccacaattcccacatgttgtaggaggaacctggtgggatgtgtttgaattatgggggcaagtctttcctacgctgttatcgtgatattgaatgagtctcacaagatctgatggtttaacaaggagaaacccgttttgcttgactctcattctctctattgcctgctgcgatgtaagatgtgcctttcaccttctgccatgattgtgagggctccccagcagtgtggaactgtgaatctaattaaacctctttcttttgtaaattacccactctgggggtatgtttttatcagcagcatgaaaatgaactaatacagaaaattggtaccagtagagtggggagctgctgaaaagatacctgaaaatatggaagcaactttggaactgggtaacaggcagaggctggaacagtttggagggttcagaagaagataaaaaaatgtgggaaagtttgggactccctagagacttgttgaatggctttgaccaaaatgctgataatgatatggacaataaaatccaggctgaggtggtctcagatggggatgaggaacttgttgggaagtggagcaaaggtgactcttgttatatttcagcaaagagattagcagcattttgcccctgccctagagatctgtggaactttgaacttgagagagatgagtcaggatacctggtagaagaaatttctttttctttttttttcttttttttttttttttttttgagacagagttttgctgtgtctcccaggctggagtgcagtggcaccatcttggctcactgtaacctctgcctgcctgggttcaagcgattctcctgcctcagcctcccgagtagctggggttacagttgcccaccaccacacccggctaatttttgtatttttagtagagacagggtttcaccgtgttggccaggctggtcttgcctcagcctcctgagtagctgggattacaggtgcctaccaccacacccagctaatttttgtatttttagtagagacaggattttcccacgttggccaggctggtctcgaactcctgacctcaagtgttccccccacctcagcctcccaaaattctgggattacaggtgtgaaccactggccagaagaaatttctaagcagcaaagcattcaagaggtaatttgggtgctgttaaaggtattcagtttcaaaagggagacagcaaaaaagtttggaaaatttgcagcctaataatgcgatagaaaagaaaatctcattttctgagaagaaattcaagctggctgctgaaatttgtataagtaacgaggagcctaatgttaatctccaaggcaacggggaaagtgtctccagggcatgtcagaggtcttcaaagcagcctgtcccatcacagacccagaggactaggagaaaatggtttcatggactgggcccagggttcccgtgctgtgtgtagtctagggacttggtgccctgtgtcccacccactgcagccatgactaaaaggggccaaggtgcatacagctcgggctcttccttcggagggtgaaagccttaagccttggcatcttccacgtggtgttgagcctgcaggtgcacagaagtcaagaattgaggtttgggaacctccgcctacatttcagaagatgtatggaaatgcctggatgcctagggaaaagtttgctgcaggggcgagccctcacggagaacctctgctagggcagtgtagaagggatatatggggttggagccccctcacagagtccctactggggcaccgcctagtgcagctgtgagaagagggccaccatcctccagaccccagaatggtagatccaccgacagcttgtactgtgtgcctggaaaagccagacactcaacaccagcccgtgagagcagccaggaggggggctataccctacaaagccacaggggtggagctgcccaagaccatgggaacccacctcttgcatcagcatgacctggatgcgagacttggaatcaaaggagatcattttggagctttaagatttgactgccctgccagatttcggacttgcataaggcccgtagccccttggttttggccaatgtcttccatttggaatggctgtatttatcgaatgcctgtacccccattgtatctaagaagtaactaacttgcttttgattttacatgctcataggcagaagggacttgcctcatctcagatgagactttggacttgtggacttttgagttaatgctgaaatgagttaagattttgggggactgttgggaagacatgattggttttggaatgtgaggacatgaaatttgggagtggccaggggctgaagatatggtttggctgtgtccccacccaaatctcatatggaattgtaactcccacaattcccccatgtcataggtagaacccggtgggaggtcattgaattacggctgcgggtctttcctgccctgttcttgtgatagtgaatgagtctcacgagatctgatgatttgaaaaggacaaacccatttctcttgattctcattctctcttgcctgctgtgatgtaagacatgcctttcaccttcagccatgattgtgaggcctccgcagccacgtggaactgggagtcgaattaaacctctttcttttgtaaattacctaatcttggatatcgttattagcagcatgaaaaccaactaatacagatacattgaagttctcagagttccaacagagaacacatctctttaacacagtgtctcccaaaatataatttaataatcattacttattaataatccacagaataatgcagtgtttgagattcctccatataaaatatagtctactatgaactatctgataatccaggttaatttgtaatctgctttcaatccatctttccgactttagtttcaccaggaagtctatactccatccaaaatgaactatgtacttttttccgcaaggatccaaaaagtgttcctctgatgtgcctttttttgcttatgttttcttcctctttatggaatgcctatcgcctctccctttttacttttccatgttcaaaaccaaaagtgcatgtaggcacttcacagacatatacacaaaacagtttacttacaaaatggtgttcttctaggtgttcagctttgcaatcaacatactaaatggagcttgaacaggctggagtgcagtggcgccatctcggctcactgcaagctctgcctcctgagttcacggtattctcctgcctcagcctcccaagtagctgggactacaggtgactgccaccacgcctggctaatttttttctttgtattttttagtagagacggggtttcacgctgttagccaggatggtctcgatctcctgacctcgtgattcgtccgccttggcctcccaaagtgctgggattataggcatgagccaccgcatctggcctgaacaaacatttttaatggtgtccgtgcaaagtgtatctaagtagtaatcatgtcaggtactgctatgaggaaaacaggtaagcgaagttttttgtttgatagtttgctttttgagacggaccttcgctcttgtcacccagactggagtgcaatggcacgatctcagctcactgcaacctccgcctccggagttcaagcacttctcctgcctcagcctcccgagtagctgggatgacaggcgcccaccaccacgctcggctagttttttgtatttttagtagaaacgcgtttcactatgttagccaggctagtctcaaactcctgacctcaggtgatccacccgcctcagcctctcaaagtgctgggattacaggcatgagccgccgcaccgggccgccaagtttttacacatatgccatgtgagagagttggtattgagtttttcaaaggaggcagaggtgatcaggttagttttaatggagagggtagggcctacatcatatcttgatgaaataatgtaggctgataactttttgcatatatgattagaagctttaaagtcattggacactgctctggatgggcagacttggaaaggagatggtttgctctgcagagatgctcaaccttttttggcttagatacatgaatggcgggttgcttcctaatacgtgatttgatgattgaacaactgttaagggcaccaaattcagtggtgtaaacatctcaaatcgaatcctgcctttgctcattgttacttaaccttcctaggctagtgtcttcctctgacaactagaataacaatgccaatatcttaaagtcaaagcatgaattaataatacactgcatgtattcatgcatggaccctaggatatatgcagtgtattattaattcatgcatgaatataatacactgcatataataataatgaattaacatgcacgaataatacaatgcacataataatacactttacataatagattggcatgtagtaactttctatatgtggatactgttatttacattatccttcttcatctgtttgctactcctcctctcagacaaagccaggaagaattctatggcattttatccatattcaccactttgaaagtcatgaagcattcttaacaacctatatattttatgaaaagaataaaattataaatcactaccgtggccacattttaaaagatataatattttatctatattgcattattgccaattcaaatttagttatataataaaggaattatataatttaaactgttgaccatctcttgtagctggaaaaatgtcctgttttacatggtagccctaacctttcccagattaccacagtctgatgttttcagacataattcatttgcagtaaatagattttatttttaaaatggtctatccagccctttatatgttataaccagatccagttttaatgagataactatagataatagggtcatattttcatgtctcttaaataatatattgagatcattctacttataacaatgtaatgaaaataaatgtttttttgttattgaatagaatttccataatacaatgagtttcctgagataaaagcttcaatgctaagtgaaatgtagaactaggacaatgatcctaatggagagatggctaatagtgttcatccaatgtgccaacttcagcccattggaaatggcttcctggatccccgcattgaaaaggattatgaagcataatctaggcttggaaacaaaatgtgtcacattggttattaatataggagctgaaaatgagggtcttctgtacatatcatttctgttcaaatgaaacatatatataatgtccataataactagagcatgaaaacaaagaagaaactagaatattttctattcaatattgtggtaaatattggacatcctgaaaataaaaaggcactatgtaatatgaatcctgggcaacctttgatccttcttttaattttcttttccttatgtcttctatcttcccagtctccccccatcctctcttctctttccttcttctgctctgtttctgggtctctttctctttcttttctcctttttccttccttcttctaactttttgtgcatctacagtgtgcttggatactaagccaggagcccaagtaagtcaacagtctgtggcagattagaaaggcagcgcagcactgtttggttgtatccaatcggtcatttgtaattagtcctgatcacatagaggactccagctggcttttcctgaccagcatatggatgttccaaactgctatttgctaacctcctccccaacttcccagcaagctaatgacccaggaggcagccatttcccaccccactcctagaggtaatggagagcaggctgcgttgaaaatgcctgcatgctcagccatgcatagaatctttctaggactgctctcattcatggagagttaattgtcctttgggtttcctaggtattaatctaatgtctacctgaatattaactcttttttcaagcccagctaaaggcaccttttgccataatactgagcatatgctaaaagtaatctttatataccagtttgaagggaggcaaagtgatattccaaggaaatttagcattaaccactggctgttacccatctctacattagccaaagctgataattttgtatcgtttggattccctcaattcttcatttttcaagtaaaattgctctataacgctattgataaatgtttttggaagtcactcatcaaatatcttgcatactttatcagcgtgtgcttcattaaatgtaatttgggtttattcaactgtttttctgcttttctatcagctgaaacccagaaatcctcttttatcatattcaatggggaaaatcaattgcaaagtaattttgcttcctatttcatctgcagataagttgctgttgctgatatgtagtcctgtggtatggtcttaaccctttctcttggatggaaatgagaggaagaaaaattacctcccgctttcatacgtatgttgatgaagggctgaagaagtctttctctacttcataataattttatttttctccttttggaaatgagtttatgtgcttctcttgcgatgatgggtaaggcagtgtagaatatcttctcttggaaggatgtgcaactatagagaagggtcacagctggagcatcccttgctgagtttgcctagaatctggtgtcttctttgccacctacttggcatgtgttcttgggtaaaccccctaagctttctgggcctcgggtttttgctttaaaaatttgtttatgccaaagaaaagaagagaaattttaaaaagaaaagaaaagaaatgcattcttctttttaaaattaggatgttgttgaactattttctccaccatgaaatcttgcatttgaaaacccaggccccttcctcccctttcaatgggaaattattttaataaatttttatcattctttgactcttttttcattcagtgatattttctgagatctgttcttatcatgttgacacataactagatttgattacttttaactgtttctagcattacattacataaatgaatattttattcaaccagttactattcatactattatttgcaatatgtctttattatacaaaatgctgtgataaacattcttgcacatgtgtgtgagtgggctctctaaacccataactagaaatggattctagattatagaacagtttttaatgtttatatatattgcccaattcccttctaagtagtaatatcactcaagttcccaccagcagcctaggaaatgtccatttcccatgatcttaccaacacttgatattgttgataggaaagttgaacttttcttgccaattttatcagaaaaaaaaaatccttttaactagtatttcttatttccatttttatttaaatatataaagtggggaaattaacttttctaataaaaataatgaaaattgattttaaaaagagcttaaaatttattagagatttaagagttctctgaagcatttttcagaaatagcattgtttgcctgtgtcatggaattattcattcagtaggttaaaaaattgcataatatggtcaaattttcagtgagagctctcactcctaacatccttagtgcaaggggtctgctatttatgtgaccgttcctgttgaatttatcatgggtcagttatgaaaacacaggaaccctgctccaattattcagaagtcattgacttggagttgctcaatttgcttatacaggaaagagttgttaaacattatcctttctgggctaaaaatgaagttgcagtgtgtacagaagtttgccaatgcacaaaaggtcacactgattgatgggctttgaaaattggccatttatgtcaagaaggagatgatgataaggtttattattctgtgaaagtcttccaagtggtgaggacatgtcaatagcacaactttttctccttttgctttatcctttgaaataatgagtcatgaaaccagagagttggcatgcagtatggccggcttcctcatgcacttcataatgctgatctagtagtggttggcaaattagtgctcgggtaccaaatccagcttcaagcctgtttttgtagataaagttttattagaacaaattaagaaaatcccattcgtttatgtattgtctatgctttcttgtcccacaaagacagagttgaaaagttctaacagaccatctgatgctaaacttagaatttttactctctggccctttgcagaaaagggttactgatccctggtggaacctgccgtagacttcatttgaaagtttgattgttaatagctatgtgaattctgtgcttttattaccttgaaacatttaaagaacttttagtaattctcttagcagatggattataattgttggaagcttataatgaaattctaagtttataaaatatttttgtttgtcctaaaagaggtgaggataatagtataagtacttctgaaatatgttttgcctcacagtaaacattaatttaaaccatgtattttgtttcctatgttttctaatttattattaaaataatgtcacctttaacttgaaaacaggggacttattttacacagtaactctttaacttttaaaattaaaaaagacagttaaattatggtttatggatttttgtagtgtttaatttaatggtaagaaatctgtcttatgattacgcaaaacatctgtttttttatcccagtaagttaattcattaagttcaaaaagtcttacttaaaatagccctaaaatattagcatattcattggcacataaatgtttaataattatattttatatttccttaatttgtagtgactattattatggtggtagataagtaagatagtctccagagattctactgattcaagaaaatactacgagcctcatattttaatagcatgtctttgtcataaagaagaaccaccatcaaagtcttgagaaacacaatattaactttcttttatatttctacacttccaatatccagtagatatgtctcaaagtcatacacatttgcttatgcacacatgcacacatacacatacacacacacacacacacacacaatccttaattctgccatgacaaaaattacattggtgactttcacatgtaacaaatgaacaagctgttaactaagaaaattcagacatttggggacaactaaaagtcagtataaaactaatgaattgctggaaggcaaatcagaaattactgttggcaaatatctaaaataagaacagaaataatcacacctgaaacaaactcaagttgaaagatgcatccctacttatacttcacgtagagaaagaacctatagaagtaggttactgatcctacaatgaataaaaccagattcctcttccaaaacttgttgcaattcaccaattcattagtttttactatattgtttgtagtaattttatgctagtaagagtttatgctgaaccaggaatatgatgggaatctgtgtcttttctaatctgtagcctacgtacctggcactgggtaaaagctcagtaaacttttgcaataaatgagcattggggcaagtattaaaacagattattatactgaaaatacgattctaggaaacggcccccaagcaagtgtgatcaaactcagtacagacactttattatacacattttctcatcacttacacatcaaagtgatcacaggttctaagtctgtgagcctgttttcccatttggaagaataagtacaataatgttacctatttgctagggttgatttgagcattaagagttattatatattaagcacttagaaaagcctggtatgtagcaaatagctcaatattacctgcttgtaatagtagtagcacttgtagtggtagtagtattgatagtagtagtatccaaaagcatcttttgatatccctacatttccccatttaatgtgtaaataaataataccaatattagcaaatgcattgtctagagcattcatcatcagagataagtgtaagccaatcatgtttgttcattccgaagatacttactatatgtcaggcttattataaaccatatgattatatatatatatatatatatatatagagagagagagagagagagagagagagagagagtgtcaggtgttgtcttgttgttgggcaggtagattggagatgagtaaagctcttgtcctgcccttgatgtgcatgcagcccaggaagggaaacattatgtaagcaagtaatttcaaagccgcatagcaattttatccaatgcaaagttatagactatgagaagtcagcagcaaataactaaaaattgttttaaatggaacttgtacatacattttatcctcccaataaccctacaatatcagtctcacctatgagaaagctaaaaggttgagtcacaaccctagaatatcctataggcagtgtaaaaaaggcaggattgaaccaggtcttaagagtccacagcctgtggttttccagcccctctgccattgcttgtctgggagatggaaagttttggctgggacatccctcactcaatggtgtaactgcccaaaccgtccctggtctggacgccacaaatggagcagaaagagaaagggagagaagccatttcattgtaggactcttgaccacagtctgttcagtctggcctggtttcttcttggtgcttatgtacgtgctaattgccatggctaaatggtgtcattgtggataataatgctgtgatgaaatgtttaatctcccctagggtttggtggacattttcagctgctgatctagtgataagctgggcaatgggagggaagctactccacttcaaaaattatcttcttgtttccgggtaatcacttgttggcaaatatattaaataaagactgatatttaaataaaagtgctttgaactgggataaaatatttatacacagtttgaatttagtgttttgtcaaaggtttttctcctcctggactctgaaaggcgagtgaacactgaaagactgtctctctcatctctcacctattgatgagatccatccagaccaggctgaaaaatcttgtgatcagtgcatgtaagcattccctcctggtcctctacctctaaagcctggaagagatctacacatacaaatagtggcccagcaccccattttctctgtttggcattgattaaatcactccttcatctagtttggaaagtttatcatctaaagctgtatccacacatttcttgggccagttacactgttaatttcttataccattctaatatgtgacttggaactgatccgttgctgtgtataagaagtccagaaaactaccttcactttgttttattcttagtttgcctgaactgttacccataacattttatccccaacatattttgttatgaataccttcaaacatgcaataaagttgtaaaagttatggagtaaacctatcaacttttttggggggggggatttgtacccatgtgatgtctaacttttgtgacttagctagtgtcttaattttttactcaccccatctcagtttttgaaacacgcacacacacacacacacacacacacacacacacagacatacatacagatactttctaggtattagttatgggttgagtatcctttatttgaaatgcttggagccggaagtttttcagattttttataatttttagattttagaatatttgtataataccagttgaacatctcaaatccaaaaatccaaaactcgaaatgctccaaatgagggttcctttgagcatcatgtggtgcttaagaagttttggaattggaagcatttcacattggggttttcagatttggaatgttccaaactgtataacaaatgactgagtgtgtggaatttatattgtactatacctggatctaaagcttctgtgtgcctctaggttagcctcagagcctccctcagcctcaatttctatcctatgaaatacagatagcaaatcccattctaaagattattgtttgaattaaataaagcaacatgtgctaagaatctggcacaaaccctggccctagccctggcacttaataaatagtagctgttttaaattattactatatgatgtgtacttggttatttaaatatgttaaaagtacatttaaattattctacattaatgtgtattaaaatagtttggacctgggttttgttcgtttgtttctctttgcttgtttggtttttcttttccgtagagaatttaacaattttacttgatccttgaagaactactgagttgttacaactttgacttgggtgaggatctcttacgtgaggctcagccagtaaagttttatttccagtaaaaggggccaaggagtgctttgcaaacctgaagagtaacacctgaccccattcataccacatggaactgcttccccctggaaattctgggctttctcccaaatgcttcatttgaaggtgaatgccttgtgaaaaatgccacatatgtgcctctctctctactaaacagttaatgtagaataccagaaaagatcccctgcccatgctgtctttcttaatgaatggtgacaatgcactaatttaagtacaattggcccagcatctctcattgtgacagaggcgtttccaccgaggaaagtggcaagggtactctgagattgtgggcttgtccagggctgagtttgatttatgaaatgagacctaggagcctggattgaacagattggcttgcaagagacagctgtactggaggagctgctgccaggtatgggtagtggaaatagagaaaaatgaacagtgggataaaaattcctttcccagtccctacttatcaacatgaaacatctgcttcagctacagtggttcccagtggcagtcagaattattgatatggcaaaatcgctgcttatatgcagcacaatggcatgtccccccacccctactggctgcattgtaataattcattactgtaccagtgcgaccaaagacaccatggatgtgaaaggggagttagtgccagggcaattgtgcaaatggtgagggtggtggaagaaagttttcaccacgagcaataaatttctgcctgctgttctattttattgtggctcgacacagtgattatactggttggaaaataagcaataagcgtctgtctgtctccagttgtttttaatattcttgtttaatgggagaacatagcttttatttaaactaaacataacggatgcattttaagatttggatcggtttttgaaaaaaaagtatcttgctatctcgtatgttaggtaagcatatgctgctataaataggaaaacaaatatgcttagttcagctttttgttagataaaatttgattagggatgtgcaaaagctgatgctgtcagccaacacatagcaccaggaagcaatacatactatgttagaatgaaaattaaatgcatttattaccagggaaactggttttgcaggaacgtaccgagaaagtttacatgctcaaataaataggaactcgaattccttaatttcagtaatatcactttataatgcatgctggtaaacttgtgtatgagtttccatggtggctgaaggatgattagaaaaagatttgctaagccaagttcttgtggttcttaacctattctaagaagcggggcaatgcaaaaatataaaggaaaaacaagagcccacacctgtaaagatactttactttcatatgtgtccttactgtttttaacctataaaggaattttagttgtgccttcttatctctgtgataaggcatttatttgtttctaaatgttgacagtaaaaaaaaaaaattggtatgcaaaaatagaaacttttaaattaattttccaaataaaattgtaatgtggccaatttagatgtaaaagctaaagcttgtaggcaagtgtgatatttccttgctgcttttcctgcggtacttagcactagtccttgggatgaaaaaaatattgtttgatgtttcagacaacaatgaaatgaagcattggcaaattaataagcagatcttacctgacagcctggtcactgaagaggttaacacactccagtgctgacaacatgataatgaggatttatggtgagcaggaggtgaaggtgggtgggatgcttccaggctcccatgtgcggtggctccagccccctgcagacataacgcctcaacaagagtgaaggttaccttctggactgtaacaatggctgagctatgtttgtggcagagtgtgcataccctaaagatatgcagatagatagatagatagatagatagatagatagatagatagatagatagatagatagataaagacagtttttaaaataattgtagtcttttatagtttggtgctttctaatttcacatgtatactgagtgaaaacagaattttataatgaaaagaaaagaaatggggccaggtgcagtggctcatgcctgtaatcccagcactttgggaggccaaggtgggtggatcacctaaggccaggagttcaagaccagtctcaccaatacagtgaagccctgtctctactaaaaatacaaaaatgagccatgcatagtggcgcgtacctttaatcccagctactcaggaggctgaggcaggagaatcgcttgaacctgcgaggcggaggttgcagtgagctgagatcccgccattgcactccagcctgggcaaccagggtgaaactctgactcaaagaaaaaagaaaaaaggaaatgaagcattccctttgttgaatataaggtatacagttggtgggtggatggatgaatgcgtggctagatggatggatggatggatgatgggaaattagtttacataacttttaaatatctttatattctttcccctgtctactgttctaattttaaatattatctctcttcttttttctctctatttaaaaactacttttattttcctcaaaaaatgcatgctcattttttgttcaagggtcttggtacctgctttcccctatgactggaacattgttccctggattttcataagacatgttttgatagcccttgagtagacagttcaaagtctcttccacaatgtcagtatcccttaacacatgcagtcatatttcccttattgtttattatttccagaacatatttgtttgtctgttaatgacctctctccttctagaatataagccccataagaacaacgactttgtctaatttctcgttatttcacttgcaccaagaactgtatctcttatttgatgctcagtaaatatttcttgaattcatggtgggtatatatagaaagtaaaactctataagcttattctttgacttttttatatatgtctaccttatatttgaggtccatggatggttctaagttagttaatatttaaaaataatgaatggagggaggattagaaaaaaaagcaagtataatacttctagggccccaaatgatctcagctcacaaggaagcctcaggtttaaatcagcatgtatgttctcaactttcccctcattctcagtcagcattagctcagtttagttttcatgactttcactctgtgctacattagataccttactgggtggtatgacttattagtcaaaagctaaggatgtttctctgtgggatattactattaatatcacatcatatttcactgttctgactctttaatgtgttgatatccgttgttaatatgatattttgcaagactgtacagtctcttatttttttatcataaaaatcattatttcaaaaattgttataactgttacctttgtattacaaaatgaatcactaaactgtttcgtaaaatgtatttccacttctgtacaggatgtccattaaataatgaagatgtacttggtaacagaagtatttatctgcacactctaaattcaagctagttctgttttccctgaggaggcaagttggtgtgccgtttctcatatttaagcgacgatatcttgaccccaagattgtcagagcctccccacaggactccgccatgagattactcagaaggagcctgtaatgagccctctgcacacaccacatggtttcaattacagttttatatgactagacagtgtggtgctgggaaggagcgattgaaaacgatgcaaagggtctttgtcttcgtgcttcagttacctgggcctctgctttcagaatgttcttctacttaatattattcagatttatcttatctgggtgaaggaccagtttctgaagttagggattctgtgttgaaataagagaaacagaaaagaatagtccaggccgcattcctaatcttgtcatgctattcccctttagttttcacacttgtccgagacctctgggatgacgttttctatctcaagggtgctttcaggagcagatgccctatagcaactgattttttttttttttcttgagacggagtctcgctctgtcacccaggctggagtgcagtggcgcgacctgggctcactgcaagctccgcctcccgggttcatgccattcttctgcctccgcctcccaagtagctgggactacaggtgcctgccaccacgcccggctaattttttcgtatttttagtagagacagggtttcacagtgttagccagaatggtctcaatctcctgaccttgtgatccaccctcctcggcctcccaaagtgctgggattacaggcatgagccaccgcgtctggcagcaactgattttttaaaaaggtggtggtgagtgaaagtttcctcaaaattgggggagaaaggtgatggagttttctataacttaaaaagaactatatcagagcataaaacattgcctacatagttctttgtagataaataatagtgacttattaaaaaaataaagtttagacttaagaaacgatctaatagaattggaaatattggctcaaatcagctatgtacttgcttctggcttctgagtggggtgacggacaacttatttcaacatttcctgaaaagctgactctttacaaatgtatgtttattgaatgttagagatgagtgtggtcctagactggaaggttccgtgggaggagggtctgttatggctctcttgtcttctctcactagtgcattatacgcaagtcagggatatagttgtcagactcatgagtaaagaaatgcccaactttacctcttctcttatggttgggaacagaagtccagaggaaagatgtgggtttcccagggcgacagccagtttgtggctaagagaagcctagaatccaaggatgccatagttttccattgcatcagtgacaattgttatgtgatgaaagtgcagtgttctgagaattggaaaggagaactgaatgtatgtctttctcaaaatggccttcctgggttactgagaacaagaatgcatggttgtttctagtttaacacctcttttatgacattcaatcagattcactaataacgagctcagattcttattaacacacaccgggaattgaacaatgagaccacttggacacaggaaggggaacatcacacaccgtggcctgttgtggggtagggggagcggggagggatagcattaggagatatacctaatgtaaatgacaagttaatgggtgcagcacaccaacatggcacatgtatacatatgtaacaaacttgcacgttgtacacatgtaccctagaacttaaagtatgatttatatatatatatatatatatatatatatatttaaaaaaaaaaacactggtatggcagctgtagacatgtaaatgaattcctgtagctgagtgggtagttgaatgagaaggtgaagtttttgacagcatgtcagatttccatggatgaagagagagagcacaagaaaagtggggtgagaaatagaaaacagcccagagagagaacctgacaatatattgtaactgcctttggaagcttcagttccttacataactgagtaaaatagaaaataggaacaacaggttaaatacttttttaaatggagtttttaaagctttccagttcatgtagagactcaaaaattctctttctaatgcatttgttttgttgaaatggcccaatttttatctaagaaaacacatcttccaccaatctgtcatctcctctaattgaagaaagaaatggttaagcatgcccagtcactattgtttgagtaaaaaagacttacttgtccctttcccgggataggaagacatcacattgtgaacatctgtgaatctcattatcaaaataaaagacaggaaacttgtgaatgattgtatcatccactggttgtgtgactttggacaaatcatattgcaccttttcttgactcagtttcttcatttttaagaaaagccattaaattagagactttccaaggtttcttttacctcttttgtcctcatttagttcatagtccagggagagaacaggctctagagttcaaatttgtcccaattcaagatcaaaagaatggataatgtagggactaggcccatgaactgtaaattgagccaatgtgtaaacatcaactcagttaaaacatccactcatctcaacattcgattttcttctgtggttattttggcatgcaggaattcagattcattttggaatatttgctaggtgcatcacactctaacaaattactagcatgttttaaagtcttcctgcattcctgtctataatggttttaagctttataattttccatctcttcactacttagggacatgggtaatcaatgaaaatgtgtatttcaagaatacgcatgtcccccagattatagtttatcaaaatcacttttgaatcattccaattgaattttcacttcttgtaaatcatcagtgcccataatcatattatggggtcacaggagatcaccaagaaaggtatattaaaggcatgacagaggagtagcacaatgcccttgaatcattcctcagtaatataagaacagaatttgttcttggaaagctggtgagggtgggaacattttctttcctttccaacaggcatatactgctcattctcaaatctgtattgctgtactagtcaggatgtttactgtttaaaatgagaagaacagcagctcaaatgatcataggcatgaaagggaatttgttggcttatgtaattaagaagatcaaggggtcaatatggatggcttcaggcatggcttaaaacagagttaaaaaaataatggcactagaaataactgtgtgtgtgtgtgtgtgtgtgtgcatgtgcacacgtgtgtatgtgtctgtatttctcatctctgtgtgtgtgcatgcacacccacacatatttatgtgtgtgtctgtatttctttgtgtgtatgtgtgcacatgcatgtgtatgtgtgtgtgtctgtatttctgtctttctctctctcctcgccctgccccatctctttcccatccactcaaccgttggttctattttcctctatattaccttttcttccaggttgacctttctcaggagctttggctaacagttacatcagatctgtattctaccatatttcccacaaaagtccagggactcctacgggcttggtttcagggactattcacctctgaatcactatggctatgatgatccaagcctgagttacatgtccatgatgaaagcctgtgatggagttgtcctctcccaaatgatgttgactaaaccagggcaagggatgcttcttcaaggggaagtgaaatgctgttaccagaaataagggagagagtagtgaaagaatgcatatcctccccaaaaaagagaatttattcttttggcccacagtgttgtgaagcaaatcaatatatgatcaagaattaatccatagattcctttctgatcttaccaatgttcaaatttatctgttcttcctgtcttcatgccatgcttccaagtgttgtgtagactcattaatgtttaattctttattttgagaagcaggaggaattccttcttatatggagtttcttgttcaccgagtgaacactagaacaataaaatacctaaatagtcaaacaacaaatatacagttcatcatttggattttgttctgagctttgaaatgaaaatgcagctcttctttgaaacaggtatctcatgtcaatccaaataaaatatcgaatttcctgaaaaagattgtatgatgaaatgcttcatttctaggagtcattggcctggattatccccttgttgttgatgtatgtgtagttttttttttttttcaaatgtatctcctgggaacattaaaataaaacatttcattatccatcttcttttttattttttttccaagtgatgtctctgccagatagggaatgcatgtaattcactgttgcttttaatttgtcagtacattaattttagttgataaataagttaactgaatatgctgtcccagttatctttgatcattcaagttcatttggctcttgcttttaaaggctattctgtgcctccccaattctccttgggtttatatagcttttaagttgtcattgaccaagagaccgttcaagggtgattatagttttcaagcttgtttgtatgcaacagccacgaccttttttcaaaagacacccagctgctcttagctgcaccttgacctccaacagacatttattacaaatcaatttcatagattgtccatataataatctagagtgtctctggtagcaagatgatgagagggcaccaatttattgtccttatgaggttcaaaagagcaacaaaatcatgaattttgaatgaattttgagaggtcttactaattttttcactttgactatccttaagagggactatcatgctctaaattttagagacaacgtctctaatagattctaccatgaagtctaggtagaaagggatagaggtgttcactcttggttaatgactctaaaaaatctcaaaactggcagtatggaacaggacacatccttggaagagatgacccactgtgtccagttacttatttacactccagtcaataggaaccccaaaccactttgagcattctggggaggaagaggagaacttaatattttacattacttaattttattccataggtagttaatgatctttatgttttattctatagcaggaatttacatgtagttggtatctaataagcactgatgaatcaaattgaacttaatccaacctctaattcttttccaagcaaaaataattatctttactaagtccatttcttgttgctatgaatacacacacacacacacatctggtttttaaatgtactatgcctttattccagaggttttactgtgtattttagtaaaaacatcattttcagacaaaatgtagactagctagaggtaactgtgcttcaaagaatttatccactaggatattaatttccatttcagagtatttctttttacacaagatggatgttctgctttcaatttattagctacataaatgagcttatctatttctaatttcgacttaatataaaaagcatcaaattttagttttcatccatctaattttcattttgtatatttatttgtggtaagctgattttggtttatgccatctgttcatcaggttcaggcagataatattaaaagtatatgttctccaatatgtgaatatccacattcataagtcatgctgcagctccgaaaagcgctgtggttgatttaggctgctctctgggagaatgatgttaccacagctaaatacaagcgtgagaatttctcagtccactctgctgtttccagtcgtggtttgaagcagatggcttcttctcaccggcctttcttaccttagacaaaaatgtaaaaattattttgatggcttctttcctccttagcctcagagccatcttggaacattctctcctctctcctttgatatctctatcagtcccctctaaaatcataagaaagtagaaagcctcagttacattaggaggtgatttagttagtagaccaatcattctaaaacatatggaatcatattgcaaaaccttataagagttagataatttaagttcactgacctgctttttattttattttattttattttattttattttattttattttattttattttattttattttatttttagacagtttcgctcttgttgcccaggctggagtgcaatggcgcaatctcagctcaccgcaacctccacctcccgggttcaagcgattctcctgccttgagtagctcctgcctccctagtagctgggattacatgggtggcatgcgccaccatgcccgggtaattttgtatttttagtagagatggggtttctccatgttggtcaggctggtctcgaactcccaacctcaggtgatctgcccactcggcctcccaaagtgctgggattacaggcatgagctaccacgcccgaccagccttctgcttttaaagtctcttctctgtctccccaaacctatgcaaaatgacaaagtacttcttgaaagaacccactctccagcaactttgaaaacaatctattttataccatacacaccaaaacaatgacaacatttctgttctttttctggtaagtaaataaacatttgcctcagagactttaatctgagttagtgtaacatcccattcctaagtcattgagagagtttttactttccaggaatcttttaagcaaaatatttaccaaacatgcatatgccaataactacaagcattttcaaatgcagtcatttgggaaaaagagaggcagctaaggcaacttgatttttttttaatacgacattttactaattgtcttagacttggtgatatagctagtttttcaggtcagagaagtcagtgttgctcttttggaatggttctttacattcccaaacttttaaattatttaaaaataaacattgttatacacaataaataagaaactaaaactggtaatttttatcatttgtttaaggtcagtcaacattttcagtgccaggcacggtggctcacgcctgtaatcccagcactttgggaggccgagacaggtggatcacctgagatcaggagttcgagaccagcttgggcaacatggtgaaaccctgtctctactaaaaatacaaaaattagctgggtgtggtggcacgtgcctgtgatcccagctactcaggagtctgaggcaagagaatcccttgaacccgggaggcacaggttgcagtgaactgagatcatgcaactgcactccagcctaggcgacaaagcaagactccgtctcaaaaaaacaaaaaaaaaaaaaaaaaaaaaagacatttttggttataatgctgagtgatttcaaaatgtcaaacaagtgaaaaggatttttatggccatatctaagaaagtaaagctgacgtcatgcatagaaaactacatctcaacagaattttattagtagtaaaaacactgataataacaaaatacaacactaacaacatgcttattatttgccagacagttttctaactgctttattatataaacacattttatccttacaacacctctatgaagaaaatactattattatcctcgattcactgatgagaaaaagaagtcacagacagtttaaataactgatccaaagtagcacactgtgggtgaaagctggagccaggatccaaaagcaggcaatctagttccagaatccgtcttcttatctgctatgaaatactgtttgcattaaaaataacaagtgcattcaagttcaagtccaattttctttctttttaattatggtaaaacacataacataaaatctaccatcttaactatttttaggggttcagtagtgttaggtacagtcacattgttgtgccactgtcaccaccatgcatctccaggattctttccatcttgaaaaacaagcccttcacccatcgaacaataactgccctatttcccccttcccataccatctggaaaccattgtctgctttttgtttctatgaatttaactcttcaggtaccttatgtaaagggaatcctacgatatctgttgttttgggtctggtttatttcactgagcatgatgttctcaaggttcatctgggttgtagcacatgccaggatttccttccttttgaaggctgaagaacatcccactgtaggtataaactgcagttagtttcttgattcatctgttactgaacacctgagttgcttctttctacctcttggctactgtgaataatgctgctatgtacatggttgtataaatatctctctcatactctatattcaatcctttggggtatatacccccaaatgggattaccagaccatatgttatcagtgaattgaggataataatatgtttaattttttaaggaatcgtcatactattttccatactgatcataccattttccatacccatcaacagtgcataagcatgccaatatctccacatacacaccaacacctgttattttctttatttaaaattttctttaaagtagccatcccaatgggtgtgcagtgacaaattttcttttgtaatcagccatgtaaactgtaatacacacattgaaaacataaccaatgtgacccataagtaaatttcctaaatatttgcttacttcttatttacagtttgcaaatctctcataaactagataggtcctcagaccattctgcatttccttgtatataaagataaacacacacacacacacacacacacgcacacacacacacaacacacactcaaacgcatatatatatacaaacatcaaataaacttttgtgtcttttatgaaaaatacgacacattgagtggaaggatcatatatttcctcttccatttctaaagcatttcaattttgaaagagcaatagagatacaccctctcacatctgagtttagaatactgaggtccagataggttaagtaattggtcccaagttgaaaatttagttagagccacatctagcctgaaatttttcccaatgcagcagcccatccaatctctaaagcgcatcatccaatgtttgtaatacattatgtttatgatatcttaaatgtatagcattatgtattacattatagatattaataaaatactattggtttaaaaccattttcataccccacatagaattccaatataagccatctcccactatttttccagctataccatttgttttaggtagactggctttaatattttgaattgagatggggattcagcttaaaaactgtgaagggttcttttaaaattttatttgcactgaagatgctgagtgtgaaagacgtaagttcatctctctctaactctccatagttcttaacatagagatgatgaccctgacatgtcactgatatttttagaaataatggcaaaacgtcttttttttttttctcccttctgctgaatataccacagacaaccacagttcattgggctggagagtttcagctgtataactaaaaataaatgcctctgtaaaacaccaacaaagacaatgtcagtttccctaaaccactgaaaaatgtgctttaaaaaatcaactgaatttcagttgggtaaatgtctactccatttgcctccgggctgggcttttaagggactccttttattttaatcccttttgtttttcagatttatcacttaaggattgtatgattggtgcaactcatactattaaaatgaactgcagttgctgatctactcacaaagaaatgaaattgtaaactccactttggtttcaaaccacaaataagcgactaataaattagcacaaggcatcttttgataggaggagagcctaaactgaatgtaatttttagtagtaaaacatgggactcactatagcgccatagtactattttaagcattatgcgtcaatattggttttttgaggttttgttttgatggaaaaggtttaaagttattttgttcatattcatatatactgtggtgtttttaaatattaagatatatagaaacccagaaagttgagctcttttttttttttaactttcttttttagggcacttgaaatttcttcagggatacaattgctcttttcacacatttagaagagaataaaagagagagaataactcttttcctttatagaagccacattataattcattccttgtggtccatgtactagatggcctcaagagacagctccattccaggaggctcttctagcacttagtgcacagcccccaccctgactttgaagactcacagcaaagcctactgaagtcactgttgatggagaatggtctgacactgtgatgccaacgtgctggttacctcccggcagtctttcatagatatttaatgtttataagagatattatactgtcccgaacttgggttatttagcaacatatctacatagatggacactcagtaaagctttataaataaacagtgcccttctcttgcatgtatcttaattctgtcctaagcacaatattctaaaatcagcaaccaaggctctatgtcaaataaataaacatatggcataaaacataagcaaatgcatcactattgtagagtataaatttaactatttctggtaacatgattctaatttatatatattttgtttgcttgtttcacctaaaagttaatattcttgctaattttaggtaactattgcttgttgatcatattagtggtttacagtatatgtgatactaatttaatctcaacagatttgagggattaatggtttgtgagaaacataatggttgtaagatagagatgggaataaatcgcatcactcaaaatcagtgcatcttcaagagacagattgacaatgaagtttaagagccaattgattgatcagttttacatgcacatacatacatacatgcatacatacatacacacatgcacaaacctcttccttaaattttcttcagactaatgcattctgaaacgggagagttccctgacccccaccccccccccccattgcaggacatgcaacaggggtataacttgtctgtttggctgttgtgcactcaaaccccttacaggagggggagcatgcagacaggtaggtgcaggagccagggcaagtgattttgggctctggccccatggtagcatctacaggtgggtgcctgtgacatctgaagccccagtgggcatgttacagtgctcttttagctcttctgttcacagacggtttaagtgttaaccagctcagtgccctcttggtacttgggttcttgtccagcgtccaggaagaatcaggtcacacggacatactaaaggatggtgaatgtggggaatattattgcattgccaatggagatgactttcagccacgactgggatggatggggagctggaaaggggatggagtgggaatatgatcttcccatggccaatctcttctccaactgtccccagcagaactcctctcaaagttcagacattccttctctactgtccttctctgctgcaccactctgctgctcttctgctcttccgttcatctgcttgtggagccttgggtttggggtttatatgggtacagggactgtggcgcgtagagggccaaaaggcaacatttgagcacaaaaacaggaaggcctgttctcatttagagctgccagtttccaggctggagggtggagcgtttgctggagaaccgccttcttctaccaagtatttccgtttcctgtctttatcaattctatagggcactgaagtaaatgacaaatgcaatgaactctatagtcttcaatgagccaaaagcataacagttactagttgtaacattcaagaggatattggatgctttttctcctttttctataccgtaaggtgctactctttcatggaaatgtaagtagagataaaaatgtaaatagagatgtttataaggcatataaacatattatatttcctagttcagtatctacagattgagacttaagtttcaaaacagtgaacaataattctgtctttttcagtatcagtgtcataaattgccaatataaccatgtatgaatgactactgataatagtcattagactagtctaatgtcataaagatggcaaatggcagaaccagaattccaacccaaggttattatttcattctggaccatcttcgtcagatggtttgtgaccattgtcagttggctagtaattgcccatagaagagtatttaccccacagtaactgacttgtactcaaaaacaagttatgtcttttcagcaattatgtgtatgtgagtattttttgaatactagaagatatttattttattttatttttttttgaggcagagtttcacttttgttgcccaggctggagtgtaatggtgcaatcttggctcagtgcaacctccacctcctgggttcaagcgattctcctgcctcagcctcccgagtagctgggattatgggcatgcaccatcatgcccagctaatgtttgtatttttagtagagaaggggtttcaccatggccaggcttgtcttgaactcctggcctcaggcgatctgcctgcttcggccccccagactgttgggattacaggcatgagccactgcgcccagccgaagatatttaatgttatacatgggatattagttttatttaaactttgcaagagtgttagttgtttagtttgtttcttaactattagaaggtttcctttcatagaaggaaaaatttgaagtttgaatttagaatgtttgctgtgctgatgaggaattgggcaggtgcatgagagctctgagtttgagtctcactgaaatcttaggtgggaggatgaagatcgctgtgtataaatttccagagagatgctccaattcactgctgaataaatgggaaccagagctgcctcaggggacttaatgacaatttctcatcttcattgattgtgtcagatttaattgctgactcagaggaaatatttgttcttaggagacttgctgcctatcaggaatgagttgaagagttctagccctgaggaaaagtttatgtgagctgaagaaaagatgctttagagagagagagagagagaatgtgcattgttttcttttcttttttcaccctctctcataaagggagtagggcaatgttaagcaggtaaaccctaataccatctacaacctcgtattaccatagagtatatcttcgacaagtatatagatagcctctttgtacagatgagtaataaagaaattcacatctgttgtaatctaatcatctatctggatacacagtttttataacaggaaggggcaaaaagtaaaatcccttaatgatgaattgctgatgtgagcctgtatcacgaataccatattaggtttttctttttaatgtttcttgctatttagtattacttatagaagtctttgaattttcattataacattaagggtgaagagctataaatgcactcacctcagcaaagaaaaccaaaatatttataaatttattttcagaaattaaagacagaaccctggaactgcacaacaggcctgactgtattaacttataggagattatggtaaatttctattgtaggaaataattggatattgtttcagctttcaaatctgtttcattagtattagcaagagattaatttctctctaagtaaattttctgaaaaaaagcacttcactatgcatttgttgaaaatgtgctgaactattccaatttaattgagataatcagcatgcatagtatgtacagttaaatctaacttatggtccataacttttccaataaagtgtctcaagttcactacatgacattgatgtgtttaccgtgggaaagttttaaagcaccgttctcaaaaaatatttcacatctctctagtttggatattcacacattactagaggtgtttaagttgcaagtgatgtcaagtacaatttgtctaatatcggtcctaagcagagatgttccccacatttgatgttaggtgctaatgcatagccagaactctgatttggtgaatgttcacatatatgactatttaagcattctaatatggcttttttcccatgtaacggagtttctggaatagtgtgagatgctattaaagatgaatgtatcttattttgttttgttaaaacaatcaacagctcacacactctctcgaagtcaccttttcttcctatccttaagtgagggggagagatggggcaaaggagaatcatgagctgaacttccactctccaccaagcaccatgctctgcaatctccatgatctcactgggactctctatccatcctatgaaagtattattaatctgatttgacagatgaagctcagcctggataagaaacatgcccgggccgggcgcggtggctcacgcctgtaatcccagcgctttgggaggccgaggcaggcggatcacgaggtcaggaaatcgagaccatcctgactaacacggtgaaaccccgtgtctactaataatacaaaaaaaattagccgggcttggtggcgggcgcctgtagtcccagctactccggaggctgaggcaggagaatggcgtgaacccgggaggcggagcttgcagtaagcggagatcgcgccactgcactctggcctgggtgacagagtgagactgtctcaaaaaaagaaagaaagaaagaaagaaacatgcccaaggtcacaaaactacactatgagaaacctgggatgtatgggatgtatcagtatctgccttgatccaaagtccatgaatgtccagggcacatgactgaatattgattctggttcctaatgatactgacccaaatgtaatcttccttaagaaaaaagacctaatggtgactgacttcaggtttagacttccccctctcccccctcagtctggctttatcatctactcttcacactatatgaagtcattacaatcttcttgaagaggagataaagctcgttcctacgaatatggtttcccttatgtggcccactgctctctgaaaggtcctaaggatagtttgctatttcaatgtccagagatagctgaattcctcctcctccactccttgctcctctatagcacacttcccaagcatgggctcacgaactctcctccctacttgtgttgtcaaacacagcctcactgcttcaagttcaattgggtgttagagacacatgtcatacctatagctaacctcatagtcctacaatgtctaatatacataacagaaaagtaaattgaattaaggcagtccaaaaatctacatgtgtctcaatgcatacaatgaaacaaatttatgtgtgctactgttttcgaggtttctcattcattgcaattatcatagtggctgatatcttgcaccatgataacatcttttgaggaatataattttattgataactaaacatagttttattatgcctgatagttaaaaatacttaaaatatagtaaagttttcatttataaatgtgttgacattcaatattccaaaaatattatttttaatggaaaatgatttttccaaagtgtatctttaactttgttttgtaggaacataaattacttattcaagtaatttgtataagtaatacaaatttggccgagttctgacttagtttgtaaactgttactaatgattttctcacgtaagcaaggtctccccacgtactaatactgtgtataaggaggctccaactgcacagtgattcacctgaagtagttcggacttcgggtgctttgctgattttagccatatgtcatacactataatcaaggcatgcagcatacaacgaaacataagttgcccagccaaattggaggaaatgaatcctaattttggattcagcagtaagtttaataaacttggtccttaaagctagactcactgttatggcttggtagtatccccgctgaaatctcatcttgaattctaatctccataatccccaagtgttaagggagtaacctggagagaggtgattggaacatgggggtggtttctcccatgctgttctcgcgatagtgagtgagttctcacaagatctgatggttttataagtgtttgacagttccaccctcacatgctcacagtctctcctaccgccttgtgaggaaggtgactgcttccccttcagccatgattgaaagttacctgaggcctccccagtcgtgtggaactgtgagtccattaaacctcctttgcttataaattacccagtctcaggtagtatctttacagcagcgtgagaatggactaatatactcaccttaggtaaaataaaatttacaataacaaatgaaggtaagataggtcattattactcttgtttgagaaaaaaaaaaaaaaacagtaaccttgtgccatttcagagggatcttcaaagatgccttttaaattatcccacatagaagcccttctaaatttcacgaacccagagaaagatatttgttcctttccatatttgttacagtgaaaataggactggaattatgatgaaaataagaacatattttatagaacaccgtgatactgaataagctaaattaaaattttatgtggtaggttagtctactagccctgcttgatttatgtatatggtagaaaatttcatacaatataacatttaggtatgtatattatagtagattaagtatttggttacctcatatatttgtggatatttctggagaaatgttcgctagcaccttgatcagaagtataaacctataagctggcatgtattctattcacatatatatatatatttttgagacgaagtttcgctcttgtcgcccaggctggagtgcagtggcacgatctcggctcattgcaacctctgcctcccgggttcaagcgattctcctgcttcagcctcctgagtagctgggattacaggtgtgagccactatgaccagctaatttttgtatttttagtagagacggggtttcaccatgctgtccaggctggtcttgaactcctgacctcaggtgattcaccttcctcgacctcccagagttctgggattacaggcgtgagccaccacgcccatcccacatcttgttagagaaagttttctggaaggatggcccatgatgagcacaaacagaacttctaggaattcttgagttttcagaaacagtaatattagtctactttgcaacactagaatgtctgtgcatgctactcttagaagttaagcataaggtgaattttaataattagaaatgggaaaaggaggaaaaacaaaacttcaggtgttcagaaactgtccatcatgtgttgaaaatgggaatgaagtaatgaagtgctctgtaatacatttacatatatttttgatagcaagaataatgtgcctatgagggcatcattattattttttccataagtcttagaaaggggaaaccaaaaatttgcagagcttagaaagctagcaggcaaagttgtgtttaattctattctaaaatttatagcaattctctttttatgatggaaccaaccatcaaataccaatatgtacttctctgataccactttctctcttagacaatttataagaacctttatattgaatcattgattctcaaatgaaatatgtgctgtatgtatcccagctttttatttgtagtattcaaataattcagcagttttaacatgtgatatgcacaggaagagaaagcacagtatcattaaaaaatgtgacacttctgtgatagaagacatttctattgtactcaattgaaggtctacctttcccatgttcaaatgatgccacttgtaaacatctctgtcttcctgaataatgtgtaattaagtgtattttaattctaactttgttttcctatatttaaaagaagtacctttagatttacatagaaactttaaatgctatcttaataaaactattctgtgggatacgctacatggagtgcttaatcttgaaacagataaaaagtaaagtttgtgggttttcttttcatctgaagttaggctgataagaagatcatcaaactagggattagtcctaacgctgcatcaaaatgcatattttcatgtctatgtaattaggttttaataaacatgtttgatggttacttaaaaaacatatttttcaatgcagaaatggcatcttgtaaactacagtataaagagacttttgcaagactatttgttttttaattacagcctgattatgataagcatttgttattttcccaagtaaagattaaattaatgttataaatcaattttctaaatttaggcttaaatgcaatatgttagacacaactctggatgtctgctatagtaaattatggcttttccgacattttctagaatatttgttattgtgtataaccttttaattgtggccacagtttttaaagtgcttatgaagtttataatgcaagtgtttggtttaatgagtcattagccattaacaaatcatttctgcagttacttttctgattgcaatttaggattttatttaattctttttcctttacatttttatttataatccatttttattagcaattgaaatcctagatttttttttcagaaaaataagacatgagatgaggattttttagctgtgtgtgtttattaaaagaaactaaataatggagacagcatgggagtagtcataccttgcatcttacgtttattgttctgaacaagaaatttcttacctttcagaaaaattgcaaatgtgttttgtttcatcataatcttataaatttaccatgttagtagtgtccactatcttcctttatcttttctctatgcacatataatattttccagatataactcacttcaaataatttctctttacgagttgaataaagtccttttatatccacaataaaatgttgcaatgatcagcaagcctcaaatagtttattggaaaaagatcacttgtgtcaatcatttccaaataggaagttttcagaatgaaatggaaccatttggacagtcaggatttctaccataatgaagctttaataagccagtaatagaaggttttgcagcaatagatgatgacccagacataaatcacattactagatcttaagcaggaagttatgtttgtctatactgacaaatataattgcctatattttgtgactccagttcaattatagatcaccattttacttccagttcaattataaatcatcattttacttcctaatatgtcagtagaacctttgaaattgtaacatgattctgaaattcaaaactacagagaggtatgggcaatgcttgcttttttttttttttttttttttgcttatggaaggctattttcctcaaaatctatttgcaattaatttagtctggcttttatttttgcttttaaatttagaaaaatagattctttctgaactgtaggattaaggaaagcattataataatattttctcactaatccttggaagtaatggtctgttccatggaggtggaacttgaagaagttcctcctctactcaatgatctgaaagaggccaaatcaagaccctggtatgctgtcatacatatcacatgcctggtcatggagttgtggaggctgaggcaagcaacacaagcgaggtagccatttacaattcagaagaaaaggatcctgcaatagcatccagaaactgttcattctttaaaaatgacttatagagacccattgaaggaggtctgtcatctatatagggtttggcagcttagtatggaaatttgatgaaagagcaattgaatgatagccaaagggtctgtgttctttctctccagcctcattagataactgagtggttttaaatcagtctttagaatccctggaccttagttttctcatctgtcaaataatgaaagatagtttaaaaaataaaagtctgaaatcctgaatctgcaagactgcggcttctctggcgaggatcccctaacttagaaagcaagtaatctatattatgaaggaagatgtggctactttatgacatgcccttgcttcccatctctacatattcatgagaattcttccttgctctgttgtacactgaagggagactaaggtccttatgagttagatctacaagtacaatcattttgtttccctttggctaggagctaacattctttcccaagctatggctgtgtaattaagtagagttctctgaatatttgtaaaagaggaataatctgtagcagttttctaaaaaggaataaaataaaaataaaaagcatggtaatggagaagaaggagttaatacaataacaaaactctaagaataaaagtaacgaaaggtacaataatgtaagaattcaagtttaatcaggtacgctgaagtggcaatcttcaataaaaaaaatcagttctgaagaatacagaatattaaatttgataagataattgcaattttattatttcaagatagttgtcatctcttagaagtgtcaaataattaccatacacattcaacagaacagcgtggcagactatataatacgaatgtgtcctatgacattcccacagctcttgttagacaggtaggtgtgtggtgatagacgcagaagtatggtatctacatcagtgcaaaaagtcaagagaggctttacgttgaaaatctggagaggggaaaaatgtaatctccaattcacagcattgcagtatagtggaaaaagaactagattaagtgtcaagaggctgtggattgagtcctggcagtgtggtataaggtaaatccttttctttctctgagccttctttttgagaatctcttccttggtatgcaacgccattgccagttaagctggcttgagccccaggttgctcgcctatcttttgctccttagaccattagtggtttctggaagttaatggtaatccagccaaattgagagtagaggctcctgtttttcactagtctccctttaacttccagaacagacacttcctgcaatttttgtttccactgaagacatccaatttggaaattccacttccagctctctgtggccctcatttgagcatgcaccttttaaaaatgagagttgtgagagagaaccttaaaggaaacatcttaaaagttagctccctgaagggttttcaccaagttaagtttcccttttatacccattattggaaattatagccagtgttttaagtgtaaagtaaaatactcttcttaagcctcctttcacaagcctactatttttctagccgcaatagtttaattttgttttgacagtggctagaacactagaaattgttgggtttttattttatagtaatgactgtcctgaatgactaattttcactgctatccatcatgcctaaaattggctggtttgcttggctgaggatgttatacatcagttcaggaacagaaaaggtcttgccttggttgccttagagtgaccgggaaagaaaatggtggtggtgacagggaagtaatggcttcttccctttccctcgtatctctagtgttccatttatcttcatataaaggctttatctgaagaaaaattaaaagttagaaaaaaaaccttcgtgctaaacagacagtttaattggttctgctatttttggaaactgaaagataaatgctacgtgtgaagttaataaaccataattggaatttgcttaagagcattctttcattccacatggactcatacacttcaggaagccaaaagacctagctgggccttaggaatacataagcccctttcccaagaacagctgtgactttcagtgtgaccttgaggaatttaataacttttctatgtccccactggacaataaacaaattggggtgggaattgaaaaactaaaaacaaatacactcagttaaaaaaaaagaaactggaaactttttcagttcttggatgataacactatcgtgtgtgttgacatttgccattttcccagctctgtgtagtgcttttttccacaaaaagactttgatatttttatgattaatttttgtgttatgtacatacctatgtaggcttatcattgtgagcataactgccctttaggttttacatgttatctagatctgaatgtcatgccatccaaattatttgacaaacataatcactcttactcttattgatgttaacaatactgtttttttgtcattgtttctttactggttatatatgtggagagaaatgaatctgatagtcccaggcatggtctggcactttcagcatcatataacttttccctagacatatttaaacttgagctaaatagcacatttctttaaagaaccaaggacgaaggaaagttcattctcattctgaatttttaaaaatatatttgaaaatatcttttcagctatgcttttattgccgtatattctacctgaatctttgaaaaggaaagagtggcttatagttttcgatctgctacttgtttcatagaaatgcctatataatggtggtgagattgagcagatcgtagaagtgttattgtagattgtgagtcaatgtccagtagggggttagagtaaggacactgaatccagaacaggatcacatgtcagtgcagctagttactaattgtgtgatattggacacatctgtttccttatttagaaaattggatcaaaattgtacctatcttatggattgatgtgagaatttgatgacctgagaatttgtggttcaggactggagcagtacctgtaccattagatactcaatgagcatcatcaactcaagggaaaattggagctttgcaatgggcctgagttttaatcccaattagcatgcttactgtaagcaggttctcaaactctctgatattcagttttccatctgtaatgattttttcctagcaggatttatggattagattaaaaatctaatctaacctaaaaataaagctatttcaaggaaacgcctaccccacttacccaatgatgaaattttttaaataaaaatgttttttgtcaagtccattatgaaaacttttagagatgtagatgaagttgtcaagtatttacttacagtctaatttattagtatagttatacaagattttaactatatcatatatttgctcaaactgtaacacaaatttaatgagatacttttgtttaattttacattcatattcaatatcaacgtttttacctaatataggtgttcagagctttcatcttcacctcagtctgagggtttggggatacagcagttcatgaattcatgtatggtgttcattttattccaatccacaagaacctgttacaactcttacttttcccattcacccaataagcaaatactaatctccatggtaggttttatactagactgtttttttaaataagtagacttttttttttttgagacggagtctcactctgtcgcccaggctggagtgcagtggcgtgatcatggctcactgcaacctctgcctcatgggttcagggaattctccctgcctcagcctcccgagtagctgggattacaggcgctcactaccacacctggctaatttttgtattttttagtagagacagggtttcgccatgttagtcaggctggtcttgaactcctgacctcaggtgatccgctcgcctcagcctcccaaagttctgggattacaggcgtgagccattgcacttggcctaaaaagagatatttgaaagatttattggcatgcttatttgaaagatgtataaatccaggacaaagaacaaaatctggactgttttcaaattttgcctttcttcatttttatttactgatttcggtttaatcagtgaaccaccaaaagtttgcaaacctagtatatttttagatgtttcaggcagatatatctcctccaagtatattatgttgtgaaaaataataaaaattgtcggagctaaccataaaaattgaaaacacaaatatatgcaatatttgttttctaagggatatttcctttgagaaggattgaccttatacttaggtatatatagaaatatgtttaatgcacataacataacttatactgaaaattattgaataataccttaactgttaaagaattaaatacgttgaagaatatcacatgtacctagaacagccttcctcaaaatttgggctgcaaggtatctttacactcttagaaactattgacccaaagaagtattgtttatgtacattatacctgccaatatttactgattaaaaataaaactgagaaatcatgaaaatattttatttatttattttaaaatagcaataaacccattacacagtaacttaaataacatatttaaaaatttatttaaaaagcatataatttttttttgtttgtttttactttaagttctgggatacatgtgctgaacgtgcgggtttgttacacaggtatacatgtgccatggtggtttgctgcacctgtcaacccatcatctaggctttaagccccgcatgcattaggtatttgtcctaatgctttccttccccttgccccaccctgccccacaactggccccagtgtgtgatgttcccctccctgtccccatatgttctcattgttcagctcccacttatgagtgagaacatgcagtgtttggttttctgttcctgtgttagtttgctgaggatgatgacttccagcttcagccatgtccctgcaaaggacatgaactcattctttgttatggctgcatggtattctatggtgtatatgtgccacattttctttatccagtctatcattgatgggcatttgggtgggttccaagtctttgtattgtaaatagtgctgaaaaaaaatacatgtacatgcgtctttatagtagaaaaaagcatataaattttttaaagtatttaagtgagaagaataacattattttattatttcccaaatatctttaatgtctgacttaatacagttgggtttgttattttcgttgaagtatatgaagaaaatccagcttcatacagatatatagattgaaaatggagatttttaagaatagctttttcaggtgattatggatattcttattcggtcttacaaaaattccattagtggtagtttcttaaagactatttacagtgtagaatctttttgaaatcatatcaatgaactttttgtactaaaatccattgacttttcttgcagtttcaatggtctttttccttgtgcatggtcttgtaacagtacactttggtcattaggaaaaatgttgtttcattgaggtatgcagatcttccacatgtggacacatttcattataaaatgtcaaaaaatcatatttgtaaatcaccatcaagcttatcagaaaggtcttgaagtgttgggaaactattgtgctcatgatggcaaactgaagtcttacacaggatgaatttttgcttgaaagcttgaattgaatcactggcaacaaatactgatatagctggtttttgtttttttgtttttttgttttgaggtggagtttcactctttgttgcccaggctggggtgcaatggcatggtcttggctcactgcaacctctgctgcctggattcaagcaattctcctgcctcagcctcccaagtagctgggattacaggcacctgctgtcacgcccagctaaattttctatttttaatagagacaggttttcaccatgttggccaggctggtctcgaactcctgacctcaggtgatctgtctgccctggcctcccaaagtgctgggattacaggagtgagccactgtgcccagccaatagctgatttctttaaagtgactaagtctcttgatttattttctagagaatgttaaatagactagtctgtatggccacagttgtctttcagagattattttagataaaaataatgttccataaaaaaagtgatggttcagctcagaactaaaacaatcatacaaatacttttcctcaaggcaactatgatactttggtttccaaactaaaatgctttatgcatacttcccatttgatcacaaagaatatattttttaaatgtactcaagggccaagatttaataaaattaataatttttactgcttcgccaaaagcatttttcagtgaaactagaattttttttttctgtgagtgaataatagtaaaaaaaaaaaaaaaaaataccatgactagtaaaacaattttctgctatgcctttgactcgtgctaaggaaccagccgttttcctcttcacaaatgtcaacacaatgaaaaagacaaaaatgcataaacattataataaaaatagttatgatctccaggccctgttggcgggtggggggggaggtctcagactatgcttgaggaaccattaacagaggaaattgaataaatagtatttgtatgtaataataatagctgacatctattgtttacatacagtttcacattattgcattgttaaatgttgttatctacaaaataagtttggttaccagtcacctttttagtattcctattcagtcaccagttttctcaaagtggtaatctgcactggaccttcatgtcaaaagtgttgattggtgaggttctactaggcttattggtaagatatatttttaatatcactttttcttccttctccactttgcccaccaaaaaaatagaggatagatagatggatagatgatagacagatagacagatagataatatattaagatggaaggaggaaaggagggcaataggtgggaaagaagggaagaaaaaagcaaccaagcaagtaatgaagaaaaaaagaaggaagatatgaaagaagtaaggaattgagatgaacaataaaatgcttgttttgaagctgaagtttagttagggaattacggttcattcaatttagtagttactcataatcaccttgctaaattaaacccaggtgtagtgaatgctgttgcattaaatatattttcacatgcactcaaactgggaagagcgaaacaccaggaaaacatgaagttgcagtgtggttcttgtatatcgttgaaggactgaaacaaacaaggctcaatggccatttctttaaaaatactgactaatactttgaagaaaataaaacaatccaaatgaaaacatggcttgcaggagctgcttctgtttcctcatcttcttttctgtttgcttttacatagaagagtacagctgtggtttaactcattgtgataaaactgctaaacatgtgcctgtaactgaactccaggagaaaactctgccaggaaactgtctcctaatgatacaatctgcatattttaatgatgctggaaatgtaggaaacggcatagactctggactctgctcattctgggctttttcccctccttgtagcttgtgcattgtttgccttcattaacatatgataactggaaatgggtttcctatcaccatccaccagccggatatggcttgacattttcagagttcagatgaaatacttgtaacctttctggggttactctatattggacttattttaatgatgtccattccatcaatgagaagctggcatggccactgttttaaatagcacaaaagaaaagttatgtctcactacaaaaaagcacagctatggaagatattagtagcaaaccatttttaaaacattttgcaccttcctctctcgcttttatgatatgacttctcggttttgcatttttctttgctccaacctcaagtgccttgttctcttactcttactttatcttagccccaccccttaatgttcattgagcacctgctatgggctgagttctttgctaatcactttatatgtattattttatttaattttcacaatattgcaaaataagcatgattgcatatgactactttatatatatgtgtgtgtgtgtgtatacaggtacatgtgtttatgtgtgtgtgtatcatgtatgtatgacagtgatatcagtttggaactaaattgagtatagtagatataagcagaaacaaactttgtgaagttatattagttgtccaaggacacacagttagaaagttagacactggaccaaacccagatttatctaaacctctgagttatcatggtttttttgtaaagaccagaatacttggaaatataagcctttgctggattttattctactcaatccctaaactactcagttaaattgcatacaaaacaggggaaattccttcataagttattggtctgaagccaattatataaaagtgaaagatttggggtcctactctcccaaactattgaataacagaaatggaatagaatagattaagccttcaaactaagaatttttaaaggacaaactcattggcatccagattattttaatatacattgttcatagattactttttagaaacactgtcaagtttatagtctaaacaaatagattttaattatgaataaggaatttaggatttaaaatattattacctggaaaatcatctttaaaaaaagcagattataatactccaaaggaaaaatgggccctttacttgaacataaagttttcattttcacttttcaatgttttcatagcttcttagatttattggcatcacgttttttactctgcattgtggtagcatatttacttactagactgtaaacttgaagccatcattgcaagttcattccctggtatatggaaaccggaagcatagtaagatcagtaaaatgtttggtgaaatgcaaaatttaaagacattgaacaattcaaaagaaagaacagaatcgtgtctagggagtgggccattttaacattttaatgcatgactgtttgaatggtttaaaatacagatttctggacacactgcagggattctgagtcaacccgtctgggaatggtccaggaatctgcattttataaaggcgtctaaggcatttgcaaccacacttcaaggaatgtggctgaactgtttacagttttaaaaagtaattgggaatggttctgacttgtgccctgctttgcatatttgaatcccatcttccagcaggtaagctttcatttggaatccttgatccaatagtcagttatgtcttcttttccatcccagcctaaggctttccctggcacccctcttaactgactgcttacttcccctctctcttcctcactgattgtaagacattcccataataggagttacacaaacggctgcctggcataagcactggttaatgctcgtaatgtttttataaagactgtacacctttttatcaggtacaaaattatttctccaagtattcccctgttttgtagaaatttccatctcataaggaggtgagcaagagttgcagaattatgcatgtaaattactaaagaggaaatgtgaacatgggatgctttgcaaatggtagctattcggtgttttcctggaacaacttctgaaactctagtgcaccaaagttagtgctcttagaaataacttaggcctggaaatctgcattttgacacaaaatctagatgattgcgatgtaaatgattcatacatcacttcttaatgaactttgcaccaaggatatggtcaaagcaggtcgttcatttattttaaaacacttttcagcttctttaagcttctatcaagtattttcttgctcaaaattctccctaaccctttagagcatcttttgtgttctgctaaaggcctcaagtagccagtcaggggagaaataacacataaacataagatagagagatgaaatttgagtaggcttggtagttttatttttaagattctaaatatttgatgttatttcttaaaaggttaatataagaagtctgtttaacagcacagtttctgaaaaccaggaattcccataaaaaattcataggtctgaaagatacaacacattttggatatcggaacccttaatttctttccgattctacaagcatatcctcagaatgtcttttcaatattttgtactgtctggttgtgtagtttcttcacccataaaagaatctgtgaaattagagacgtcattttatataaaggcatttcagtttttaaaaaggatatataattacatccagggctatcacatggttgctgctgaagtttacaagagatgtgtgcctacttctagatcagggattggcaaactgcagcccacagaccaaatatggcctgctgcctgttcctgtacagtccatgagctgaaaatagatttacctcttttttagaatcctttttttagaaaaatgttgtttttatatttttaaatagctgaaaaatcaaaactggaataatattttgtaatatctgaaagcgatttaaaatgtaaattttagtgttccataaataaagttttattggcacacatccacgccattagcattgtctatggctgcttccatactacaaaggcacggttctgtagctgcaacagagaccatgtgtgacgctccctgcttggcacactataaatcacagtgaagcagttataactcgacagcgtttcaagtgccacatgtgtcacgtacctgtgtgaacagccattttcaaagatgaaataagtatgaaatagaagctcactctagatcagcattcacagatggacatttacaataaatgccggtgatagtaacactgactttgagcctcaattaagcaaactgttagcatatacatacaaaaagaatttcagtcttttcattactagactggtattacaaaaaattatgctaaattgttagtattatattttgaatttcgccaaaaactgtgggcatttgttttctttcttgttatgtgagtatgcatatattaccgtcaattttgcagcttcgcctgcaaagtctgaaatatttcctatctagacctttacagagaaagtttgctgacccctgtgatggagcactgagtgcatgtaaattatgagatggtattttagttgtaaaaaatgtttcatcgctatagagttatctttcaaaaatgtaattttcccctgattacaaaagtcatatgtacaactgatagaaaatttaaaaactgctgcaggatataattggaaactctccttaatttttatcacctggatatgatgaataaaccctgctaacatgttagtgtattttctctagactatttttttaaatacttgcatatgtttgaaaccttactctaaaaacaattttcaatgtcacttaaactttgagaagtagtttcccatattattcacaaatctttgcaaacgtgatttgtatggttgaatactatatattcatgtggatgtgccataatctgagtctcctttggtgggatcattgaagtttttgggttttgaacccccctcctttttaataatattatttaaaaaaattatgctgactaatttatttgcccaaccttcagatttttttacagaattcttttaaatggtagattactttcattccatatgtaattcagttgagaagttggataacacgccctaatttttatcaacacatccttttgggtaagtcaagctactcttagttgcttgataaaacagaggttgctttatcttatgacagcctaatcgtacagcagtatttatggcacacactctagaacaagcctggaggctttaaatcttaactgtgtgacttaagtcattaagctctggaaattggaaacaccagtagaacctctctcatagggcaacagttatattaagtgaggtaattgacatacagtgcttactcagtgtctgacaactagtaagagctcaataattgttagcagcaatataataaagtagaaatatccagctctctcctccctcaaactgaggaatatccatttcttcagaaaaacctgtgactttgagaagaaaatctttctttcactacgttaaattcagcttctttcacttttcaaaatatcagattttcgaaagctacagctataccacttatggtatttacgtccttgacccagtcacctaatctctattgaattctccttttcctcacttgtaacataggagatcaaagtcacttactttattggattgttgtgagaatgaaattagagcatacatgtaaaacacttagcccagcccctgtacagagttagccggccaatttcctattgcaggctatgataaagacaaacattgaaaatcagtgattagacaaaggatgcttccttgcccctggcagccttcgaaaacttccctcaccttactgtggatagcagcattactcctttttactggagaaaaagatagtctcagatgcataatcagatgaatggaccatgcagaaacgctgattaaattagttatgtgtattttctgtgtgggtatgtgtgtgtgcacataaaagagcaaaaaaagagtttaaatgggcccaaaggaaggcatttaaatttgaagcctatagttgttccatggttcctcttggcttctgatatcagttcctcctattaaattattaagtgttaagaaaagaaatgtttaaacaaagccactattagtttttagtcaaattctgtgtgtacttctgttatattcaaacaagctaatgagtacattctttttcttctgctcaacttgaaaaggttacaaacaaataaactgtctcaaaatctttattctctctggaatttatttttcagaaatattaactcaccttattttttaagccaaaaatttaagaagtttattataatttgttattctaattctgctgctgagttggctgttttatttaacgataaattgaatacaaaagctccccaaggcaggaagacagagtaccaagctctgaaagtttggcagtttgacatttcatggtagcctcagacagaagttaatttcgatgctaattatgtatacatacttaagttgttgtatgggctagtgggagtgtacatacatgtacatatatgtatgtcttggaggttacactacaactaaatttagagtcattttgtgcagctgggcgtggtggctcacgcctgtaatcccagccctttgggaaactgaggcaggcagatcacaaggtcaagagttcgagaccagcctgaccaatatggtgaaaccctgtctctactaaaaatacaaaaattagcagggcttggtggcgggaacctgcaatcctagctactcgggaggctgaggcaggagaatcgcttgaaccccttattacctcagaatatggcctcatttgtagacagagtctttccaggggtgatcaaattacagtgaggtcattagggtggaccttaatctcactgatgtctttataaaaaggataatcttgggcacagcgctgtgcatgaaagaaggacaatgtgacgagatctagggagaagatgtccatatatgaatcaatgagagagacctagaacagacccttccctcccagcgctcaggagccaacccagcagacacctagattttggacttccagcctccagaactgtaagacaatgcacttctgatgtttaaactacccagtctgtggttacaacagctctaccaaactagtacacattcccttaaaggaagttcgtacagtgtcttacaacaatgaactacattaaaacacactaaagaaagtaagacacaaagggagattgattgttcccatatactgacatttgaaaagatctaatacatgggaaattggtcttgaatcaactcataacatagagttccctcaagagtcccaattcatcattaacatccatcaaaaaaatcaaattcctcctaaaatgcttaagatgggagataggaaagatattgcatgctaagtggaccaacttgtctttaaataaaatgaaaaacttatctctcagacatgctgaattacattacatacactccattgcatatattccagtaaaataaattcgtgaccagtattctgtgtaagtacagtgatatattctgtagcccagaattcataattttactttaggcagcttaggtctcttaaaatatctcccgagggttgaggtcttcatccagccggtggccctattaggaagtagactagaggattataaggctttataaatcctaatgttgctggggctggtaattcacaagtagtagatgcagaaaccacagggagaagctcagagtgctgggagaactgaagacaggaaagtaagaggctctagaagcctccagattaatcttcccaggaagaagcggagacactaatgcttgagaaacataaaaacagactacaaaaagcagtaaggaaaaaaccacattatagcttttacttattttgttggactgttattttcaaatcacacaattgtctgagatgatttaatacacaattacataaaaaatgaaattaacgtgtctttaaaagcataaaagcaactgctaaataaagccataacatttttctctgtgctaccaaggtaatgaaccatatttttcatctctaactgtgcctctgtgtcatgagtatggaatttggggcaggaggggggcagggaaatatataccttcgctactgagagatcgtctcatagctccctgggaggtggttcagagtgcagtgggttgaagaacaaaacagcaatacttatgaagaaccctgccactatgacgccaaatgcctaaataccccgacaagttgcaggggaaagacaagagccaatggaggatggcagagggttcacattttgtatctcggtacctgtttggctgaataaagctgacttctgaatcaagatgctgttctgttttaatgtagaaaagtattgtcactgaaaacctatacaaacctaggtatgcatatatgcacacatatatggaactcgatagggcctcctgccttcatctatgtgcacacacacacaaattatacatacacacttgtaaccacatgttcgtattagaacttttcccagtgtctagtagaaatacctccccttagtagtcttttctgtaaggtattctccaagtttctgagaaaaaaaaaattatggaagcatatcttattttcaaaatgatttcacagagagcctgttccaacgtactgcaaaataaaagtaaagattttactcaaagattgaataaacataagcatacatagaacatctgccatactccagaagtggtgcttgtgttggggatataaataaaacaatagaactttgctcctgccctcagggagacaacagtctgacaataataatagttattatttttgccatttctttttcttttctttttttttttttttcttttgagacagagtctcactctgtcgcccaggctggagtgcagtggcgccatctcggcttgctgcaagctctgcctcccgggttcacgccattctcctgcctcagcctcccgagtagctgggactacaggcacctgccaccacgcccagctaattttttgtgtttttagtagagacagggcttcaccgtgttagccaggatggtctcaatctcctgaccttgtgatctgtctgcctctgcctcccaaagtgctgggattacaggcgttagccaccgtgcccggcctgccatttcttaaataatatctaatacaagttactagtgcactgatatatgcctaaagaatacatcactagatgaaataatgcaatgtaatgatttttttttctctgttactcaactactgcatggcatttggttgaggaacctgtacagattggaggtgacaaccccatcactacatgcttgctctggaaagatgagctttaatcgaaggaccaaatctgtgttccatggacacttgtttatattttctatgatataaaatgggtagggagaaaaaaatcaagtgagcaattatgtttcacatctaggcttaattaaggttttatgtaaaagtacagcaaaaatgtacatatgtacatacataaatatcaagagattgtttgttgtcctatctcagtgggggaacagaataacatatgagatggattagacttctgataggcggatctgaaggcatcttgttttacataatggtgcggtatagtggtctgtggagattttctttgaggacgcaggccataatctagtccaattctagttatctttggtttggggcctgggtatttgtgtcactttagggagttgtctgacaattttggttatccaggatgatatctgaatttgcacaatcatcagggaaattatctgtgggaagaggaagcactggagacaacaaaaggcctttaatctaaaccagaactagatagatttgcatgtgtgtgtgtgtatatgagtgagtatgtgcccgtatgtgttttcttgtgcatttgtttacatgtatttgtgtgtgtatgcttgtatatgtatgtttgtatttatgtgtttatatatatgtgtttttgtgtgtgtcttttatatgcatgtttatgtttatgcacatgctacgtgtgtgtttagtgtatatgtgtatttgttagtgaactttctgtgtatgaatgtggtctgatgtcttttcagccagctctcaaaggtttctgggtttgggtttttggtctttcattgtaattaactaatggaatatctactttcactaattaattcaattctgttaaatcttttggctggttaagtatcaaataaagagctatgttaaatgtaaaaatgtgagacaaaagctcaggatcatttcctagtattgtcattcttgcaaacttcaggtggaatactgctcccaagtctgggttgccaattttgagttcaatctttttctttctgtatttattttgtcagtatataatgcaaaatttaaaggaatgtttcttgctttctcacaaattgttaacctcatattttctggtcatagaaggtataatttataaaattattgtaaaaaatgttttgaaaaatagagaaaatggagattacctgaaaccccacagtatcctcaggtaatatttgaacaggtagatagaattgcacccacatcaataagaactgagtattagatcacataacactctttctcctgctctaatatgtctctccaggaattctactgtttctctccttcatcataaattattctgtctttcttggatcttaactgtaagcatagtgtgtactgctctattgcatattattttttaaaaaatcgattcttgatcccactttctctgctaaaaatgaccctaactcttcccttttctttatagaacaatgtcttgaaatcattgtctacattcactgtctcttgaaacacactccagtaaagctttagaacccacccttccaccattccaccaaaaagactttatcaaggttattaattactcccatattgctaaatccaattgcctattcttagtctcatcttactggacctataagcagcatttgacccagccaatcactccctccttcttgaaatatttcattccctggccttccaggatggttttgctcgtgactcattaactactgttcttcagtctcctttgctatttcttttcttgtctttgacctcttagtgctggagctcaccaagtctcactcttcagacacttcactctatgaaatcctgcaccccgcccccttctacccccaccacatccaaagtgatctcatccagtttatagttctatttttatgagactcaactttacatgagatttccctgatctccagacttaaatattcagctgcttacttagtatgtccagttggaagtctaataaatatcccaaccttgacatgttcaaaatggaattcctggtcttacctctcaagtggtcctagctatagccttcccaatctcagttaatggttacttcatccttcattttgtcaggtcaaattcttagagtggtccttgatttgtgccctgtctgcctgccaccacttcatatccaattctctccgttattatgttttagaaatatttcagtaacctaactaccgctgccacgtccactgctctaactctggtcgaagccaccaccatcactccccctgggtcatcgcattggctttcttagcaggttgtcctactttgattcttgcccttacaatctttgttcttaaaaatggcagccagaacaatccttttaaaagataaatcaaaccatgttgacctttatttcaaatccttgcaatggcactctgttgcactcaaagtaagggtctaatgccttacaatgacctatgcaatctggctctactgacctttcactcttctttcccattccttctgtgatgtagtatactggcccccttgctggttctagacatccccaggcatgtcatcatctccaatcctatgttactttctgttctctctttctggattactcactccccagaaagccacaaggttcactcccacactatcttcagacctctgctcaagaatcactttgtcagggagtgtttctgaccaacatatttacaatggcaacactgcccttcagcattctctccctccctatctcctgccttgctttatttatttatttatatttgatgtcacttagcaccttctaagatactctacagtatgctagtttactgctgtaattttattctagactatatgcttcattaaggctgggatttttatgcattttgttcactgatgtctatatcctcagtgctaagcacagtatgtactggatatacatgcttttcgtaagtgaatgaataatatgattgccattatactatatatgttatgttgacatgatttttacaacttagtaatacctgagaaagttcttattttgttaggtatctgacctctgatagcatgattgtttctggtacaataatattccatttcaataatattaatattccataatttattagctccctattactggatatgtacataacttcaattattaactaatataaagactactacctacataaatatccacctacataaatatttgtacaaccttcagattattatcttagcattacttttctgcaagaggtaaatttgaaccaaagcatatgctgattctacagatttagatatatattcccaaattaacctctggagagttagcattcattttctcaaccaccgcagttacaaaagtacccttttcccagcacactgagccacactttatattgttattaaattcttgtcaacttgatccacacaatgcatataataagtttttttaaataaactttttatttcaaaataactttagatttataaaaattgcaaagacagaagagtcttccttatttttaacatcttatataatctttgtacatttctcaaaacagagatattaatatcaatatgttactactaactccatctaataatgttttgatttgccgtttttcttagttgaatatctctctcctcatttgtcatttgcatgtcttctttcatgagatgcgcttgtatattgcattccaggatttttattgtataatgcatttttgatgaattaatatagtctgttttatatatggtacacagatctctggaaggaagcaataatttatacccacatgtcttaaaatatctctcatattattgataatttttctaaaattagtagacattatgccacaaaataattgcattatcataaatatttgagttaacattgatatagaaaacaggacaaacatgactttttaaccaagattaattaaattcaagttatttattgatttattagttaagcctctctactgcaagtgacaaaaagtctaactcaacttccttaactgtcaatggtaatgaattaatgtgatgggataagtcccaaggtaaggtagttaagttcaggaatccaaagttgtccttaagctttgacaactctacgtttctcagctctgtatgttgacttcatttatcagaatcttcaggatggtaaaaacagcttctagtaaaaatcgcatgggtcatgtatttgtctaggaatcaatcacagtgacacaaggaataagctatgatgattggccttttccagaggcaagtgtccactctctcagacagatggaatctcatgtactgagattggtagaaagtatatctctgaattaaaattgtgaaccattactggagtaagttaggcacacgatggaggcaaacaataaatatctagtattgttagatttcacacatgattgttaagaaatccattttaatgtcgtatgaagccatacagtattccacaactgatctgagcactgcttccaattacctgtgaaataaatagaataaatctttttaccttattttttcctatggggaagtcagccctatgatatccagttaattggtgctaaaagcttgttcttaactttattcactgatcattctttccatctgtaacagaaaatttaacactcaacatcagtttttatagtgatccaccagccactatgccaattattaatgccctttgttcaaatgttctaatgacccactgtccacagtacatttcacaaacacattggaaaatttttgaggctttcaccaaaaggttgtccgctgttacccaatgaactattgcttagatctcctactgtgaatcttctggtctttcttttgttttgctatatacctacactgttgtcaaggatacccagctctccactctcttgtttgaacagtccacaaggtgttctattaaaagtcccaattaaatgtgtacagccattcacctgtacattcatccctttactcccttgcccacccacatacaaccaactacgtgatctaaaaaataccaacaggtcaaaagtcatcaagcgaatgaacaaaatacttggaatctctaggtgtcacataatagccatggcaatattatctcggataattgctgccctaacaaagcagaataaactcagattgaaaagatgtaaataaaaggagagcaatggaaagaggaacgctttttcaattttataactattgcattattagtattttaaaggttaaaagagtttcttcaatgtaaaacttattgctctatgttgagcaagagagaagttgttgagataagcagaaaagcatttatatcatataaagttatagaaatagttggaatttaaattacattacatacttagtaaatgtctgtttttatagaggtacttcttaatttatgaggcagtatagggtagtggttaagggcacaggctttggactaagagagatattatcattctcatcattcctgcttgctacttgaatgtccttgaggagggcataaccctatttgggactcagtttcatggtctatacaatgacattattaaaattattaataatagcacctatgccatggcatctggcaaggatacaataagataatgcatgcgatgggctgagtacagactttccacgaagaatcaatggatgttagcattcattaaataatacacaatgttattaaggaggttgtgagcaaacaatttcttttatatttaggcttctgtagttttatagaatttatatggctattttatagaatttacatggctatttataaaatttatatggcaatttttaatactttgtacaatgctttacatatttccattgtgctatgcctggtgccatgcaagagtaaaacaaaaaggcattcaaaaaacctggggacacaacctatagaagagcaggctcaatggtgacatggtggtggccaatgtgaggaagaggttacatgtatcttgtgccatgatagggaatagaaatagatgtgtgaatggaatgttcaggaaggcagattttgattgattataaaaaggaatggctcaccctgaaattcagaaccagtctacaatgctaaggtatactgctggacaaaatcagctactttaaggatttccaagcagaagcttggcaaaatgtcagccaggaaatcatagaggagatgcatttgaagaatagagtttgagcatggattaggtaaggtaattgttaggaacccttcctgctgtgggattctgtgattcttattcataaataaaagttagatttttttaccctgataggttcatattcattgaatcattcattcaagaaacctttggtggcccacacgtgtaatccagcactttagaaggccaaagcagaaggattccttgagcccaggagttcaaggatgcggtaagctatgatcttgccactgtactccagcctgggtgagagagtaagaccctgtctctaaaaagaaaagaaaaaaaagaacagaaacctttattggcacaatgagaaacaccatcaggccatatttattatgagcatggaccatggagcttaatatgcctgagttcatccctggccttagcatttaatttattgtgatgttatgcaaatgactaaatttctctgaaggcttcattgattcatataaaaatggaagtagtcatagttttggctcatagaatttttgtgggtatcaaataaaacatagaattgaataaccatagccccattattggcatcaagtaagcactcaataaatatttgctatgattactattaacagtgaatgaatgaaagtactgagatatggaggattgaaggtgaattacatgatatcttagttcataagaatttagtcagtgagaaagtactgaacatccgtatctagaatccaaggtaggagataatatatacacacgtttctgtaggggtccactcatttattcggcatatatgttcatatatctataacaggaaagaaggagtatttggcttcagggagttgacgtgatgttgtgttggaaaaaggaatggcaaacaaacacataaacaatataaaatagggtggtaggcataaagagtggcatgggtgtagcatgtgcggtcaggacccacctggctaaggggatgatatgatcgtatacttgggtgatgaaaagaaatttagagggaggaaagacaatttccagatggaatcattaaggtagccctcatggggaaaaataatattagagttgattcttgaaggatgggtagaatttaatgatccatccgttactcaattcacttagctagtacttaaggagtatgtgacagccagtggaaacagtactggaaatgcaagagagcattctcatgtggaacttcagatggagaacacaagatgaccgctatcaccatcaaatggaagacagcaacaatagtaacaaagataataagcacacttcttgcagaagatataacaattaactgatagaagaaaaggtgtaaaaaaaaacttacctaaagggttgaaaggtttaaaatttctagcttgaggacaaagaactttgtcagtagacaatagggagttgctaaaaggtcttttgagcaaggaggtaatataatcaaatgtttaaaaagtcaacccaagggcagttagaaaactgtttcaatacttatgcgtgatattatagaattgcttgctcattcgtccattcactcattcattcattcgacaatcactgatcctatgtgtccagtccaatgcaagaagattagtaggagaaataggaaaaaaagagttacatatacaatcaagtatgaaacaaacatgtttgaagccaccacatgaaaaggactataatttcaagtgaagtaaaagtttaaagaaatagctgtaaatgtgttttctctatcctttgttagaaaaatagaatattctttttaaaaatccaattatgccatttttctaactgtctaccttagtctgttatgagcaagacttgaagttggactgaacagatgaccccagataaaaacactaggataagaaaaacctaatatattcaaccaactgcaataattcatatttttaagatttcatttagactattatgaataattttaatatacggcctctaaaatttatgaactgtagttagatggcattttcaattcacaaaggcaaatgaatgtatttagatgatatacaatctttctaatggtggaactttttaatataaagtttttattgtaataatttaaaatgaacaccacacacatttgtggagaaggcctcaagatcaaaatttgcaaatgccaccatcggttttgtaacctaatgcaaacttgtagttaaataaactagtaagaaatcatactgtttccttttaagacccaaagtaatgtaaagttcctttaatgttttttttgttttgttttttgttttttttttttgcatattgagactatagacaaccagaattaatacaaacatggacacaaatttggcaacagcaaaatgggaattatgcttgaaaattctttggggctgtttcctcagcctacagtggcaaccccttcttcaacatagtctccagtcaaaagatcacaagggttgaacaagagtagtgaggtgtcttttatgacccaacctccagcccagccatgaataattacagcaggagcaagatacatgatccaagctggattttgcaaattctagcagattttcttctgcaaatgtgggtaatgggcattgggaaataatgcatattaaggaagtgccgaataattgctggcaatatactatagtggtgtcttgatttctgtgatttctgagatccggattgttcttctcttgtgtggatttttttagaggaccagtatctctgcagtaaaatttgtcttgttcaggttaattttaattagcgttcatggtgtgctacctaaaaacaaaagaaaacaaaaagactttaatctgaacagtcattttacaattgcagtcaataaaggtttaaatgttttaaattactctaacattatatagtcagtataaaatattttgcagctcaagaaattatgtcattggttaaaaactgattctcatgactttgaagccacacttaattttatggtgattttaagatgttgcaaagtattacagattctctcatgctttcctctaccatatacaaaaccagaatgaagaaaattcctagtgcaagcaaaggaaaggcagccacaaatatatatgatcttgaactctaaatcaattggaatagattttaaaacagaactaggacaatccttttagaaatgaagttagggcagaaaatggtacttccagggtagtgttgtaatttggatgtgattcatttcagtccattgcttgaattattcgcaaaattttccttcctcatttagttccccgaacttttcaaggatatgtttatcagcagcaggaagaaatgcctggtagctttagaagattgccctgtctctttgcattacttctttcaactctgatgtttacttcgatttttaaaatgacactgagaggatctgtaggttcggatggattttgttaagagaaactcaatgtcacagagactaaaactcctcctgaacaacaacaatcagttagtaatccttttctctttctccattacatgtcctccttttatttgttgttgtttcttgctttagtggtacatattaaaaattaatggctgttacatgattttagaagggtatccacttttcttttattagcaggtgtaattcatgaaaagtatactgcagaaacctccattacaatgccgctttctgatagaattcaattgagagatgttattgctatttattaattgctcggtctgcactgtcatggttgatgatgttagcacagaccctccattgagttacattcttgtattcaattagggatgtgtattattgtacatgttaacactgtagaaccggggatgctagccatctgtagatttgattttttttcccttcatagtcctcaaaaatggagcattttacatcagcactgctagagagacttacaaaataaaataagcacataagcacatcagttgcaggtttaaaaacaaggacagtgtaaaatttaaatttgaagattctatcaaaagtatttgcataattagaatcactagacattttcattttaatcattctaggtggtcgcatatctgaagaagagtaagatcagaaatggtactggtttatcctgtcagaatgtttttctctggctaaatggaggaccatgttatgatattaaaagatcagagtgactaagataataaaaccaagtgtgctaaaacttccccaggtgaagaagatgcgtgaattgcaaaccagtcctaacaggacatttaggaggggaagaatgctacctgctcctcactttcttccctcctggtaccaaataactgctgatacttccaatatagagcaacttttcagaataaagaaacagaacaggaaagctagctggctggcagcagcgtttaatttctcagactcttttcatgaattattctaaaaagatgttctctgacaacatagatcctttctaaggtacctcaataatgcattgccgtggcagcgcaatcatttacctttgatgactcgacattcaccctggtcagttttgtcacttaatgtcaatgtggattgaagatctgcttttgaacaatcatggccttctgtttgaaaacaggaggcatacaccccattgctctggccaaattccaggttaggtaataacattctgttacctaaagaccccccgcagtttcaattagaaaaaatcgttgtgccttactcctctacctgtggagctatataagggtaggtatcgcactgctaaacagcaaacttgtttcaccccagaaggaactgccctttatcatcatccttaattaatatttattgggtacccatagggtgaatgacttgggaaaaggcgacttagtaattaaatgtttccgaatgccggttgtcccctccgagaatgaacgtggaggaccaaagtttgaacagtctattcattatcacagaaatagcatctatccttgtaatatggtacttcctcgctcgcttctgatatctatccatctggtacacctctaatcaaaactatttttcacatcattggatcctaatcgcctcagaattatgtcgagaagctctttgtggggactgaccaaagagtatgagttggcctcttggctctgaccagttgcaaattacaaatatctactcttctgcagggcagggagggggtgagtttgttgtcctaatgagcagcatgcttttaatgttgaaagaagacctctgtgtttctaggattacattgtcgtctgtgccatctgctcttcttttttgctatctagctctgttcacaggatgcagaggcgccgggaactcttagaaagaattgggtttagtgtttcctttctctgctctccagacattgtcttgatttgtagactgattggagacctgtctagtgaatgaattcttacgtcaatgatcatgcttccttcttgccctgtgcctactatgctcagattctcaggatttaatattttctgacataacttccaagaaggtatgacattgccaggggaagtaaatatttcagggatgaccctgctcaaccaaaaaggtctcatccctctacttgaggcatcgaccctgaccctctggtctaaacgttttgttctgcacaggtgtacattcacacatcctgggcacagatgccagcagatacaggagataaacaaaacagtttctccttgagcttgcactccagcactgaacagagagcccccaccccgtgcggcatcacacaagatgcatccttttggctctctcaaggatgatgacaaaacatgaattaagaaaaaaaaatacacttttcatgcttatttttaaaattttatttcaaattttcaaatgtctcaccactttcctcttttttatttcaggagaggatgatgcgtgtgggagcggattactgagatgatgacgatattctctgtataggggaattatcttataaaaacatgtacaattgcttgtattttgttacagaaccaaggttaagaactgcatttacaatggttgtgataagatttagcatttaaaaaaattgtaacatataccaaaatatgccatagctactagaatctagtgacgttgtttccatgtgctttttcttgcactctcttccttccctcagttgagctcatcccctttcacacctagcttcatcccaatgcaacttctggtcccttcctctgtgtcccgtgggacctttttctactgctgtgatatgtccttgtattcttagcattctcttagaaagtatcctttattgccccaccataaaggactttttccatgtactgtatcaggtatccttccaaggttgcaagcagcgtagaaaactctggagaagttgagcaaaggggaacttagtggaaggagagtgggagctcagagaatcactaggcaggctatagcaccagtgctaaaaatgggcatggggaatgtttcccaaaaaaagtccttctgttttagagatgcatactgaaatatttatgactaaaatgatgctttttctagaagttgctccattgtagggtgggggtagataggattataaaagaaaccagaatagtcatgagttgatgagttttgtagctggatgatgggtacatttgagttcattttctgtcctcactaatttggggcatgtttaaaattcccatggaagaagacaatcagaattaaaagatgtatccaaggctggttgtcctgagagctacccactattgtacattaacagagatggatgtcgtgactctcccatagatatgaaatgcatgctaaggtagacacacttggttcataggtatttgctccgctttgattcagtcaaggggtctgtgtgtgttagtgtatgtgagggagtgtgtgtgtgtgtgtgcatgtgtatgtgagggtgtatgtgtgtgtgtgcatgtgtatgtgagggtatatgtgtgtgtgtgtatatgtgtatgtgagggtgtatatgtgtgtgtgtgtatgtgtatgtgagggtgtgtgtgtgtatgtacgtgtatgtgagggtgtgtgtgtgtatgtgtatgtgagggtgtatgtgtgtgtgtatgtgtatgtgagggtgtgtgtgtgtgtgtttgtacatatatatgagggtgtgtgtgtgtgtgagtgtgtgtgttctacaagatgtgggtgtaaatatatgaatgcctgcattctgaattgtgtgtatgtgtgtgggtataggagtgtgtgtgactgtgagtgtgaaatagatctgccagtgtgcaaagcctgagagcagacgtggcagagttgaagggcctttgttgtctgtagcaggtccatcttgtatttagttgacaactgttctgtctgataattcctgcagcctttgaagtttccatccagtgaatataaccctaaaatatgaatgtccttttccccaaaccaagtatgcttcattattatgaaggcatgatctgtatgctgtcactcagtgcagtataacttaaaaacataatctgcagtgtagctaattgtcaataaattttctccattatatctcaaaatttttaaaaaaataaaaagaaatggataggaaccaaggtgacctagattattaggaagcagaaaagggagaaaatcgtgagatggtgaagaactgcctgataagggagctgcaggtaaaatgagcaattaccttattttcatctctatcactggactgaagtcccaattccaggtaggcagtgtgtgatggaatgagcttgcttttctgcctggtttctagctgtatctagaagatgacaggaacgttctggaagaaaatgggatcctccaaaggtgtgatgaggtgcaataggtgtttgaattcaccagggccaaggactttgggtctagggaagagaggtagttcctcaaagggaaattagcaagctgtttggagagggaagaacaataccggtggcccccagtactaaatgtcctccttagtttgactccaagactcacaactgctcatttttctctttagctttaaaatctttagtaagattttaaagaacaaatttgagactcctttagtgtgataaccaagtgtgggccttcaggaacagccccaatttatgtttcttgttttcctctggcctttttagtccacttgcaggctacaaataccagtcacacaaatactttctttcttgaaacatgctgctttcttccattcgcagatgccttggttcaagattctccttctacctgaacttcctttgattttcttttttgcgttacaggtatttacttgttcctctcaatccaaatcacatggcctgtgttcccattacactgcatttccatgggctggccttgccaatggtgttatggtcagtgagggcatggccctctcttcaggttacagggtggggcacttgaaaacaggaagcatgtccttcacctttatatcttctctaccgtggcaaccagcaccatatatatcaagtagaaggcacccaacaagacacatattttgagtgaccctttcatgctttggtgacttgtttatgttgattgtaatgttggcagagatgcattcacaatgttgcctcaatctacatcttattagtgatggatctgtactgacttctccctccctgtccccattccccaaatccttcttttatctccttgtttctcccaaactctgccacttttcacattacccactgaaccatcaggagcaatagtaaggactctctagttgccctgaatcaggttgagaaagtgtgaggacttgttacctcaattggtccctgaatctttagttagaagatttggagacactgtaggtagttgtactttgccataccctctaccttattttttggtggcagtcttagaaattaacatttattgaagtaatcaattattgcaacagaagcacaagtaaaagagggggtggtaggtaaagtagaaatatatcaagagaaaactaacttttgctattatttgtataattgccacaaccctaaaaagaaactatttttctaaatttaacatttgaaaaagatagtgggaaacttggaagtaaaaatgaaaaataacaaaaaaaaaaaggtactaggtcatgttgcttgctctagatagttttggcatggctaagatgtgctagaaatatttcattttgacatgaactctgaccacttttcacttgtaatatcgccagcatacatatatttactcaagacgggatagagtttgtgataacaatagtgggatgcactgtggccatattaaggattcaactcacttatttgagctgagtgcatgggcagcctgtagtgaatgaacttgagtgacctatttcttcttttttgtttaagaattaggactataagcagccaaattatgaatcaggaactaatagaatgaatagatgcaagaaaacagcatgcaacaatttaatgaaagagaaatgtattatatatgctcaagaaacaagtaaaatgccacttttagattacagtttttccaatctgtttatttgcctcattttctttaactgctatttcactcaactacaacttttaatattcattgggtaaacaatatagaaaagcttggttatttcaaatctgtgttgagctccttctaacttatttttatatttcaccatctataatggagtatttacttataataggacactacattttgcatggataagttatttctcttctttctaaggtgtctaagaatatcaggttagaaagacatactggttaaatggttgattttagtcaaaatcactgcagcccctttgggatctactgtttttacaaagtgtggtcctgggataattgtgtcagtttcaggtggggattcatgctgaaaatgcatattcctgtgtcaattctaaagccaaatatataaaaatgtctgctaattttaacaaccttccagaatctgtatacaccagcttttgagaactgctcaactgcaacttccgtctcctgggttcaagcaatcctcctgtctcagcttcccaggtagctgcgactacaggcgcacgccaccatgcctggctaatttttgtatttttagtaaatggagtttcacatattggtcaggctggtctcaaactcttgacctcaggtgatccacccgactcggcctcctaaagtgctgggattacgggcatgagccaccacgcctggcccatattgttattttttactaatcaaagtaatacattttattgtgcaaaatttggaaatacagtaagcaattgagttaaaaataattcactatcccacaatgcaaaatctttacaatcattatatatttttttaaattggaagcacataaagaaaagccattaatattatgctgtatatacactctcctttttctcacttaacaaatctaatgcttaacttagacagtgcatttgtagaaatgcagtgtttggaaaggaggaggataaaaaatggtacgggagagtgcagagaaaagaagagaggaagaaaaggaaggaagagaaaggagatgagggtgatgatggcaatgtgaaagttaatctaaatgtatgtgtcagaataatgtcttccttttttttttttggtggttggaaataaataactttaaaaactctataatgaattatctgaggcaccagaatctcactgttaaaaaacagatattggctgggaacgctggctcatgcctgtaatcccagcactttcagagaatgaggcaggtggattgcttgagcccaggagttccagaccagtctgggtaacacggcagaaacccatttctacaaaaaatacaaaaattagccaggcccagtggcccatgcctgtagtccaagctatttggaaggctgaagtgggaggatcacttgagcccaggaggcagaggttgcagtgagctgagatcatgccactgtactccagcctgggcgacagagtctcactctgtctcaaaaactaaaacaaataaatttaaaaataaaagccagatgtatctgatgtttgacaacttctttccattagagttgggaacagatcactggaaaaatggggacagtcagtttgatcacaggatttggtttaccgcttggattcattttacatttttttaagcaaaattaacttgggaacttctttatataacttattttttgcgtgcctaatatggaacagatgcagtttttgtccaatggaagtgatacttgagctcgtctaatgaaaattgttaaagtgccaagtattcttattctgttattagggttatattaggcaactggcattattcattatttctaactaaagtgaaacgtggacccccatgcatgaagatatttattacttattgatatttaaaggttgttaaattaatcttatttaaattgctcctactaccaaccactgttacaataatttattatataatattacttgagggttttcttttactttagtataaaacttgcaaaagcaatgtattgcctgtggatttttcctacagttcattgtaactgtgactaattcatcacagctgtttagacatgcaaaatctataatacttcacaatgttgattttctgtttctaagactagagcttgatttgaaaccatataatgaaaaattacatgcatctcattggaagaaatattactttaaccactgggaggtggaagaccaggaagagctgtgtggctctgcagctggggatagtgtatgtgaaattctgatagcttcactgaactttgttatgtccctcgacagtattgagattagatctgtctttagttttgttccagaagtaatgttactgctttatttttcctgttactcgcaagaggtagtatagaatgtcttccaaaatataattccccacgaaatatctagggacctgtttttctttttgtgagtcattcatcactcctttctcttctcttctttctcctgcttctccttcattgcttccttctctttttttctaaaggacagtatactatttttgagttttcgtcattcaaaaagctggggagaagcacaaaaggaagtggtggtttccctctttctgcctcttatcagatcttataatgggttaaagaggaaaacaaatcaggggtaaagtgaggctttgcgtttattggcggggatggattgtatctattccattaacatggatgattgaacgctgcctcagtaccattgtatttgatattcaaactgatgctatcattttcttagtaatgattgaaagctgcctcggtatcattatgtttgatattcaaaccgatgttatcattttcttggtttgcatgtggaaaagactgatgaattattagttacatcaaatctttaacatgtgcaaattagtcaaatgcaaaacatgtttataatattcatggttattattcctccatttatattattttttgaggcttcacacaagagcagaagaatgtgtgaaggtattagctgccacttagttgtttagagtttaaatatttaaagcacagagaccttagtaaaaagaagggatttatgtggatacaaggaaaaatattgttttgtccactgaactgtagttattatatgaaagctaatggaaataggagaattgaaaaatgtaggtaaacttgttgttttaaaatactcaatttgtatggagtttggatattttatgaagtaaacaggaggtgggagtggtacaaactgagtacctattcattcatttcttcagaaaaatacccatttactaagggaatatagcaacacataaaatagatacaggctttgcctccatggagttaggacaggcaggcataaatttaaaacccacataagttgtataattactagtgtgacattgtatgaaggaaaatgaaggggatgacaagaaaatattaaagggatcataattgtcatgaccttggatgaaggaagtctgtcttacggaattgctatttaagcttgactgagcatggtggttcacacctgtaatccaagcactttgagaggctaaggtaggaaaactgcttgagcccaggaatctgaggcaagcctgggtaacatagtgagaccccatgtttaattaaaaaaaaaatgttatttcaactcaggcataaaacattagtaggaattaaccaggaaggaaatgaagagaagagccttccaggcacagaaacaacagcatggcagtggtttgctgtgatggaagtaccaaaaaaatgctaactttttatatagtacttgctccatcatgtgttttccattagcatatagtattttacatggatgttctaacaaagtatttttagaacccatatgcaataactgaattattatacggtcagaacaatgagaaatgtgcaaataatttcatgcaattgtacctactctttctatatgcaaacactttaaagaatcttctaagaagatggctctatgaataacagggagataactgctttaactacaactaactttgtgaaacttggttttcagagcaaaccaggaaaaaaagaaatcagaaaccacatgtcaatactttttagaaaaggaaaataatttggtatcttatcttgctgttacaaataggctgatgtctgaggttatatttaaagatatttttaataaataagactcagcaatcaagtcagatttgatttgctggcatagaattcatttgatataatgacacttaagggttgcttgacttctattccatttcctgatgcccaatctcattattaaggtaagcaactgtgaaaaagggtgactctttaaaactctcagtttaacagtttcacttcattgaattcttgtttaatttcttgttgccgaatatgagtgattgtttttagtatcattcatgaatgacacatagaagatttgctgtatagtatctggaggtatttctggaagtgggtttctggatttgaaaattttccatcatcttgaacctactttttaaatgtgtctaaattaaataaatcaatttaatttgtttgtgaaagttccatcttcattcacataattacccaacagacttaaacaacttttctaatgtaaaatgtcagttaattatgaatacatattattaaaaccaaacaagtagccagaagcatttttttgaatttgtaattggatttctgtatgtttttcttaagaatgcaactatcaacttttataatggtaaaccaattgtaatcttgttaaacatgccttgatttcagataaatagaatcgtagctatctctcaaggaatcaaaagaaaaaattattttaaatgcaatcttatttttaaactgtattacccataagtaattttagttatttaactttttagaggaagcatctcattagccgtgggttagaaaatcaactctctgtggcacaattcattaaaaataggatttctcgttcttggatagtgttttgtcaatatcaaaggctgaagtatttaatgaagtatttaaaatgccacgcaatctagcaaagatacctaagatttatatggaagagtatatcttttatataaaatttccaacttctaaaaaaattaggacacagattgaagcagtactttcagaaatatctgtcaccaccacacaccttcaattcgagatgaatgtaggcttcacatcactggtctgggccaagtgacatcatgcaaatggtggcactagtgtcatgagtaataatggcttcccccttcaaccctgtcaaactgtatcaggttgctaagctctaacttttgttgcagagctcaatgaaaactaaaataaaaaaataaaacaattaccaggttgctgtgtatgggttagtatagtgatttgccaataaataacaattaccataggaattaccatggaatgtgaatttctttttcctcttgttttgttttctttcttttttctttttttaatgaaatccatagaggttctttctctgtagattttatttttctttctactataaaattagaacttgtcactccactatgggactctgacagttaaataatagttcacaaatgattagcggaatgagaaattactgcccacagaaagagctctgtgactcagcagataaagatatacaactcaagtttaccaaggaaaccccactgaacatgtggaaacgaaaggcagatgtaatgctatctattgaagcacccagccagtttgttacacgtcccttaattatcagaataattttcacttgaaacttaaaaacaattggctcacacatatttcactttaagcattttcagctttgaaagggggttggtgaatgacattaaaaaagctccacacaccccctttttatcctccatctccgtttaatggaaaaaggattctggtaatatccagctatcttgctagtacagcaccaagcacaaagaaaggacagtaggggtggtgattttaattatctatgtaaatttaactatgcgccacagtcctgtgattgaaactcattactttaactttatagtttagttatgagtgtaaacctcagctcaattaaattataaaccagatcctgatggctccacatattcacagtctttgaaggaaaaacaaaaagaatatagacaggacacaagagcatctcagctatcttttctatgtatgttatcatcccccaaatgccactgtgaggcatgcatgcaaggtggtgtatactgcattgtaacctgtcactgtgcaacagaaataagctaatgttaagagttatttatcacaaatttaaagacaggacaaagtaatagtagaagggtttttaaaattttgtctgttttacagaatagtggtctcataaccctctccctcaaaattgtgtattaattagaacctcaagctcaatttttccctaatatctgacatatcttttaatatacattttttgagacagagtctcattctgtcgctcagctggagtgcaatggcgtgatcacagctcactgcaacctctgctcccgggttcaagtgattctcctgcctcagcctcccaagtagctgggattacagacatgtgccaccacgcccggctaattttgtatttttagtagacacagggtttcaccatgttggccaggctggtctcaaactcccgacctcaggtgatccacccacctcagcctccaaaagtactgggattgtaggtgtgagccaccccacccagcgatcttttaatattttagcgtgtgctatttctcattgtgacaaataaaagtcattcttcttgtctatatttttgttacctcaggggattatccataactgtcagattgtgtaagctccattgactgtagactaattgtccttacattaaatatattaaaatttctaattgtggtgagaagcaatgctgcatttccccttgagtcactgttgaatcagtttcctcacatgggagatttatttagagatagttttgcttcacttgaaataattgaggacattcaaaatgccaaagttattggattaacttgaaaagttgcgtttgctctacagatttatttcaagtacaaattttaaggtaggtgcctttaatcgacacttaattaatgcgtttacttttgttcgattatttcttggaattatatttcttacctcagttgtgatatttttatttgtaccaatgacacactcaggaatctaataatttgaggtttaatgggtaattaaagccactagacttctctagaagaggtcattattattagcgataatagtaataagagcgaacattgactgagcacttaccatgtgccaggacccacgctaagcatttcagaggcattgcctcacataattttaacaataatgctgttaagtggagttattcccattatttattatccctttctgggcttagggatgctgaataaccaaaggaagtttaaaagcaattaagtggcatagccaggttttggacctaagttcttttgactcccaagcccatatggtggggataaattcaatgatagaacaatatatcatagttaaacctaaactacaagtgaggataactaaagaatgatatgtagctatcatcttatgtggctgtctttcactatcaatgttttatctactaaattcttaaaagcaaatctccatccgtcatatagatttgcatcgggagcctagcacagcacttggcacagataggctctcaataaatattcgttcaattgaatttgactgatgtttgttttaaatatactgaaatataaaatgtactggcttggtttggaatgtggctgtattcatgcagttaatttactctctgaagttttcaagttagtgactttctcttatgtcttctaagtgcaacactgtgcttgtcacatctctaaagcaatttgccatgctcccactaagatgaattttcctgaaataatgtctgtgaccattttggtggcattttgtgatgctactagtgaatttccaagttatactgaagcaagcgagcacccatttgtagagctcaccttattcgctttgaaaatgccattgctcttggaagaacacttcgagtgaaaagggaaataagtgtggaggatcagcagtttgttttataccataagtgtttctcagtaattattttcccgaactgttactatagaaaaaaatcaatgcttatcaagaaaggagaaagaaagaagaaaaggaaagaaggaaggaaggaaaagaaagaaaggaaggaaggaaggaaagaaagagaaaggaaaggaagaaagaaaatgaaagagagaggaaagaaagaaagttgacattttagttgagtttagttttttgttgttgtttgtttgtttggactggggaactccacctatgattatatctacgtcacttaaattgcaattgcaatacttctgatgttttgttgtgtatgatgtgcaaaatcttcagtctcactatgtttccaaacacagatattaaatcatagctttttgtcattttgtgatgagatggattcaaattaagtacactgtgagataataaaaaaaaaataaaagaaagagagagaaatggatttggggaaggagacaagtgtggtcctgtttgaacatggcatcaattccttcttaacaccatccctttcttcttctacattttatcctatgccatttatcccacatgtattacataccttctatacataaagcactgcaataaggaattagcataaattcaaagataaataagaatagctccatgtccttaactcatcacaatctagtagagaagagataaaacatgcacaaagacgacattgattgtcctccaaggaggacagataaaagactgggaaatcagagtaaaagaaattgtctttaattttggagaggctcatagggtaagaaaaaatttcactgagaaggtaaaacgtgaggcctttaggaaggagtagagatcagctgcttctgaaatggagatgccaggaacacagaacattcctcctcctccctaggacagagccaacctcattctaaccactaccaagcactgatcacccttaatgcttgtttgctaccaattcctacaggatagaagaaatttgcattcttttgtcatacaaatagttgacttaaatacaatcttaagggccctgcaattaactaggtttgtggcagagagaaatttacttcttattgaatctcagtttccttctccatgaatgagataaatggacaagaattgtgattacaagctccagtcaatggtcatgactgcctgatatgcctggtagcctgtgccataagcattgcaagaacaagcctaagctaagttgaaagagaggtgatcaattaagtatgtcaagggcataaaaataaggagtgatggtatgcttgccatatatttacaaccacacatttagtcagttcaactaaggtgagattcctcattttgtgtcactaaattacaaggaatacctttatttccccaagagaaatgaaatttgaggtagaatttcttagtttaagctatttgtggaagcagtcttagaaagtcattgtcagccttttataggcagaacacatggattttaaagcaaagcagaaatactgagcatgtgagttgtgtgatgttccgttttaaggatagtttgaacacatagggaatgtcagaattggattgtgaagctctagatttgaaagcagttgaatatcaataagatttgactattaaaaaactcaaaaaacaccttgaattcattactggattgcctaggtaatgtaaggaatatgacacacagatccatgaaaagtatttgagaacagcatataaattgcatgttttggtgcttggatgtaaccaataagagatcttaggtataaattgagtaacatgccttagtcactaaaagaatttggcatggcccacacagctgttaatgggtaactctgattcttgctttttaaatttgagtttcatcagcactatttcaaatagttcatttaaaattaacaccctaacactgatgctaaggtgcatgacagtgcataataaaacgtaattttcattttacattatacagattacaatccctacactccgagggatgtagtggaatcttttgctgtaatgaatttatagcatggtgctatcagttcctctgaataaggaaaaaaggaatagcatcttttgtatgtttatttttctttactgatgtttctttggcactatgtttagcctcctaactacacctcttaggtttggaagagaactcagatttattacaaaattatttttaaaatatggcttatccattgcccacaagtgacacaaatgtcagaattacctatggaactccatggaaagcaatttaatttttcctatgtctgagcctttttggtgtctatttttatgaagtagttttcttgtgtttttttcctccttttataatttttaaatggataagttgcagtagcgtttctttctttgaagcagggatgataagagcaatcgcagagtacttctagttgtcaatgcccttaaattataattgattagtacacgaataaaggagtgataggggattggattttgaaagaaaatgggactaagtgtaactggtttgaagatatgattttattgtggaagagttgaaacacaaaggtttccccaaagtctcatttttcatagacatgagataaaatctgtaactctcattccattggggtttaggctatttgttggctttaatttaattggatagaaagcaaggaataatggtttactttgagctctcttttatcttccttagtaacatgtcacttatatgacccagggaccttctgagggtttttgaaaaggcctctttaaaatctgcttgcacttatttgggcactaaaatatgttttatttggagatgttcagaggcaataaaatatagaatatcattttaataatagagtaaaattcggtaaaaggaaacagtaaatacacgctgaaactggagtaacgaagtaaagcctgcctcctagaagttaaagtgcccggttttataatgggcatataaatgccttatgagcctgtttggtaggaaacacttaaatatgtagatcctctgtgaagcctcattacttatgtttctaaatgtttgttttggcatgtggtgccgtctttggtatacatgccatttgcaggatccgctggaatagccactttagagcaggtgcgcttgacaggatgaactgaacacacatattatctgctctaatgaagtgcacttattcttagcctggggcatagtcagtgatgttctgtgatttctctatatccatccagcagaagctttcctgtttctcaaaatacctcaccctagacatcgaggagccacttctatggaaggaaaagcagtttatcctccactgacatcctattgttagctgtgctatcgagttggcgagcagtcatcatcctgctgactaagaccccattctcctgggtctcaccgtggtcagatcaatgctctaatctctgggaaggaagaatgataaggcatctatgtagggtctcctctttagtcttcttttctcttagctgtttctttcaatgcccagattgccagtgagttaggctgcagtgctgaatagatcagagtgtttcactagaaagcacgcagtacaaagttgttcctgctctcttcaactcagtggccccatgactttgcataggacattttaacttacagaatcgcaatattcccttttgttcattgcaaaagctatcattgagtatcaatccatgtttactacctacttttcaaaatactggaaatacaaacatgccatccctattttgcccttaaggagccaaccatactacagagaaaacacggaagtgaacagccagttatgaacacggccccatcaccttcctagaattgtcaggtaaatgagaccataaatgggtcagcacttcctaagctctctgctgtcatattaatttcaggacatggctatgacagtcatgttactaatagggctctgcctagtaaccgtgttcatcccagaagaatacacaaaaatgtctttcatggttcgaaacttggttagaaataccaggatcctcataaaaataaatgatgcccattgccattaagtaagaatttgcaagcaattgttagaaaataagttctagagattccagagaaatgagagatcccactggaagcttcccaagtgcttcttggaagaggtgtagggcctgaatgactgacaggtcaaacctacccaggcagcaagccagagggagggcattgcctaccaaaggaacaatatttgcaaaggttgagtggctcacacctgtaatcctagcactttgggaggctgaggggggtggatcacctgaggtcaggagttcgagaccagcctgaccaacatggtgaaaccctgtctctactaaaaatacaaaaattagcttggcatggtggcgggtgcctgtaattccagctacttgggaggctgaggcaggagaatcgcttgaacccgagaggcggaggttgcggtgagccgagatcaagccattgcactccagcctgggtgacagagcgagactccatctcaaaagcaaacaaacaaacaaaaaaagaaatgtaaactgcatgtatggaaaggaaacctgagccatcaagttcatgaaggtaaacaccgaaagtgagagttgtgaaggtatttttgctcctgtccatatgatacacagttcctttttaatctgatagataatgtcattggcaaattcgctttgccaatgacatttaagcatgaaacttaacaaccatataggcttcagactacatagacataaaaagaattggaaaagttacaatgtttctactgtctacagcatgtagactgcaagtagagtatatatgtaagtgtctttgcaaggcaaataataagaaaatagtgttttatatttatatgacaaagaatctcataggttaaatacaatgttgtttcatccagagtttgtataatttttaaatgaaaagacacatagtttagaaatgtagatcaccttttcattgccaatgggttccaatagccagggcctatgctaagtcctagggataccaaagcagaagacttcagagccttgtcctcgaagagcttaatgtcaattgaagaagataggtagagaagatagtgaatcatagggcaatatatatatacatatatatacatatatatgtatatatatacacatatatacgtatatatgtgtatatatattttgagagggagtcttgctctgttgcccagactggagtgcagtggtgccatcttggctcactgcaagctccaccctccgggttcatgccattctcctgcctcagcctcctgagtagctgggactacaggcacctgccaccacgctcatagggcaatatttagtttaatctataaatatttggggcaaatgaaagtaagttcatttccagttttcttgttaattacactcatttagccaaaggaaatgttatgcatgtaaaagttctgtctatttgatgaactctctaccagtctttgctgtgaagtaactaaaatattagcctgaggacacagatttttttttagaaatttcttttgacagtgattgcctaagtgccagaaaacatagcaaaatgctagtttttgtatcaaaactgttgcgtatataatattcaggaaaaatgtaaaaggaaatatttaggacaatcgaatataatctatttctgtaagacactagctaccaaattcttacttgttagtgacagatatcatctaatttaaaacatggtctttacttccagacattgtaaatgcttctggattgcagcatagatttcatcacatgcctaaaatctcaagtgtattttcactttcgtaacctctctagacattttaatgaaaaacaaagagtggaaaagttaggtttcacagaaggtttctaaatagaaacctaattaaagaaattaataatcatcctttgatgccatgctcgtgtgcctttttccatctctaatggaatctctgcacctagaagaattgtagcttttgcttgtgctcttgactagtaacttaatgtggcgattaagacacattctttatatatttgcatatatacaaagacgtggatgtccttttaaattatacccaccttctgcctaggctaatgctatattaaattgcattgaaatgcaaaagcacctcaatataatgattttccacatcccatttacttgttgattattaatgaatgcttcctgagttgtgttcctgctattttgtctttaagactactttcagggttttcgcatcatattcaagaggccagtcagagttctgtgcttgcggcttcattaaaattctgtcctacacatcatctgactcacactttataatctatcagaacacctgtttgctttacaatggccacgaggcagctcaaaacactgtggtatttagcatttaataatgagcacaagatatgtatttttgacactttaaattttctttagaaaagtgcatggaaaagagccaagtttgaatgaattatctaaacttttgcaatttcataatgtgaattttaaccaacttttaaaaaatgtgtacgagaaagtgccttctctctttgtcagtgaaccttaccttggctaactaggaaaggctatagagggaaataactttaaaatgtcactgcataaactaatagtgatatcaaaagtattttaagaagagtctgtgcattattactttccctatttacatacccgtctcacagacacttcattgtaattctcactctgagaggaagctgagaagcttaatgtcactgttaatatctagatatgtttataatttagtgacttaagtcagtgatgggcactgcatacatatacataaacgctcttttctttaaagtttgggcatttacaaatgtgattgttaaatggccctcaatataattgtatctatttgaaatacttcaagggagggatagggagataatggatggtctcagaagggtgaaattccttcactatattatgtaaatgaagaaacgtctcctagtgcttatgaactgctatagttttcagcgctaatagaggacatactgcaagttgattattgtaatccaacagcgttatctcatcagtgagcggattaagggagctctctcagctgaggggtctgaataagcattttcatttactccctgctgggtcattgacaaatggaagtttttatctgggaacatttaaaagcataaacagtaaacaaacctatagtttcttcccttgcctggatcctttaccagatttgtgctatcttgcaaaggctgataccattcaacctagcagtcaactgacttctgttgtgtcccccaaatagagaattatatgcacctggtgatgaggggggttgatggagtcgagagagagtcagatcttccccgttcaaaagcattcagcaggggccgggcaccgtggctcatgtctgtaatcccagcacttgggaggcggaggcaggcagatcacttgaggtcaggagttcaagaccagcctggccaacatggtgaaaccccgtctctactaaaaatacaaaaattagtcggatgttacggcgcacacctgtaatcccagctatcacgaggctgaggcaggagattgtagtgagccgatatggtatcattgcactccagcctgggtgatagagcaagaccctgtctcaaaaaaaaaaaaaattaatagtttaagttcatttgtcatcctcttctatcccttgttcaaatccctgtactcagcaatgacattcactttctgtctaatgacgccatgacaggtgacaataaagctaacttcccaaacctggatttccctctatttcatccccaaatcaaaacttacctctcatttccttcctttgcattacaagagatccttcattctttgatttgaccataagattagagaaattatgttaatgactgaaagtagactaatgtcctatcattagattgaatcatatataattgtcatttttgtaagtcaaaacaattgaatgtttgtaattgtatatggcacaatctgaaatgtccagataatgtgcacaggttaaccgatgttttaacgacagtgactggagtagctaacatctgatgatcatgtgactgttcatacactcttctcaatactgcatgcatgttcctggcagtatcatttaatcatcagtcctattaacaacatgaaaactgagactgagttatcagtccggagtcacatcatgacagtgaaagtgccagatcagtactaggctagaatttttatgactttaaagatcattttcttctttgtctccaaaaaggcccaagtgttgaatggtgtgcttgattcagctggggccagtggcaggatcttttgggaggatgggggtacagaggcttcttgggccttgagaatcttatgtgtaggcagtatccataatgactgtgtttagattcagtcttggagaagagaagtcatatgacctactatggtgacttacttcttgtaagttttatgcagcgatgttcctgtagagagagcatgaagagaacaaagccttacctagtccatatcctttcctcttttagtgcaaggcttgaatccataatgtttacccctttactacagaccatagtaatttctctgttctgacatctaacactctgtaacaaacaaacaaattttcattacattttatcctgtatggttgtctcatggagtcatatgcttaaatattatcttcttatccaggttagaactttttccaagacagaaatcatcaatatcttgtctttatttcacattttctacaggatttatcccaacactgagcacataacaggtcactaaatgtgtgtcgaccggttgatcaattaaggtctttgattctaaattttacttccacatctaccattgatccctttatatagtaggaatattaagggtactaaacacaaaacaagttctttctcagacattgaattattaaactaatggcattggtgcttatgccaaaaccatgcactttaaaaaataaggattctagatctgtagtacacatttattatgtattggagccaataagtcaacagctgaaatggttatacctgtattactttcaaaagaaaggaaaaaattaaggggctcagagatcagtgtttcattttgtatacctctaactaaagcatgaaattatagttcgctaagagaaggctatggagattctgaaaaatgtaaccactttggctagatgtcaaaattgaattcattatttcttagaaatgattttagacctacaattcacaatcaaattgtgattgttttttaaacacacacaaacatctctacacacacagtcagttcggatttatattggcactccaagaaccgatgtcaaactaaattttaagtgaatgttagttgtaactctgatacatgtttacaagacaaatcatttcagatgtagcaaatgaatactttaagatgtatttgaaaataccgaaaacattctaaaactgaagaatcatgtcacaaaatgttggaaattagaaccttgattcaatactttgtaagcataggctaaatgggacctaaacatttcattgaagttaaaattagagttaatcataccagatatttaatcacccaatgccttaatgccttaaacagcccagcaaggagcagttgaggaactgtgcagttgagttttaaagtattttgatattccctgtaaccattatatgtctgcattagactaggtctcattgagcagtacacatcaagatgcctaaaatgtagatggctgtataacagcaaacaaagtggttatgaaacagcaggatctcggcaggaagtaaagagatatctcaaagagtacctaatcaaacctgacaaatggtgtaacatcttcagatgaatgactaggcctgtaacatatttttagttaatcttcctcttgcttgccagaaacaggctcattcatgttctttcagtatgagatgggagggtaaggcttttgtatgaggatcataatgcacagaaaccagtgaagatttggtccatcatgtttagaaaagatgaaagagagggctgatttggatatgggcagacttgtttaaaaatagattgttcctgataccaaaaggttgaagagacttctgcagaatagagtttatgattcgtcattccagtgctttgtctgtgaagtgtgtggcttgccttctaggtgtgtgttcttctctctactcttcatcttttctccacgtcatggcgctgcttcctccctattcctgcttcctcataattcaacttccacatggcctctactgcttgtttgacttctctcaattgggcctttcactttcagctccaatttttaacgacttaattctctcccggtaccagttcatattcccaacatattggctcagctcaactttttccatttattctttttcctttttttttttttttttggtgccaggtcatgtttaccacaaactgcctataaatcagggctcgttcctaattaattagccaaaacttgatgagatggaggtaatagatgggtcatagagccaataacatggtcatatggaactgaccattctggagagactgaggttggggttgttattgcagaggttgtcataggcaaccatatgccatgatacataggtctcagaaataaataaacaacattcaggatatttatagccagagacaaaggttgccgaaaattaactttcagtgtcttagattaagtggattatctgagatccattgcttgaaccaataaaatgcaagtatatcactactcaaatattcacatttttttccttaaggcaagattggtcaatttttagcccttctgcataccagcagagaaagatataaaatgagattcaaattttgaattagggcatatccattgactttgaacaaataggctctggcgtagctagaattagacatggtgaaaaccactaaatttacccaggaacactgcagaaacattcatcatatacaggtttattttgggcattggtgaatcaagcttgtcactgtgtctggtgggatcttggcatagccaaacacattgccatggcattttaatatgccttctgactggttacagaaatccttattatttcatgaatgagttccagaaattcagactccatgtgttttttagggagttctgggatcagcattgagaaaaatattgctgttgtgttggagcgtgaaatttatgcagaatggaatccaaatgtgacttgaccacctaaggcttagaaaggtgtaaaacttagctaatacagcactgtgttagccagttcttcccttattggagtatctctgattactgtacaaaaattacctttagaaataaaatttaattaaaagattctctctctatctttctcttaccaagaagaacactggtgcacaatattaatttatggtatcctttgagtgctgaactctatattaatcctcaatttataaagcacaattatatttttcaggttttcttaagacctttcaaatgtttctaataaatgggttaagacatattctctttcatttctcccttctctttaaaaagtgaccagttgagttgtccctgtccaatttttaaaaatatccctactctttaatgtattcaacactacttatatcatgacaagacctttttatagttaaacatgaagtgacttaaatgttctggataaattagtttgcttagaaaaagtcctatttggagatggagttacagcatttcctttgatagattcagggcatgacaatactacccttgaacaaaaatggcactttattaaatggaactcacagtcagccttatttcaatcatcaaagaagtaaaagtaacactctgatgattatgaaaaagaggttggatgagatgtgaaatgagtaatgaacccagagtgaggaggtctgttcctcattctgccttaattatctgtgtgattttggacccctcattttctttctctgggtctttttttcccatttgtgaaatgagggctatagagtattcaatcctttaggatcttttgcctgtattatttattttatatctgatgggaaatacattctttatggaattttataaagttatcatataaaaataaaaatctacttaaaaggcacatttttatagtaagatagcatagaggaaaaatgagtgaatctcaactagattcatctaagggataatgcctggatttagagagtagctggccctgggagatggtagctattaatattactactacatcctactttgtacactttacccagcaaataggcctctgccctataaaaaaaaaagcaagtgatttcacctaggcagctatgtgtgttagtattatgtgactatcctagggctgccgtaatgaattatcgtaaaccagctggcttaaaacaacaaaaattcatttttttgcagttctggaggccaaaagcaaaaaccaggggagaagaggcaatggcctcttccagcttctgaaggctgttgtcattccttggcttgtgggcccatctccctctgctccattttcctctgtgtgtctgtctcagtctccctctgcctttctcatgtaaggatacatgtgatagcatctaggtcccagccaggtaatccagggtaagttcttcctctcaagattatacctgatcagatcttttgccatttaatgtaatagccactctgttgccacaggaggtaagatttgcaggttccagggattaggaaatagacatctgtttctggaggccaccccagttagcccactacaggtgggacagcaggtaactattgagcacgtgcatcatttctgtgggcagcaccatgcagtgctggctgatggttgcacacaggaatgtgggctccgtgttgtaggatcttcccattttaaagcaaaagctagattcgattcaattcaattcaacaagctagatttcagtgagccaacgtcaaatatcaggggattttacacataaatgtgtagacacaatctggattttgtgtctacgtgtttatgtgtaaaatcccttgatatttggtgttcgctcattgaaaaaaagagtctactcatgacaaataaaactattctatgcgccacatttgctgtgagggctgcaatgtctgaaaaacagaataaaattacctttgagagagcactttgtaaccatattcattaactccacaaatatttctttagcacctaatagaataatatttattttagattgaccaggggagagcttgccgctttcagaaaatatctccccaaatgcaactctcatagtttttcttacgaagaaaagagagcattaattagtccaatatttcctttctggaaatattgcctatgtttctgtgcccttcattgagatcagctgagtttcatgatcctggaataaagttaaaatccaaattcaaagtcgtaaatgtggtctgatccttgagtatcttggagataatggtaccccaggttacctaatatctcatacttactggttattcatctcagttagcctatgattcttttataggtaaagaaagcaaggccattcacattccatatagaccataatccctattgagtcagcatctctgaattaggccagtgtgttagaatgccaagtccttcaatttcattcattattggctgataaactgtgtatttctttaatacaaagggagaaaattgttgcaggtgcccaatctgccatcaatagccatgagactttgtacaagttcataaacaccaattttctcatctgaaaaatagggataataacaatacctacttccctatattgttttgagaattaagggggttaatgcatgtgaagtgttcagaagagtgtctggcacacagtgaacacctaataagcattagctatgccaattattttcatcagtattatctttattattaccaaacatgggtaaatatctttattattctatctcctttctctatggcagcgtttctcaaaatgtaatgtgtgtaccattcacctaagtaagaatcatgctaaaatgcagattctgattccttagatctggatgaagcctaattctgctttttaacgagctcccaagtaaggctggtgctacctatgagaagattaactggctgcatgtcataatcatctagaaagctttcaaaaaaataccagaggcataaatgtaccctcctcctccagaccaattaaatcaaagtcactgatggtgggaaccccaggtcattgctattttcgaaacagttccccaagaaaatcgaacatgaggattaaacccctctcttactacataagaatttttacacgctcacaaatgatggggtaaaaagaaatgccagttctctctattacaaattaaactctcatcccacctggaagaagttagcagcataaactgtaacacatctgaagtggtgcccacggttactcttgcaagcttcttatgggaaacacaatattttggtatttcccaacctggtgctgttaacaagaatcatcccttgtttgtgtttgttaatcagcttgatgagcagtttctgtgttgatcttcccaaactgtgttggccagttgccaaatcaagtgcataaattacacactgccctctctccaagctgctcccaaccctgcagaacatcagaaagaatttcctttgaatgcgcaaatctgtgtaagccgattgcttagactgatactttgtggggttggtctgatgtgacatgatcatgtgtcacaatattatgacactgtgatgacgtattttaatgttaagaaataatattttgaccaatatccaaatgtcagtctttttgaaaggtcagattctctttatataatggtgtttcctagagaagttatttataggtcttgaggctccacgtaccaacctaagcactctattccaagaaccaaggagcaacatatggctcagctctactgagatttgttatcataaaagaatgcatgagtgtgctggtaattccttaacaaacattaaggaaaatgagatgccaataatatggaaatttcaacatggttgacttctctttatagaagacactctgggtatcgctaaagtcctattgacctgggacctataggaccaattctaatctttcttccatttctatgtgttcctgtggtgatttctcaccaggtatccatttttaaactgcgatcattttatattctcagatcaggagctctatggtaggaatcaccttagatttgaaatttctagcaggttataaccctctttgagaagtatgaggggaaaatagagaagcaagtagtgaaacctgcattcctaacgactatcttcatttgttatgtgacttggttgacactattagaaaaatgtagcttgtattatttttattactaatattattactatcattattatatactttaagacatctctatcatctcccaattaccaggacataaatctagatagcaaatgtcttttttctttatgttatgcatattcagaaatgggtctccttgtaaatggccaacccatttaacaaaagaagaaagacctgcctaacaaaggaagaaatatattcatttatatattcataaaaataagaataaaatataaagcgcccccaatatttgcatagcaatgtctagtgccttcatgaacagcaaaaagagacctctactgcaaaatccagatattaaaaatgactaaatagggaagcaaggatatttaaaactgggataatagaggtcatctctgaaaaataatcttaagatgtgaatgcatagagtcagctacctatgtcaaaaactacctatcattatctgtttaagaaatagcacacacacacacacacacacacacacacacacagaaaagaagaatgaatattctgcaacagattgctaacagtggggtaatgagaatacatggttgtctatttttttaatgtttcataagaagcctatatcactacttgtataatcgggaaacaataacaactgtggattgacttgaagtgcaatttgtttgtttttttcttttttcttgtttacgctttgtgattactttagaatcaatatatatttttataattcttattaaaaagttattttatacatgccagtatattaatacttaagaaaaatttctctggatctttactcctaggaagttagatttccttctttctaattcctattcaatggctaattggctgattgtgccttctaccatagataatgctttctccgttagtatatatttggaacctttgtatttcttgaatgaaatctcattcagtgtctgtggaaacctgctcctgagatgttcacagatcttttaagtagagacgtaagattaaggagtcttgctgaaatattcgtaggtatatttctgagggcgtatgctgtacccttatctgacccacaatacatcaaaacagcatggagttcatttggattcaaattcaatcaatccctgtctcctggcatgaagaatgaactctctggactaaagaatctttgatcaggaattccacactctctcccaacactcccttcttatccacccctactcacctatatcgccatggagggagataattcttacttataaagatggacaactgaaactttgcattaccacatagaaaaaaagacattcttggatttaactttttgatgcaaaaaggacatatctgaaatatgacgtaggccctcatgcacaggcaagctcaaggattgtgtttgctagaactaaaaattaagaaaagaacagtcccccacccaccacaaaagaaaaaaattcagcagatatttataaagtatgtgtacaggatatcaaatatttgaacaaccagaatttcatgctatgattttttttcatataattgcttgacatcctttctaatctatcattttactcctcatgtgttgcattctctggactctgtctgtatttacactgttccgtctgcctagattgccctagcccttgtcccccttagtcaacaaatgctaatactccaaagacgggagaagatgctccttgttttttcttagagcatttcttgacctcagtgtagaaatacttcttattcacctgtgatctcataatattctgtgcatacatctcttattttttcatcaaatacattatttgcacgttatgacttataaatccagaattctgtgagggtagagaccatgaatccttgtatttcaaccttagcaaacagtaggcactcaataaatgcttattggatgaaggtttaatcatccaatagagttagggggttcttgtcctgaggagaggaagacaggtagagttaaccttcaatgtactaacaaggccgagtccatcttttttctatcagagtaactgcaccaagatgtcatgtagcttttctgaagcctctagagaaattccatcctctggtgggaaaggaggggaataaaaaagtttgagctcaagtccattaaattctttttaataaggccttacaaggtattcagtattttgctttgatagctgtataaagtcagtcttctgacaaatttcatattgcctttttttaagataaattttaattattaaagtgtccagtgaaagcctgacgatttggaggctgcgaattagggagcaatgctgaatgatgcagtgtgacagtcgtgtgcaataatgggaaatgtattcatcttagataagaaaggtcattccttccagtgcccctagctcatttggaagtcaaaatggactgtgagatttcttgggctagggatgtgcaatatttggctaaatattctacctcttgctgccagatggaagagggtactggggagctagtgtggtaatgtgaacaaagcatgggtactgcattcagaatcccagctctttgccttactaagaggtgtagcttaatgtctcaatctgcgtctgggtaatttcatctttaaacttgacatataatagcacctactttagaagtttgttgggaggcttaaataaagtcatgtatataaaattcttaccatagtatctgccacatactaagtgagctgggattcaagtccctttttgtcggtctagctatataaatggagaaaattttttaactttttcaaattttatccttccaatccaccatacactgtacggtgcttagcaaagaagatatgattatgttgaagtgttcagcgttcgtagctgctcagcgactgatattattctactcatatcttaaaataatctctgttgaactcaatgaaatgaattcccataacctcttcacatccttgtctctccttgctgtgtgtttgttagaaagacagtagccccctgttggtggtcctttgtcactaagaactatctttaggctttttgaaattctatactatatattcccacgtgatttttctttcattttagtttattcgagtaagtattgtaggtgtggtagaagtagaaagattaagcaaaatagaaaatgatttctctaatagtctgctttaaatctatatctaataatggtaaagataataatcagtaagaaagccttggcttggcttctctccttttatctggagaactcttttctcttcttcatatagtattacatattgtagatcttgataattgagtgaataagtgaagtgtatttttttttcaattttataaattggaatcttaaggttgagaaaaagcaaatcagtcagcaaatggtttctgttcaattgcagcccctctttccatctgagccagactcttggtcctgcttcagaacagtgactcttaagtccctgttgtagttttcacatttataaataaaaagattgaggtgtgatctcctggagttacattaagcccttgaacattctgtaatattatgactcttcagcaatgttgctataactagaatccattgccatgcttcttggtttagtctttcctgtattgcaacttaatgtgttcactttctgcacttaggagaactttcctgtcttttgtagagtaaccagcatatatcttaagcccagaatgtctgaacacatgagtaaatacagagtgagctgagatgaagggtaaccttgaaaacagtgaagtcacgtgtatgctcacttagacagttaatggggttctgttgattggtacagaaataagtgactgggttagcttatgagggcacaaataacaaatgtaaaggtaaattttacagattctttaatatattcccttaactctcttaagttcctaaattcctcttgtgatgatagaaaacacaggcagcaaaggttttggcattcactgtaccagcatttgtgggtcctctgggaacctcataccaacgtgtttgaagctgttgagtggaatagagaagaaaggaatggctactcttccaaaattcaattcattggggtgcagtattgtaacaagttggttatatacattatctatcacaaagaaaaatagatgttccttgaccatttttgtgagaaaagtcctttgtactaagcaatatagaatgtatcccaaagcagtgctgctcaaagttaatctgcagaacaaactgctaccaatccacaataagatacatggagaaagtgagagtgtttagaaactttttagagcaatttgatataaccaggatattcatttttctattcatttttattatattttacatctgtgacagatcggattttaaaaacaaaaatcagttgttctacagataacttgagaaagactgttctagaaggaatacagttttaaaaaatgaagaataaggaataaagctagggtgggccacctaaaaattttcatgtgactatccatctgtaagtacgagtatgtttgtgcaaactgcaggcaccctttctttagttctgtgtgttaggccctgggcttaatactttccttctcttatgtcttttaatccttgagaaactatgtgctggatgttttttagacccttatatttttggccccaaagtggattttctcacaaaatggcagttatcagcagaaagccctggtttaagttttcactctcattacatcgatcccctgctgtcaaaatgggctcctgatccaggaaacaaggttcccccagatcctgtgagcacggagccatcggcccctgctcaagagtcccagtcaggtggagccctgtgcttcgctgtagagctgttcaggaaattgacaaatttacagccctgtcgctgccgtcctttcagtggggaagcgcggcttctcttccagcaagcggacttagatgtctgtttactgtttccctcaaatgtgagccctgctggtgatgcacgtcgcaaatggaagtaatatcatttgaagcagtcccgctagaagcccaggagcaatctaactgcattaactcttccgtctgagtggaggaggctgaagagggtacaggactggactgagctgaagtgaagaaaatagagcaatacacaatccttgactgcaagtagcaggggtgcctaaagaggtttcacttactgccttcaaatgaatgacaccggggtgtcacaggacatctaatattctgttgacaaatcttgctaagcattggaagtggctgaagcagtggcttcctgtatttttgaggggtttctaatgttgtattccccccttatacctctcagattctgcggattgttgtttctgtatgtacaggaatgccctgtgctggtggttctgaaatactaggccaagaactgcaggcttgctttattgttttcagaaactgcagtctactatttctttttctaatgagcatactatcattttattttatttcactgttttctattttcccagctttactaagttataattaactaattaaaattgtatctatttgcaatgtatagctgtgttttgatatgcatacattgtggaatgattaaatcagacagtctgacacgtccatcacttcacacttatctttttttttttgcaacatttaagatactctctcagtaattttcaaatatactatgctttttgttaactacagttaccgtgctgtacaatatatttccagaacttattcatcctctctaactgaaactttgtaccctttgactagtatctccccattcccaccctgcacctctcacccacccctttctcctctctaagttcaatgttttcagattccacgtgtaagtgagatcatgtggcatttgtctttctgtgcctggcttatttcacttattaataaataaactaagattcaaagctgttggggttttgtagctttcttgtaataaataatagccaattagttatcctgcaatgggcgttaggactcagacatttctctgtccatacttgaactcctataaaccttattacccagcacgttgtcttttcacagcctgatttatgctgtggatttgattgtttcctaggtatagtggaaaaagagcatctcttaataccattcatttattcagtgcatctttacttagaattttcttcaaacacggatattaagctgccctaagtggtctgtgtggcctcatctttaatctcatggccacaccatgaggctcctgttaataccctccccattttcaggtgaggaaactgaatattagaaaaggcaaataaattgcctgacgtcttaggatcatgaaagttgttctttgtctcattaagacatttaaggtggtgttagacaagatatacaaaaagtttagttacaagtcattagaatttatatatacaactctctgtcatgcatgctctctctctctctctctctttttatatatatatgtatataaaattagcccgttttcaagttgctaataaagacatacccgagactgggtattttatacaggaaagaggtttaatggacttacagttccatgtggctggggaggcctcacagtcatggtggaaggcaaggaggagcaagtcacgtcttacgtggatggcagcaggcaaagagagagtttgtgcaggggaactcccgtttttaaaaccatcagatctcatgagacttattcactatcacaagaacatcaggggaaagacctgcccccataattcaattacctcctaccaagttcttcccacagcctgtgggaattcaagatgagatttgggtggtgacacagccaaaccgtatctcctatatgtgtatatatacatatctatatatgtatatatacacacacatatatacacacacccatatatacacacatatgtgtatatatacacatatatatacacatatacacatatatatttgtgtgtatgtgtgtgtgtgtgtatatatatatatatatatgctatcctgtaaactgtataatctaatctagatgatgtgatgaaagcaagacatgggactatagtccccaactttcacaaaatatttatccagtagaaacatagaatatgtatccaaaatatgaatgtgaaaactagaatgtgatatgagatgaactttcagatcttcctcctaaatcaaaattacaatgacctgatttggatgattcaggagtgctttgaaggagatagtatattagtagaaacttgaaagaccctcaccgttagagataggaaggtaaaagattccaggagaaatcacaggaaagcagaaaaattgaaatagtgaaagatagtatggcttgggtaaaaatgtttatgaaagggtttagtaagagttaaagcaaaacagtggattcgggtgaggaaatggataacccgaaaaacaagccaatgaacttggtaagaatgaagtttctgaacttggaggtaccatgttcatagtggttttggaaagttttatttgtacaggcttgagtacaatgggttatggcagaagcttgggagaggcaaagcatgcagagaaattggccaggtggttgtttttctttgtttgtttgtttgtttgttgtttttttgagacagagtctcagcctgtctccgagcctggagcacatggagcgccatggtgcaatcatggctcaccgtagccttgacctactgagctcaaataagtgatcttcacaccttagcctcccaagtagttgggactacaggcatgcatcaccacgcttggctaactttttttttattgtttatagaaatggggtctagttatgttgcccaggctgatctcaaattcctgagctgaagaaatcctaccacttcagcctcccaaagtgctgggattacaggagtgagccatcatgcctggttggctgttcttatatagttgttaagtaacatagcatggcaggggatgcaacagaaatggaaaggaagatctagatgtgtgatatatgaaggagtggaatcaataaaaattgacagcatggtattggagtccaacatactggttcttaactagtgttcaaactcctgtcacttgttagacttgtggtttgtagacaagctattgaacctctcagaggcttgaagaagcaacaagcttgaggtttaggccttgctgagtcactgagtgtgtgtccataaggaaggacacatctgaagcatgaaagagtgatcaggtgaggataagagctgaataactaaagatgcgaccctgccagtggtgtccaaatgtgttgataaaacccaaaacagttacttaccaagtgtcaaatgaggattacattgatgtctcatagatgtaagatctcagaggctaagaatactcataagggactgtgggtagtcctcagctgggtagaggaaaaaataaaataggcgttctaagggaggatgccaatgtgagtcaggcttggagacaagaatgctccctttgcatttcaaagagcgtgaaaaccactttaatggactgcaaaaacataagactccaaaagaaggctggggccctgtgcaaattgcctttggatttgcagatttagcaaataaaaatacaggagagccagttaaatttgaatttcagataaacaacaagtaatcttttttagcataagtatgcactgagcaaaattatcaattgtttatccaaaatccaaatttaactgggtgtcctatattttatctggcaactcgatgtggagtgccacaggaaagcatttggactttattcagcgagaaccatttgagtggtatctgagcaatggagtgacaagataaaataattcttaggataattaatttggtgtgcgggatagaggagacgagacctcgaatggagaggacagctgtgatggcgtagggataacacggtgagagctgatgagaactcccctttcttctattatcgtctgtcaacgtggatttccattctgtcctgtcactccagttgtccctcattcctgatgtcacctacatctcctgcagaatacatgatgacctgcacttcttgaggttaaaatttctccttaacatgattccttctttcttttgtttttctatctttgtcagttggcagcatgttgttaacacagtagttctaggttaagtaaaatcatcatttctcagagataaaaatagttgtctattttcttttcaaacccagttgtaaaacttgtgtgagtccaagttgggataacttttcagtctccttttctgcttgtacctctcaatgcatctcttcagaagattccagtaagatgtccacagggtacacaacataagttattgaccatttggggttggggggtatctgcttatacgacactctagccacactgtaacagaggtaggaggttagagatactcaagctcccctttgtcccttttctgcgcctcaaaggggtgacataaatacaagggttgagggaaatgggaccttagagacaaggagaagtctagcagagatgactgtggtgatgctgcttacaggaaacccaggccctgcttgaagaaaagccaaagtcataggtgagaaaacagtggcaaggagaagacacaaaacatgcagacattcactgaagactaagattaagccatgattttaatacgtcctctccaaaattcatggtgaaactttattctcattgtgcacgcatttagggagtgattcagacacgatgactacaccatcataaatggcttagtgctttataaaagggctgggggaaactagctttggccctttggcccttccacattctgccatgtaaagacacaatgttcatctcctctggaggatgcagcatcaagatgtcattccctcaccaaaaactgaacttgccagtatcttgaacttggacttcccagccaccagaactatgagaaataagtttctattctttataaattacttagtctcaggtattttgttagagtagcataaatggactaagacaagccataagaattagagctcacaaatcaaaggcaagaaatcagagtggttcataaactcaacctgcttatggttgtgcagggcacttgggtcaagggagcaagaggcactgaaatctagcttaggatccctttgccaagcagtctacatggttgcatccagtaaaaagggacagctttatcttattagtgtgaagatactctataggctagtggtgggattacaccatgcagagtgtgaatcctggcaagtagttgaaccgtatgatctgatacttgatcatcctgaacctgagtctcttcacctgtaaatagtctaataataatacccacctaggctcattctgagggttaacaagattgataagctataatatacaaaatttttatcataatgactggcatgtggctacaaataaataataaccgctaccaggaaaactctaaaaaaaaagacccaaagggtgtactaagctatttagaagtcaagtaaaatgccttgaaggcagatttaactttataaagataatgatcagcaaacttattctataaagggccagatagtaaatatgtaaggctttgtgagccataatctctcttctctatcccatatacttaaaaaaaaaaataaccctttaaaagtagaaaaatcatgcttagctggtgggcaataaaaaaaacaggctgcagactagatttggatcatgtactatagttttctcactcctagaactcaaagagaatagtagtctatgagttcagaaatttgggatacctatgattttagcatggagccaggcaacaaacaggtagaactcattacttgcttgccctaaggcctcagacttacggttgatgagagactatttgtctagttcaagattagatgtccaggtcaggtacagtggctcatgcctatattcccagcactttgggagaccgaggcaggcaggatcacctgaggtcaggagtttgagaccagcctggccaacatggtgaagccctgtctctactaaaaatataaaaacaaaattagccaggtaatggtggcgggtgcctgtaatcccagctacttgggaggctgaggcaggagaatcgcttgaacccgggaggtggaggttgcagtgagccaagatcacgccactgcacttcagcctgggtgacaagggcaagactccatctcaaaaaaaaagattagacgtcccatcccagtacaaagtttagcatgctgtacaagcacaataaatgatttcgagggaatggattgaaatgtttcaaagtttgttgaggatgggtatggtggatcatgcctgtaatcatagcactttgggaggccgaggtgggaggatcacttgagtacaggagtttgagaccagcctgggcaatatagtgagacccccatctctaccaaaaaaaaaaaaaaaaaagccagttggttttttcagctagattttttcatctgcaaagctaagagaacaatggtgtcaggaataaataaattactatataaagtgtatttattataatgctggtcacgtagtgacaataatctcatcctcatcatgtttcagtgtcttctttgtgaatatgtgcttaggaatcatttcaaattattgtgtaaactcttatcacttggtataaaaggagaaactaaaagttttaaggataggctgactaaaagcagagaaacaagaacctagtctatcaggaagagtacagttatctcagaatgatgatcatttgttcttttgttctcaaaacaagaccttcaacaaaagtcatggctttctacctctgatgctgactgtgaacgaatctgagcctttactaactctcatgacctttgtcttcttccatcttcccaggtatgaggcaaagattaaagccatagacgctccttggggaaaggtgctgttataacccacgtgggtatcattagcttgaaatgtagaaggatgaagattttgaatgaaatagagactttattaaggagtaggatgcctgtagataccagccaattcatgctgtaaggtatttcttcaatacacttcttgtagaaaagtaagtggtggttacaaagccatgatattcaacttagctgtcaaacaagcagtcagcttacaccttaagggaggaaggaaactgtttgaaatgttgcagaatgtgggacactgtaggataatgaggagtttctaatcaggagacagtacttatatccaaaacttgttagcctatgccttgcctcatcggcaaaatgggacaattggacctaacagagtgtgtgccagagggtttttatgaattgcttccaggtgaatatccatgaatctgatgatacttgaagacactgactctcataaataaatgaaagccaaatttgaaaacacatgtgtagttggaaaggcgatttcaaataatcgagacatacttatcctctatttttgaaatgaggttcagaattcagctggaattacaaggctcatcaaacactttgaacttgatacagtttaaataggctcatctgagcaaagtacagaacagccttcatttcccaggttctgtcagtcagcctgctggattgactggtgatgtcttgattgggtatgattccccttgactcatttctctgttgctggtaattaaaagctgtctagttttgttctcatttaacaataagtgaaagggtaatgtctgccagacttttccattcacttggtgtttgtaacagttgagagccttggagcaccatgaattctaagctgaaggtaactatcagtacagatagtgtattggtgttttgcacctgggagctgactataaacctcaaagccaatcggaaaacagtccccagggtaaatggataaattgtcatagatgaccttctcctctcattccagctttgaaaaacagaactttctgtgagtaggtagaataagctgtctgtcatttgcagtttccagcagtctctgagactagtgcatgtgcctaattttacactggaaggagaaaccatgtcgaaacgcagaaggcaaaataagagttaggctctctctaggctcagtatgtttagttctggttcttaaacctttcccatcattatggttttaatcattccgatcagcattattataatcacaaaatgtcagcctaagaaaacgataatctcatcgtcattatgtttcaatgtcacctttgtcaacttgtgcttagctatcatttcaaattactgtatcaatgctgcaattagatataatttgtgatatgaccagcattcacaggtgagtagtttaaaaaaaaagtctcacaccaactgaaatactttattattataggtctattctttcagaaccaagtatgtttaatgtgtgctttcatttgagaaatatttcaaatcaaaatgttacattttaagaatacatgacttaatatttatgacttgaatattataactgtgtgaatttgaagcactgaaatctcccattctctataaattttattattaagatggcatatggaggttttttcaggattgtcctcatgcatgcaattaatgaaattcaaatgtcttttttttaaccagtaaaagtgcttattgaaattgaccattctgtaatgacttctactctttcattgcacagaagcataggtttaaaatattttccattctgttaagttttcttttaaaccaagataagattaaggtataagaaaggaagagaagtgatgatttggagaaaggtttcctaccttctcttacgggaagatgagacctaggtttaaaaagtaggactggttgatcaagcataaaagtgatttatgaaatatgacatctctgtaacattgagaaaaaaatgttttccttcattgagtgctttcttccatatgcaaaatattgacacatccctattatatcaaacaaaagccttcattcagagagataattttatagagcggctggtatcatgtgatcttattaatatttatgaaatatgataataatatggaaaagggggaactggaatacagccctatctttctagaccctattcatttcagcttcaaaatgttttttcatttcacacatcagacgctaattagcaaatatctaattagtgttagaagattaatcgctcatgggagttgttgaggctttgagctttcatgcatgcaaaaacagtgccactttaggtgcatttgttaaggtacagtaactttaagtgatacaacttttatttttcttcgaaaaatatttaaattacatcgttggagtaaatttaggctcaagcaacaaggaagcaaggaacacacaattgaaaaataaaaatgacactgtggagagccacatattcagtcaaatctccaagtgtcaggcaagggtctactctgttttaggcactgtgggaaactatcacaaatttagagaatcatcaagtacagctcctgatttgcagacacttagggaattaccataggggatcaaaatccaaggactccaggccaaattcagccagacatgtgtgtgtttttgtacagctgtaaactaagaataggttttacatttttaaatcattggacaagaaaatgaacaaagaatgatatttcatgacacgtgaaaattaaattcaaatttcagtgtccataaaaaaaattgtgttggcatatagccatgctcattcgtttatgtactgtctgtggctggtttcacaccaaaacagggcgagttgagcagttgcgacagagaccatatggaccacaaagtctaaaatatttattctctggccctttaaaggaaaaatttgccaccccaaaattaaagataaatatctagatgatagagcagagcagctttgggagtcaggtagagccatatcagttccgtagtttgttacctgtgtgactttggcaggtgatttaaaatttctaagcttctatttatagtgtagcaattatgaatctcttcatagatctatagaaactgaggatttaaagagttgaatgggattacttacacaaagtacctcatctgttttctgacttatagtagataaagagtaaaagtcactgccttggcccccatagtttccaagatacaacataaagttaggtttctttatgaattctccctctcaccttccttagaaaggttcctaaatggaagggcaagtggcccagaagtgggaacggtactatttttcacctgtttcatgaataagatggaaaggggataggtactaaactaaaatgatctcactagagatttgtgcttctaatattataggactttgtccccatcttgtccccaaatgcccttaagcatcaatcccttcttctaataaaacctgaagaaagtagctagcaaaaatgtattgttaatgcaagtttcaatgatgttgttcttattttttcactcgtaaaaatctctgttcattccaaattcctatttacaattcatagctgtcagatctttcatttaagtacacacatattaaatttattgactatatcctgcagagttaatgatgggtaactcattaaatgccacggggagtctgtagtttataagtaaaaaagaaaattttagagggtgaggtgttttttgagagagaggtttggagtaaattaaaaactttaaaaattattctacaagctgaaaaatctctgtttcaaagcagcaggaattttaatcaacacacacacacataaagagagatagccgtctcacttcagtgttgtaaatagtaggactggcttctagaatcaatatatctgcactgaaatttggtcataattcaaattgctttaagtgttctttggagacaagaccaaaaactactgaaggggtttaaagtgaggtttaaaccaaagatattacagcctccaatgtatctctgatacctccaaggagcattaattcatttcctctgaaacaatgtgcattaggaaaatattttgaaattatactgattttacatgacagatacataaggcaataatttgagaaataaaatcacaatcatagaaagcatataatcatattcctgaaatataaatagcaattgctttaggggattgttagagttggggcagaacaagaaaagctagtgtcctgaaagtttaatcaatggtcattgactaaatggtcatgccgccattttagtcaacggtcactctgtgtactcaacatgcctactcagtctggaagtatcctgggcagtgggcaagttgtattcagagaagggccagacatggggaatgaccttgaatcagatggaaggatttgccaccaattgcataaggtaagccagaagcccttgaggtctctcaccaggaggttttccctccaccttccaaaagccagaagagaaggaagaaagaaagtgattataacaaaaaatgccataagtcagtcactaagaaggcgctttgtattgaagagaaggatggtttaacacatacctttcaagagcttctcttgaaaacaagtgaacttcatgaagatttataaacatggtctgcccctaggagctcaccatcaggtctttccttggcatgtatgtatctgtacatcatgtgaataagaatcaccatgaatgggggtgttatcaaaagatacagataactagattgtctccctgtcttcctccttctgaatccatgaagggtcaagcccaggaatccaaatgttagtgaacctctcaagtgattcgtatctacctttaaatgtgagaaaaatatccctgggtcattgccaaatatgaaaaacagtcagttgcatagcttttgtattgtcattactggttccttcatacataaaggcatctctcatgaagtttttgttgtttttcccccaaacaagaactttacctttgccaaccattgtattttctggttttttttctgtcaactacaaaggatttctacactagaaattcggaagattttataaaaccaataatgagttaggagtcagccacacaagatggcctgaataactggacgtcacagttatttcttgctttggaccaaaccaccccaaaacttaggagcttgtgagtcaactgagcaattcttctgctggactcccctgggatacgtcacatgactatatttgtctccaagcttcagtggagcctggttggttctcaacgtgtaatcacttgaccagcacaatcagtatcacctaggaaattgttagaaatgcaagttctcaggtgccatcccaggactactgattttaaaactttagaggtggagcccaggaatctgctctaagctggcttccaggtgattccaatgctcactcaagcttaagcacttccgtttagagagcatcggagggggtggtactcttatcatcctgcaagctaggctgagcttcctcaaacggtggtaccacattccattgggctgaaaacagatgttgagatgcctcttgagacctaggcccagaagttgtcctgtgtcatctgtgacaccttctattggtcaaagcaaatcacaaggacagttttaattcaaggggaagtaaaatagactctttcctcttgagaggagtggtgaagtcacacagccaaggtgcctggatatagggatgggaataattgttctggccaccttggtaaacaaccttccatactgagtaataatataatagacttaatgctttattctcaccaagattccccaatattttcctaaaggatttttctcttctttgcaaaaacaatgcctattttatccgttttatagagcaactgcaacaaagtaacacaaactgggtgtcttaaaacagtagaaatttattttcacatagttctggaaggctggaagtccaaaatcaaggggtcagtttgaccatgtgccctttgaaatctgtaagagagaattcttccttgcccctttctagcttacggtgatttgctagcaattcttggtgtttttctggcttgcagtcgcagcattccaagctgtagctcttgtgtcacacagagttccccttgtgtatctctgtgtgacattctcttcctgtgtcttaacatcatcttcctataaggacataagtcatgttggataaacatggctatgtttactaatccactatgaccttgtcttattgaactaactgcatctgcaatgaacctatttccaaataagatcactttctgtggtactggggtccaggacttcaagatcttttgggagacacaatttgatccatagcatctacctggatttgagtcatatggctgactgtattttatcatatctgaaatcaagaagtaactgtactgggaggaggggcggattctaagacctctactcacctctgaagtcaccgcttggttgtgtatggttgaccctcttgtgtgaatagatatataaatgtttgatggtttagtaatcttctggacatggggccctggagagaattatcagcacagaatgtgatacttacgtgggctatgatggaaaagccacagaggatggtatcttcctgagctctgcattttaaagtatcctattacatagcatgaaaatcacgcggtgccatttagcataataataccaggggcacacttaaaatatcatgttatagcttggaaacattgagagctacaatgggatttcaattgtgtaaagggatgtttttacatcatcttccctggaatttatcaggggcacttttattctattatatctctagtgtaatgagactcatgctttttgaatgtttagaccctgcctatatatgtagagtttttgtctagctatatttatatattgattcattaattcatctacttattattcatttattcatccattcatcattcacgctttcattcaacaaatgtgtactgggtgcccctcctgggagacagacactagggagtcagaaataataaaactaattccttccctcatggagctgatattctaaggagagatacacaattttaaaataacgaaaagcaaaaatacactttcaggcaataaaatgtactatgaagtaatatgtgtgtaattggggaatagaattaacatttgtttgaataactctaggcatcatgtgaaggtatattctgtaagggcttgttttttttaatatagcagcgtccaaatacatagttcactgtccctgagaatggcatggttactgctcagtgacccttttcaagtcattgaaaatattttctatttgctgctgatctatttcaataattgagcttgttgggacagctgttatgctatgtaaagagcggagattttggctcctgagaaccctgggtttgaactgaggattggtggtttggttatttattctctctgagcttggcaaatgtccctactaaatgaacataatactgccttgttcttaggttgtcctaaagcttacacgaggtgacatatgtaacactaccaaccacaacctccatagataactgcttaacacatatttgtacacagttttctctgtaatttcattcaagcaatttgggctttttggtggtcttctaaaatggccacttttaaaaatagtctatgaaaacagatcagtcaaagatcctcttctctataatgatattactcaggcacctgcacacaatgaaagtccaacattaaagggcagaatcttgctagataaacatgttttttaaaagatttaattgtcacggctcccaaataaaataatcgtggttaatttttacatcttcaaacacgtatgtatggctttctgatagtgcattatacatcaaatacaataaaaaaggcattaacaaaaaccacttacactaaaatctgatttatgctttcacataagatacatggttttatgcttttatgggtacatccaaagtttgtgaacttttacaaagccctatttaaatactctgctctaagactgcattttatcttcctaatttgggcataataatcttaattatatctactgcacaggctgttggacaaggttccttttcgtgccctccatgagtaaatttgaccatacgtacagacttgacaggccatacatacaaatgatagcaataatattggtaaggaacaaacttggcagcatcgtatagaatgcatttcaaagtttagtaataatgatttgcaaataataacatagttctttagaaaaaagttattgacacttatcacatatgaagcagctcattcaatgttcagaacactcattcgagtcagaaaatattattgtcattttatagatggagtacatgagacccagagaaattaaataacttctccaaattcataggctagaaagtggtgaagcagaggtttgaactcattattcttcctccagagtttatacacttagctgccatgctgcgtggaccacctaatggagaacacatccgggccaagttattcatctcaattgttgtggggctacacatagcatgtcttctttttttgtttgtttttaatgatcataagcaaatgcctgactttcaaattattcctatattgaatgagtcattgtctactggaattgtctcccataaatggcatgatctccctaggaaccttagactgtgaactttatgctgctgagctttcaatcctagacctgaaaggaaatctttaatcaagaaatggagtctggtgcctcagtgagctcagacctcccctcgatgactaacgctaagtctttgctcactgctgaactgaacattaaagtgacagaaggttgcacagaaggtaaatattctttgcgatgtaaacctaaattaggaaagagagggtaggattgatcgtgaatgggtgcctgcatttgatagtctcatgatttaggtgtcctacggagagagggttggcagcgactccagttaaaaaggggaggggatgctccgcaaggcagaaataatgacaaccaagcatcagatattccatgggctcttggctttcttccatgctcaaaagactaaactaacctctcggtcaacttcaatgtgctaatttacaacttaacactcttaggccatatttctgtccctttccccataattgacacctcaatcattatgctggcctcctctcctgggcactctcagtatacagactctgcttatctcaccttcaaagtggcagtcccattgcctgcaatgatacattcctaacatgtcagcccaaagcacagagttattccagtgcgacttaaacttgaagtccactttttttgatagaccagcatctgtctggaagtggaatcttattattattattattttgagacagaatttcagtcttgttgtccaggctggagtgtaatggcttgatctcggctcactgcaacctccacctaccaggttcaagcgattctgttgcctcagcctcgcgagtagctcggattacaggcacgtgccaccacgcctggctaatttttgtatgtttagtacatgttggccaggctggtctcgaacacctgacctcagatgatccacccgcctcagcaccccaaagtgctgggattacaggtgtgagccaccgtgcccggccttggcggtggaatgtgaatacaggtatttgctctgcaggatccattaagagcagcggcacatgaagggcaaagagtggttttggcattacaaatgcttctcaaccacacttttgtttttcgaaatattttgaaatgtttatcttaaatttatttctttttaatcataatggagattcatgccaaaatacagaaactattttgtctataaatgtggaatcctataatagacagtggagctacccggggactttagagtttgcacagtttaactttctctttacagatgtagaaacggaggctcaaagaggtcttatgcctggtccaaggtcacatggctagctgagtatagcctcataatagtccctaagaactgaagatgtcaaaatatgcaatgagctcgttttctctttgcacatttaattacttctatttttctgttttatcacatgtccaacatattcttcaacccttcaatttaagggacaaagggaaaggtggagacaaggataggaataagaacacattggcatctattaagatcatttacaccaaatcagaaacataaatataatccatcagggcactttctcgtagcaaatcaaggagttttcccttaagtaattataaaacaggttaaaggaataagaactctggtcattcatcgattcttgatttttattcccagacttatcattccccaggatgagaggtttgagagaatagatacatttgtaaaatgactagaataattttacccacctcagggattcagtgagtgtttaataccataaaggactttgagatagtcagatgaaaggtgctttagaaggcagacatgattactggattagaatttcagagagtgagaaaggactcttttgtgttgacagacttttttcttattctttttgcagttctatagtggtttaaaattttttctcctaccaatttcttcaatttcagatcatgtccttgacttggtactgctctcgtgagaaggaatgtgtggttggtgtaaactgtctagctccctgtacattttttttctaataagcattttagcatctttgaattcacaaagctaattttcctcattttccacagtggcaatgtttgtaaagcacaatgaaatcacctggggacagtgttctttaaggcagtatttattacaggtcacagacacacacacacacgcacacatacacttccctgtattgaattgtttggagaccacaccaattttgtttcattctacaagggtttccataatatcattaatctctctcagctcttcaagatggcctcttaccatattctgtcaaaaaacaagatatagaccatttactttaaatacctaaaaataaaaatgctgaatcaaatggttacacatacacacacacatgcacagacacacagagctctctaatgtatttttcagttgttggaaatctgtgtgcattgggtggggggagcaatggaacttgcagtttattgagagtgaaatgttctattgcattagttgtaaaatgttctttgctattaaaataagtagtgctaattaataatcctgcagaattgtagagcagcctttgaactacaagaatagattcttaatccttagtatcaatagcagaattctccttctcctttctctctccgtccttcctctcctgcctctcttccttctttctagaagtatctatcgcaaaaatactgtgctaggaactgtgtttgtggtggtatatcagctcagccaatcgtagcagagcaatcttatggacctcacccaggaatgaatttcaacatatctttggtgtgaaaagactgaggataacaccaaccccgaatctataagctttgttttattttatgtgaaaggcctttttttccctcttggtcactcctgtactgtatctagtacacttgaactttataaggctaatgaaaatatctgtgtcctaaaaataaaatgtactggctccaaaatgaaaataaaattacaaaatccaagttaattaagtttgattaaatatctactgaataacaaaactaacatgatatcagctagtcaactgctatccaagtcagctgttatgcagttatatataaatcagatatttatacatcttgtaactattagatttctgttttggcctaatatggaggagtggggttttttcaaaaagaagcagcctaaaaacaatgaggacctaaagtgtccctcttcagatgcttttgttttcaaacaacatctcaataatggcaatggagatttgatgtatctgtaccatagatttaaaaaaagaactctacctgttaccaccatggggatggaggttattttatcatacacagtaactttgtgatgtgttagctgttttttgttttttttttatagtgtgaatacatttccttctgctttttctatcaactaaaacgttgctgtgagctgactttcgttccattatacttctatgcattcatggattcctcctttaaaactattgccaggtgttagcatcttccctgagtaatttcaggcatttcctttgaatgaaaatggctcacttggaaggttgtgaaaggcataaccatgtggaattgagaggattttgtgctgcgatgtggtgagaaggcttgccagaaattgcctgtttcaggctgatgatgcaaaactagacatctgttaaattaacatctacctaacgttttgccttcagtcaaatgcattttttaaaaaattaaatctctcccactctcttcactttcttttttttccactgtcaaaacaatctgtcacaagatatttaatttctgtgtaatgggttacttaaagaaaccagcatatggtgcagtgaatatacctagctacaagctagaggcaaatgtacgttctgctggttcgctgtactactgaagcatattgtgcccagcatagatgttattatggtgctggattccctgagcgctgatttacattagtgccagtttctcacaactcttgccttttaggatcaaaatattagtataaatattcttgttccaccaaggagtcagaaatcactttcgactttggttaagtggtgggcgtttatggctctaacatttcagggagggagaaagaggaatctcattatgcagacatcttcgcacacccctcctgcatccaagaatttgctaatagcagtcagctgatctgtggcctggcagtatgttctagaggagtggaatctttcacacacttacactgacaacaccccggacaccgcgtgcatccctgcaggctagagtactttctacacaattacctttttttttgttgttgttagtgtgtgtgtgtgtgtgtgtgtgtgtgtgtgtgtgtgtgtgtgtgtgtgtgatggagtgttgctctgttacccaggctggaatgcagtggtgtgatcttggctcagtgcaacctccacctcctgggttcaagcagttcttctgcctcagcctccaagtagctgggactacaggcatgagcttccacgcttggctaattttcgcattttcagtagagacggggtatcaccatattggccatgctggtcttgaactcttgaccttaggcaatccacctgccttggcctcccaaagtgctgggattacaggcgtgagccaccatgcccagccataaccttctcatatagtggagttgtcttattgataggggaggagattctaaagtccctgtcattatggtgatgagagattaaatataatcaaaattacttatgaaaatcccttgagccatccatgaagtatgtgtacctccttgtttagtaatgcatgtgtatttatatatggtaaagtgtaaagtgcttattacgtcagaaaatagtgttgactatgtgtcaggcccttttctaggccctgagaatgaagcggtgaacaagaaatacaagattgctgttgtcagtgcactcactttcccatggaaagagacccagtaaatgcatgagcagtaagcaacctgaaagcaaaacataaggctatagattctttatccatctgcccgctcatctatctatctatccattcatccatctatacatctgtcaacagtaaaccataaagaagtacatagtaactgtatgtctttgacactaaactcatgagcaaatccataacaaaatagaagtgtataggttattttatttctccataacacttaaccaatctctctatatggatatatacacacacatacatacatacacacacacatacacgcacacacacaaaaataaacccataaaatataagttttgaattatttaatctatctatgtattcatttgtttatttttgccaaaagcctggcatcaattttgtgtaagttggacaaacttactccattgtgtgcctttgaggggcacagtgttcatatgttaattcatttctatgtaatttgaaaggttcccagattgctccttattgggacagctaaaggcaatctctgcagtacttgaatcatgaagtctcccaagttggtgttgacttctaggctactggtgagggaacaggggaatgtgggtgaactccttcaagccaggcagtcacagaagttaacagctccttggcaattgttctcaaatagttcattccctgaacagctaggttgtgggttttctggggagaaaaagcataatacctgcaataaatcacttaagtctattacttattaatcgaaattctcaagtgtcctgaaaagtatctctaggccattgtcattgcaaagctatcacaaatgaatgagctaggcaaggcggcaaaattcttggtccacttgtaccaaatagcctgaaatagctgtgttattaatcagaactccataaaatcctaaagttcaagctgcataaatatactcaggtgcacgttaggcagagtcaagtgggtgctgtagtcctttttcagtacatcagaaaacttcacttgtcatcatttgttttttatttagtattaattttgagaacgataattctttcccatgatttttaccttgattctctggagccactaatattcatctaatatttttgaaacgcttcttaggaagccaccatatttagtcaaggctgaatgccactgagattactaagaacaaaagatgagctcccatccttccccccaacccgccgcccacaaaaaagggattatgttagcattgtgcagacacctattgacattgtagcctggtaatgctaattaccactggaggcaatgcccatcagcactggaggagtttgctgctttgggcatggaagatgattggcttgtctgcaaagcctggatcataggaggtattccataaaggtgtgttgcgtatatgactgagatttcttctctttctgtctctagggacataaaaagtaatagataactagaggagttacattcttaaacatcctaatggcattgcccctcatggttgcatgaactttcttcatttgacaaatacttagtaaacacctactagctgccagacactatgataggtgctgatgtgcaatggtaagttaataatgaatgaatgaatgaatgaatgaatgaataagtgagacatagttcttgtccccagaacagaattattgtctagtagagaagcaagacattaatcaaataggcaaccaataaagacataattacaagctggggaaaatgctttgatagacagacatggttctagaggacacacagcaaaggaaactgatgaagcttgatgggatcagagaagatttctctaaggaaacgagtcatgtgctgaaactaaaggatgaagaatagtgaactatgtgaggagcagggaagaccattccggacacataaagacatgagcactggctcaatggtgacagggagcctacagttcccaagagttgacagcaggtcagtgtgtcaggaacagagggctgggaggagggtagtataaatggggctggaggggcagcaggacctaaacttttgatagtactgtgtcagtaaatagcgctgatttatcaaaggccaactatgaatgtataaacaggtgtcaaagagcaggacagcataggaagtcatctactctcacatagcgtccagatctgtgcctagctctgggctgggtaatgagacaaggagatgggaactcagagctttgtattcattacaaactagagtggtggataatgaaagctttaagaaatgttaagggaatcatggacgtcatatgtgatgaagaaaagattgggggcgggggttggaaagggctttcaggatcagcatgccttctgcacagctgaatggtgcctggctaatttccctttctaatgagaccagcacaaaatccatccatttagactattcagcttttaggtaaatggaccaagctgttggggtagaggggaaagaggggttgacattgatggatggagttaaataccagagtcccctccttcacacagacttttctaaagcagtattgtgatagaaagacctagaagatcccaggtgggccaggcaggctggacagagcccagtgtctccctgagaaggggaggaggagggcgagatgggggtcttctgtcagcatggaagggtcctcttcaggtctcacaacataatggcacatggcgaggagtttctcaaacagggcttgattctcatgggaagtgtctggggatcattctataggctttcccctggcacaatttaattttttgtccagaattcccaccacagcaatatccattttctcacttattttgcagtaccgccctccaattttatggacaacaaattgtgatttatctagactctaaaataggagtgaccttgttctggaccagagcaatggttaaattgaagtaaggaaggttaccatgccttggtgcaatagctagctgcattatactctaaatagaaaagatgataacccagccagactccttggaaagacttgagcatatgtgtttttaaaaggagtgatgattattttcattcattttctgacacttgttctgatcagatgcttagattctgtgacctcacgatacagtgttcatcatttaaaggagtccaatggcaaaggagattgtgggttatagtcctgctttgagggtagatggagcagtgacaggtacattcagagctgtggatacttagctgtggagaaaagacacttccaatggccaccattctaagcgacttttatggttaattctcataacaacctcagggcatgtgtactgctattttttgcactttgcaggtgaggatactgaggcacagaaaggtgaagtaagttggccatggtcactaagctggtacacagaggggctggaattcagacccaaccagtttgaccccagggcctgtattcctaaccactatcagtgtgaccaagaagtggattgggccaagagggtggcaaagataagaaactcaagagcagctgtttactttcaaaggagcttctctctctctctgctcctcctcctcctcctcctcctccaacctgttccaattgctcagagtagacagatgcttggggggagtgtgagtaggaaagcaaagaaaatccttataaattaattttttttcaatagtcaggattaaaaacacacatttcccatcactcatctctctggaaagcaatggtaccaattgaagtaaacactttcctttctgccgcagcacacagtcatgcgcgtgcacgcacacacacacatgcatacacacatgcacacacaaacacacacacttgtttccattggctcttggaaaagcatttgcagctctgtctactttctcagatctacctaatttggggctggctacgacaaccaaacacatgagctgctttctgggagatctcagcagtttggccttaaaaatagttttgacgaatgaattttaaaaagccctctgagaaatactgaccaactgcacctttgtgtttaacatttgaagcttactatggtaatttttcccttttctttttgctcatttatatgtttcaaaaattcatattcaatattatatttaactcaaacttggttggataccctactgtccgttaaaccctggaaaaacatctcacttgtaagttattgtcttctcctcactgtacggctttttgtacaacataagaagtcattttccacctcatatttggagatttggccttccattcatggagggattgctggtatggaagtcgctagcttgtgtcacctgtaggaacgaggggaaaagaatgtgtaagtcagttggcatgttctttccctaaatcccctagagacaactcctccatttgctactaagaagaataaatccctccctgacatgttgggtctgtaactctcggaatcagtaaacacagccaatttcaatctgactgtcggtcgtagcaactaaattctgggcctgctggagagctccaaagctgcacggcaccctctgaaatgagcttggtcgagccttttcaaattccataaggcgacaaagaaacttcaacgacatgattgcaaaaagaagatagaagagaaaggaaccttgctgttttcattaaagtgagccgcattagttctcaaatcctatgtttggggaacccctaatggttaaacttacacaagcagaaggaaaataaaatgcccttattaaatttcctatgaacatgttaaatattttccctttctcctgtctccatgtcttagactttgagtcattttgcctctgtcatctgtttccagctcagttgagttacaaccaatcagatatgaggaaaattagattttaatggaatatttgattttcattgcttaattgatttaattgcaagtttctatttcagactggaagaaatgcaaagattttcagtcaaatgtagaaaagctctcatttttctgtgttcaacaatgacaaacttaattcaatggtagcctggattctaaaactttagaggaaggcaataatggcatctttctgaattgttattctaagtctacagttcagtttctctttcatatatatgtatgtatacttacatatatatatatatatatgtatctgtcacatcaaaattcagcgtgtacgtttgcttattctagttgtgttgattttgattttgggttatgaatttttgtttgtcagaggaaacaatacatatgtacttatgtaaacccacactttgtttccacgggcacttaatgtcaccaaatatttccttttgttgctaggtagaaagacagcttagagagatagttctctagccaccatagtaggtcagtggacttttctgagctcgcttagaccacccttgataagtagaattcagtctgtgtcaatgcttttgatgtatactggctgcctaggacattggggtgagaagaatccctgggagaacatgcaaggctcattcaccaatgcggagtgcagcaagtaccccccatcccttggtctcacttgtattttaggtgcccgtgttgatcacagcatctcattttccaaagggtcttctcacagcagtgggacagccctgcatgttagcacagtttctgaattctctgaactccttataatgtcaattagggattctaccagaatgcacatttctttatttaaaatgttaagttttttattgtttgtttttaatctttattggctttgggaaatttaagagttttctaatcattttgagagagttttctaatcattttgagaaaagcgtgtgtgcgtgtacacagaccattggcatgtgaaaatttaattatggatgatccatatttgaatttcttatcaagtaccttatatgcttctttgtgagtttttaaaatgtggaatataattttaatataaaaatcttagcctattgtgtggttatgtaattttcatcaatattcttaccatcacgattgtcaccatgatgcctattttgtggagacttcctcttctacaagggtaggaaagcaaaaaagctaagagcatgagctctggagatggattgcctgtgttcaaatcccagctctgccagtgactcattatgaaatttcaagcaagttacttttactctcctgcatttattttcctcattcataaaatgggaataataacaaggcctagctcacaaggttatgtaacagtttaaagaagcaatagatttaaagtgcttggaagcatgccaagcatgtaggaaatgcttgataagtgcactgaatactactgaggttataatatgagcccgatcctagcctgagactgtacgtggcttatttcacttacctcagtcatacccagtaggggggtgattctgccctccaggggacattagacaatctctagagacattcttgattgccatggcttgcaagatgctactggcatctcgtggatccagggaggctgctaaacatcacacagtgctcaggactgtcacccacaagagagaattatctggcccaacatgtcaatagtgctgaggttgaaaaaaatcttgatttaatccatgaagtaggaaatgtttacattatactcattttacagaagagagtatttgaaccttggagaaaatataacttctcatattgcagatttagtaattggaactgctgtgcaacaggcttttggagcaggagggtttattttgtttttaagataattgcatagaagatcttctaaaagccgtgaaacagaaaccttcagtgctttttggaagcagaaccactaaggaatgggttcaagcccgtcagaacagacactgtctggagtgtggcatcaggatgctagaagctccagcctgtgcctggtctgactttgaattttctggatcctggggaagcccatgaggcttggccacagtcccagggtggtggtagacactcccaaggctgaggtaggctttgtcttccaatagtcacagaagtttattttaatattttagcaactggtttgatcattcctgagaagtacttcaaacacataatttcacagatattgttacttaagatgaggccaaattgaaagtataaaaactgaaattgtctaaagcaagggtccccaaccccccggccacagaccagtagtgttaggaacccggctgcatggcaggagtggcaggtgagtgagcgaagctgagctccacctcctgtcagatcagcagcagcagcattagattcgcataggagcatgaaccccattatgaaatgcgcatgcatgggatctaggttgtgcatttcttatgagaatctaatgcctgatgatctgtcactgtcttccatcaccccctgatgggaccatctagttacgggaaaacaagctcagggctcccactgattctacattatggtgagtatgtaataataatagaaataaagtgtacaataaatgtaatgtgctttagtcatcccgaaatcatccccaccaccaccatccactgggtccatgcaaaaatggtcttccatgaatccagaccctggtgccaaaaaggttggggactgctggtccaagggaaaaaaaaaaaaaactgagtacatatcaattaggtacagtcagcagtaaaaatcatcaaggtataacacaaatgattcatgaatggggaacactttatctcagctagcccctgaggacaggagcaacagtgttgatctatacatcccagggcctggcacatagtgggagcttaatgaatgaacataaactcacaatcttactccatcattgtgcaatgcagtttgaatggttgtgacacccataacctcaaatatatacaattcagacctcccacttcatatctgagtagaatatggcagtagttggttggttgcacttctcagcgtctcagcctttgtattaactatggtccatctctacatcccagcaaatcatccctccgttgtgtccccctgcaatgtggatggagaattagctgaatatgcccagaaagccaagtgactcaaaattcatccccttcattctgacccccagtcaaatccagatgtcacaaaacagtttgtgatctgtcatggtcactgtggactgggtgaagaggccacaaccattagtggagatcagttctcaaaccattgctttaggaatgtttattacaggacttggtttctgactttctgagcacagctaaacaaatggtaatgcagtttacagtcctcagaaccatcattttaatagtgatcttcactggattaaaaaaatctctttttgttcttggcctcccacctgtagtttttttccttgttaaatacatgcgtggcccattgcagctccacagccattcatatctcagtgcctgtaggggtgggagtaagggggcatggagatatttcttatgtatcccatatcatagtattttggagagaaagaagtcttctcttccaaaagtatgaaactgttcatgagaatataatgtgtttgcagaaatcagttatgttcaatgggtaggtgttttcgtgcttcaaattaatatctgtcctttaaaaatagcagatgtttagctgtatatgtgggtggtcgacaaatgcaggcactccacatttgctccaagtgcagggctgacagacaagggtggctctcacgaccaaggcaatccccacccctcctctcacccctcccactctgtggcgatgcttccttggcatctcagatccgtactgttgtgcctcacttctcaaatgcatggaagctacacttcccagcacagtaacagtgacctgcttgaagtgaggtcttcagaccagtgccatcatcacccaggagctggttagcaatacagaatcccaggctccagtccacatctactgaatcaaaacctgcattttaacaccaccccaggtgactcttgtgtacattgaaggctgtggtcccagagcactccgtctctaacctctttagtctctcttactgcattttaccttttattacctatttctgtattatactcttcattttgcatgcgacagttgagggcaagcatcgccttatttttttttcttagatctgtttagcatgtaggtgattttcctagcacagtggtacttgatcaactcctgaatttaatgcagatattcggattataaccacagggagagtggtagtatgtacaccagaaagggaagagtgccacctgtaagggagctctgggtttaggcatatttgactcttccacttcacagctgggcagtcttgagcacattatttgtctcctctaagcctcagttgccataactgtaaaatgcagatcataattgctatctcataggtttgtttttaggatcaaatgggagcaaacatataaagcaattggcatggtgctaattggttcacagagagctctcaagaaacattagctactactatatgaattatcatttcagccagtaggttctatactatatcataattccaaaaagaacatccccacctcaactttaaaaaattaccctcatagctctcaactggggttgattttcctccccaggggacagttggcattgcctggaggcattagattgtcatgaactggggagaaggtgggctgtgtgtatctagtgggtagagttcaggaatgctgcctaacagcccgtgatgcacaggacagccccacaacaagccatgatccagcccaaaatgtcaatcatgccagttgagaaatcgctattatccacagaggaactgaggtaagcaaaatcaccattttttcttgaggatttaggtaccttggtatattcatcctctcaaatattaatgttgagcccttttgtcagaatccatctactatgaggcaaatcatttcctttggtacagaatcacaccctggaaaacctgatgcaacctgattaacctattaaaggtcataaaacaataacaattacattgcacatttcattctttaatatcaaagagagctaggttctttgaaatgtaaaacatcataagtgaaaggatagggcctgcaattcccccaggagcccaaggtcattgtataaataacattctggttcccctattaatttcactccattctgggatgtgcaggaggccataattgttagaggaagaggagaaggctgaacttttgctgcccatgacggaggtcagacagtgtaactgtggtccgtggttcaaaacagttgcccaaaatggagcaaaataaatgtccttacagctggtagaaagatcaagatgaaacgtctatgttgtttttcccttaaaaaatcagagatgctgcaagagctcccaagaaggtattaatttcccaggtactactgcaaaaataagggtgaggaggcgagtgttaggctttattcctgctgtgaatagattaagcagacaccaatttacacctcattgttaagagtaacttttttctgcaagtgagaccacatttacatcttttgtaattaagctaaaggaattttttttaatgacatttcccctaccacaaatcatgaagtaaatattttaagtgagatcaaatgctaacatgtatacattagaaccgtaaaaataaaaagagagacagagagacagagtcctagcgccacctttcagcttcgtcatttgctgggctgggatagtctctgtgcctgttggtgctttggttttggaaaaggccgggtatgactaagtgaggcagttaaagagatggtgagcgtggagggattcgctcttggaagggatggctgtgccagcttccctgaaagcaggaggtatggcagtgagttagtgagtgctcccagtcattcagggcacaccatccatcagcaggagcgtgaggctgcgatggcatccatccatccgtctcctgcatgctttgctttttggcaattttcgtttttaggaaaattgaacatagagagctgtatattaagagctctaacatcctttattccccacacaagagaatctagttgggcaaagaggcattttttccccctaacaatagagtttgcatggctgctagaaacaatacaattacggacccagataataaataattgcagaacaatggggagaatgaggtgtgggcaaggaggaaaatggatggtttcagataagatttgcacaaagattgagttggtgaggtgaagtcatcccaggtcacgtctgttctgcactaactaaggtaaattattgtccacacacctgaactgagagctggaggccacgctgccagcctagactgtgcctttgtaagatggaccttttctcctgagaagagctcagaatgtgaagtattcaaatggaagcctgtgactgctgcttggccaaccttgtgatcagtcaaatagaaaatggtggcaagtcatgcctgtaatcccagcattttgggaggctgaggcgggtggatcacctgaggtcaggagttcaagaccagcctggccaacacggtgaaaccctgtctctaccaaaaatacaaaatttagccaggcgtgttggcaggcgcctgtagtcccagctgctcgggaggctgaggcaggagaatcgcttgaacctgggaggcggaggttgcagtgagccgagatcgcaccactgcactccagcctgggcaacaagagcgaaattctgtctcaaaaaaaaaaaaaaaaaagaaaaagaaaaagcaagcctaccacttgtgatctacatgtttatggagcctaaatgccagtgtgtcacatccctgggcacatgcctaggtactgtagcaatgttggctcagtgtgcattctcaactctgatatcagcatgaaaagaccaagcctcagatatatttggctttatttttaggcttttcctgaaaaaggtgcaagcacatcataaactttgtcttccacaaaaagatcagatttaccctttggaggcatctttctccctgtgccacttgccttttaaattcaagcaggcttggagagtctccttttcttcccttgggttcctccttagcctttccatggtggctattctggtgagtactcgcctctctttgcttttgattgtggttctcaccacctgtgaaaagaccttctgatgaaatacttcccaaagaaccttcttgaccttctcttctccttgaccacaaggctacttctgttttctgccaagtgatgtctcgtaaatctttgtaagttgcaccaactgtgtgtccttacagagtctatccaatctcagcattgccattaaatatagaacccaatctgtagccctgggcaccctaaccagaagtattaattttatagtttagcaaatacggtaatgcaccaaataacaacatttcagtcagggacagacctcatatacaacagtggtcccataagattataatggaactgccctatatagtgtaaccgtttttatcttctatacagtgtttttactgtactttttctatggttagacatgttgagatattaaaatacttatcattgtgttataattgcctacagtattcaggacagtaacatgctgtaccggtttgaagcctggtagcaacaggctatgccatacagcttaggtgtgaagtagggtttaccatctaggtttgtgtaagtgcactctatgatgtttgcacaatgacaaaatcgcctaaggattcatgtctcagaatgtatccccatggctaactggtgcacgactgtacttactaagtctatcctatgtaccagccattgttctaagtgtggggaccaaaaagacaacttctgaccctcttgaagcttacattctgagaaagcgagtcagacagtgaccaaaatcagtaaaccatatagtgatttagaagtcttaagtgcaatggaaaggaacagaaagggaggatggagaattgggggcaaggagatgatgcagtttgatcagggcaagccctgctgagaaaaaatgattttggaggaaacacccaaacagagtgtgaaagtaatccatgttcatgaagaagaacctttgaggtagaggcctatgcagctgaaaagagaaaagtgagggagagattagtggagttgacatcggataaattgagggaagggcagagcatgtcaagtctttagaaagtcaagtctttaggaagacttgggctcctctgagataaggagctcatagatggctttgaggaggagtaagattatctggcttacattgtaaaagaatcaccctgattagcagagttggaaataatcagcaggggatgtatcagtaatttattactagataaaaaatgcagcagaacttggcagattgaaacaagaggaaatgattgttgctcacattctggtgtgtccaacaggcagttcttttgggggacttgcctgtactcacttgtacagtttcatctagctggtgggtttcatgggggctggactccatgaaatatttgagcgtttccctcctcttggtttttcatcttctaggaggccagaaaaggctttctttcatggggatggcattcttccagcagggcaagcccctatgctcaagaacttcttgtgccttttcttgcatcatgtttgttaatggcctattggccaaagcaagtcatggccaatcccagagtctggccaatcccagagtcagtatgagagagaactatacaagactgtgaatacacgaaggtaagatacattaggaatccccagcataaggaactgccacaggggcctaaagtagaaatcatggaaaacaattgagaggcgctacaaaatccagaaaagaaatggtgatagactgcaacagagtgctaacaatgaaagttttaagaagtacccaaattctaaatatgttttacaggatgaccttatttttattgtgtcaagtcagtaggacaaggctattaagcttccagggattggtgatggtcttattatgcgtgagatgatgtcataatatagtaaatgaggtcagggataggtttcttttattgccaataattattcaacgagttttctgtacaattgtaaacttagcaattcacttagtgccgtgactacacagcaccctgtcaatatcatcatcagctaatatttatcgagcaccctctgagtacatggtattgcactcacagcaacagaggtgagctgcattaattctttcagccagtgcaggattattgagtggtttattacatcactctattaattggtgccccagcagcttccggaacaacatttagcttccataatgcaattctttttcctcttagagtagatttagctttggtagaatttaactgcacaaagaaatgatagggctatctgcctttataaatatgctaatgttttttgtttatcttattatcagaaacttggagatactggtcccatttcatagacggagaagttgaggtagacagcggtgaagtaatttagctaatgctatgtgctgagatcagggattgaaattcaatcactttatctattgcactatactgcctctcagtggtgtatgttattcccattttgctctcacactaatatatggtcatgaaaacacccaaaaagatttaactggcgtctatattctttaagggagtgtatggcacttttctttgacatctgcacagactaatcactggaaaagtggtttgtttgtttgttgttgttgtttaagccccttattataggggatttgtcagctgttaaaatcaccacttttttgtgtgagttaaattctcatcagaaagatgtttttgcttttatggtacatctaaagttttaggaactagctcatgaaataaatgatctcattgagatccctactttcattttgttctggaaacagttattcactggcgattgttttggttgatcattctttttgagagagttctctttttttttttaatgaaagagttaaataggggagctaagaaaactgtgagtggaagggagccgtttaaatgcagaatttctttgcaaatcttgaaagtagcgccattagatgtcacgtactctgagatgcactagagtgtacaccctccagaatgtctgtctgttgtaattccatcacattacatattttagtgcatatctcttcctagcagcttccagagcttttcagatattcagcatcagaaattgcactgttttttcctggattttacaaatagcaaccagattattgtaaaacagaactatctgataagtaaggttgtgaattgcttttgtgattgtcatgggtaagagcattgaagaaactcgcaaacagtgcagcacactggttcctgtaaaaataaaacctgtagcagtgaatgcgtttttctgatgaatacgttcaaggctgtgatcattgtgcaacttctggttggatgctttcaaacgttccatattgagaaacatcagtaacaagaaccaaatagtccaccaaagcctgtattcaactcaatggagaggaacgtaaattcttacttagagtttcattgaggccaactctattcggtccaccatgggaagcagagatttaaggttctctcttgatttgctttccatttttactttatgataaggtggctccgctactttggttttcacttaaggggttgttccaattactatgcaaaacagaaatggaaaacagacaagacagacttctgttcagcagacaaaaaccaaaatgccagaacatgttaattaatgtgagcagttttataagcaaaataatttgttttaattggctaaataagatctgatataattataataagccaataaactaatttcagaaaactatttatatcacaaacctttaatcacattatatactcattgcaagtttggaaacggatataaaaatcgacccaaattatctcatctttacaaataagaaagatacattaagggcttttttgaaacttcaaaggttatgctcttttcttattttggagaatttctttttctttttggaaaaaatatataggcaatttcaggagcatgaatctttagtgaatcaagaaggaagcattatgagggtgaaaaatctttcttaagaaagcttattttgtccaaggtaaaaggcttattaagatgaggtttcttccacaatgttctttcatatcatattcaccctaaggaaaaacaaacctcgtagaagagagagattgtataattgggcctgaaatgacctcctagaagagaccctatagaattgagaactctctctctgaggattagctgcccatgggtcaacacaaactgacttccaactaatgtataaacgattgggggaaaacgatatgcttccagagggcagttgttaattcttcctaccacaagaatctcaatttgttgggatgagctaattttgacaccaacttgaacactggttgatgcgcagcatgtgcacacacacacaaatacataacaaagtaaataaataaatggcctttcatacaaccccaggggtaaaaacgctacaaataaattatgcacttttacattatactagctgtattttaacaacagtttttaaaaggccagggactgtattataagctctttcacataatttccgaatgacagaattgcatgcccatcagaattgcatgcccaccaaatcaacatgtcttttttaataagtgcattctaggtacaaggtagtactcaaaggaatagcaatatatattgtacaaaaaaaaaaaatacttcgctcatgtaaccttcagtatacttaaaatctatgtgatgaagtaagatataaatcaaataaaaaagacctagtaatattagaagaataacagttcaccaatggtatgagatatccaaaggcaggacaagattaatgggaaaattatatgtattaaaatgttctcggcaatgggtgcttagacatgggaggaaagagcatttactgtgagctaatataatgtagaaaaaatatttttggttggagaagtatcttattttgaacaaaggatagcatacatttaacaaatccttccatgcaaaaggaaaacatagggagatagcagggtacaaaatgtgtttggaggtgtatagaccagattttaaaacactgctagaaatagatgaatgtaggcaaaattgaatggctcattcatgtatcagacccacatatactgaacactcaccatgtgttaggcactggtctagctactaggaatatagcagtgaacaacaacaacaacaataaaaacacgctgacttcatgaagtttatgcaaatatttcaagacagtaagtgtgtgacaccattgattatcctaatatggggagcacaggcagttctttatcttagttctattgtttttcatttgtgcacagacaggcagagaccatggtgtgtgtgtgtgtgtgtgtgtgtgtgtgtgtgtgtataaaaatatatatttcaaataaaagcatttattcaacttgttgaaaattcaacaatattgttcatcaccatgtacacagaaaaacatcacataggttgatggaattttttatgttgttccagattgttttagtattatatagacttagccagagagaaaataaaagagaacataattaatgcatttacttaaaaagaaagaattaaaggtgattaaacgctgtgggtatttgtgtggttagttctgtctttctgtgtaaccttaaaaggatgactatcagctaataacttttccttttccatgcatggaatgggtggcctgaggggcccatcttcaagcagaatgtaaatgccaagtatgaggaccgaaatcaatgagtatcaccttcctacagcttttttttttttttttttttttttttttttgcagagaactgcatttgtttctatctgtgcagccatagctacatcattcatatgtaatgtttgtcttttatattattttgtataattttgatgattttcgtggaaaacgtgatgaaaacatttccccaaaaaaagtgttgctgaatttaaatgtgtttaaaaacttaatccccatgagcatagatgatcaaacactcaacaaatatttaccgaataagcaagctactttgtttacagattgtgggaggtactaaagatgcaaagtgtttaaaatgtgaatattgttctcatttaatttaaacatatatggaagaacggggcacaaaccagaaaagccaagtaataataaaccaatgtggcataagctaagtctgaatgcctgacatggataaaaataactagaaggtaggaagacaagggttaatatcctggctttgccatttgctccttgtgtgatgtcgggtaagttaattttgctaaatctcagttttgttgtctgtaaaatggttccagcaacagccatttggtgagttgttgcaaggttagaaattagaggcaatgataagtccctgtcatttaagaagcattcccattactatgaactatttcattattgggtaggtgttagctatatactagctattatataatagctttacatggattagctattaagttctcacaatattttacagatggggagagcagggtttagagagtaaaagaatttgacccatgttccacaattaggaaacaaatttcagggtgggaatttggacttaggactaaccccaaagcccagctcctaattatgatacatccgagagcactgtgatagctatgggaattaacagtttcatcaatgtaaaccaagaaagtcaaggatatacttgtggaggacatgtaacctgtcctggtctctgataaaagattggagttaaatatgttgatatgaaagagaaaaggccgttctaaacagaacgaataatgtacttgaggctctgaaagggatgcatatgcatcaggctgggcggacagtaagctcttgtgcagtagggatagaaccagtgtttacatggataggttggtgtcaaaccacagaggcgactgaagttgaggcaaacaaatctgcacttgattctctaaggaattgtgaaccttagatgatgtgcaagccgatacataagataatgaaataaaacagactttcaattgaccaatcaataactattgggaatggatgtcattcagagtggcattttaagaaggatgaattggagaagaaaaaaaaaaacctcttaaaacggctgttttcaatggctgtgtcacgacagttgggagaagtgtcacaatgaacaaggcactaatagaaaagtatttgtttgccaaacattagctagtttatagattagggcagagtcaaggtcgtatgtagaataatgtcattctcctttcattcagattccaagtgcattcttgagaaggggaaaggcggtgttacgatctctggtgcagtccttgccagaaccctaggaatgccccctggaatgggtgttgcatttcaccgcccttcatgtgtttcagcacaactaaaacagcctaaagaagagctgcattgaagaattattgcaactgtccaggcaaaagtacacaaatcaagaaatgtcagaggtctgaaaacagtaactttaagagatatggggttggtatttaagttattggtaattgaatgattgtggtgggggaagaactgagccctgaatggcttgaaggattttacattttacactggtgaggagatttggagaaagggcttgcttcgagggtgagttcatgagttgagtggtagaacttattgagttttaagcatattatccaagtggaaaaacccagaggggaatttgaagaactgtagcttgtaaagagggtcagagtggaaagaagtctttatgagtcatccattttgaggtgatgaaatattgtccatgttatccatttttaaaattttaaaaagctgttgagtgggtttcctaacaatggaagttcacatttactgatgcacttgctatgtgctgggagcaggacctaccacggcacagacattgtttattcttaatgacaacccatgaagcaggtagccttacacccatcttaagatgaggacacaatgagacaaaataactcagtcaaggtcacacagcagtaggtagtggagctgggattcaatcttaggcagggtaacctggttccaaaaactgagcacttaactactgtatcatacgctgtcatataagcatatgaatgtaaagctctcccacagagaaataagtcacataaaagttacattcctgtaagaaatattaatatgacttggtcaccccagtataatcacctagccccccaccctactcaaggtatcttaaatcacacatatccactccactacaaatgatatccactcagggaacccacctcctcactaaggaagcggtaaaaataaacaacagcactgatagccatttgtagctttaaaaaaatctctccttttgtctgctttggagatttctttttatctctcattgacaatgttttgcagatgctgttcaataaacctcgggccccttcccctgtttttattgtgctgaaatagttgcgtgctgaaatagttgcatccttgtaactgggtctttatttttattggcagaaaattctcagtccacttattcccttgtataaagtaaattttaactgtagaacctgtatcaataatgtcatttaaaggaggctgcttccaatacactctgcaaaatgtccgcagagatttccggatttcccagtcaccacttccctccctgctagccaggccttgcagctcccttttcccttctacatctgagcactctctgttctctggccagctgccttctgttcagcccctgtgtgttctccattctctgctctgccttaatgataagtagagtttcatcctaagcacattagggtggaggtggggattacttctttatttgggtccaagggaaaaacataccctcctattggcaaaccatgaagagtatgacacttcgagtttaacaagattaagcaatccctctttgggcacagcaatgtggccagtgtgggggaagagagtgttattcttcttggaccatttctcattctatatctggtggcttacataggaattccaaattgcaagatgcctagggtccggggatatgttgttgggacataagatagttgaaatggttgtgtacttgggtttttctattttttatgtttctaaaatgataattgttataagtagggcacatagaatttactttcggatattggaattgcttaatttcgaagagatggccagtcaaaagcttgggcatctcctcttcctgttcacttactactgttttagctctgcttaccatgaaaggtaagcagtcattttcaccaataacttataccaaatagttgaccttggaaccagcaatttacattcttataaaagaggtcacttagggaatttaactgtgtaatcctagcccccatgtggtaggagatgagtagaaatggaacaaagctggtgacacaccatttgaaacaatttgaattgggaaatcatttcttttcgacttcgtgtcaaaaatggaaccttctttaaaatggtacaggaagggagaaggatgcagtaaaagtctgtagcaatagtgactcaaaaactctgttctaggactcacgaaagcaatcctgttgtcacatttggagggaaaccagaaataatttaggtttttcactttcctaatagcttcttttccaatacctttccttcagacaccatgccctcccttttattttgcctttattaatgaaaactaatgaagagaaacaccgtttaaacttgaactaggaaacacaggttttgtagtgctaatattttggtgtgggctctttttttttttctttaagacaattatcaagacgaagcatttgtttcttcttttgtttacccatggcagtttgtcagcagttatgataagtagagttccatctgccagtaaaactacattgcaaattgccgtagaaattagcagctttcatttttgcctacataaataaatatgcgaaataaattgcacataaatgcatcctaaaaaatcacaggtataccacacagttaaatgccaatcagacaaacccagagacacactgcgattatctcagttttcaaacctgggagatacacgaatgtgtttctaaatgagagaggcagtgtatcatgctcgctgagataaaaacagaagctgccagacactgcactgtggctttattctgagaatcctttgcctgaaacccgctctcttttcttgatgttctctgtctctctctctctctctctccccctctccccctctctctctctgcttctctccctctctcctcgctgtctttccctcgctcattgttctctctctcctcctgcctttgatgcacatacgttgtcacaattcattgactctcctctcttctctgttcttacactcaagcctagcggtgctttcgccaggcagcagcagcctctcctgcgagttttaggcatgtatgcagctcagtttgatcgagcgttccttttctgccttttcactcttacaaaagattaaaaggtggcgtcacattgctcccctgttccttcccgcaggagggacttaaaagggacaacaaaaactaatcactttcaataagcattttcttgctggaaaaaaaaaaaagaaaagaaaaaaaaagaaagaaaaaaaaaggcggggggtggacttagcagtgtaatttgagaccggtggtaaggattggagcgagctagagatgctgcacgctgctaacaagggaaggaagccttcagctgaggcaggtaagcgccgatcggagggtttgaccgagtggcttagttaaatctctgttttcaccgttttgtaattgagaaaggcatccgcagcagaagccgatttttcagtcggcttccttttgtttaacatagaaagtacctgtattaattttgatgaattagagcatgcagcaaattcaattgaaaatagatttgtatagtaaatgcatttatactgaatgatttctcctccgttttatttaaggagagagatgagaaagatgattttgatcagaatagcactttgcattacgttaaattctaaacagctaacggaaagaaaaataatccaattgatactgcttttgaactccgggacttaaaccctaggagacagctgccatttgaaatttttcttctaactgaacttctgatgtgttataataatttttcactggaggttttagcaagggtagagtttatttaagtcgagctactggggtttgtttggcttggatcttgtgggtgaagcgcttcttatatctccttaacgtgtgtcaggttgatggttcataaatagagattaagtgttgtcccaaatgaaatatgaagttaaaacatcaggttagggcatgttgtagaaagggatctggtaaataattaggagaactgaattatgacagtttgaaatgggagttaactctggaggtgctgtttgataaacctttctggattctaagcggctcaataatggaggggctgattaccagtctcgagtcggaactttgcatcaggatcctaaatgtggaatacatatggattttcattgtacgtagcttttagaaatatgtcccttttgtgtgctatgagagttgtggattatatttgatggcatgtctcctttaaagagctttggggtgaagcttaaaaggctcatatctattttaacattgaacaaacacaaaatgcatgatctcccagcacttgatttttgttgctacttctgttgttttaaagttttgattatgtgtttttaacctcagtctttgttgattctgtgttcattgcttctgctgctaaaatgtattgctgacatgaaaaaactgagatttgagaaagaaaaaaaaaaaaaacaacccaaacccacctctgattagccaagtttctaattaaggataacagaaatccagattatatctaagattttacctaaaagatagcatagaatgtttaaaattcatttttaaatgtttttatgagaaaatctgaatattaaaagtacaaaattcagttaaaagaatcctcctctggaatgatatatacaagggtgacttcagtacctgtactaggtttggtcctagaaagaactgcactactatggcattgttgatttcagcggccacggaagggaggatattttatgtatttgtctggagataagatttttttcttcccaagtttccaaaccggacttgctcctcaatatcataccctggcatgtctcgcgtttgccagaccatctgatggcatcttgtgggtgcagcctatgaatccaattttatgaggacatcagaaactgctgagtagtggggagtagagaccaaatggactgtgggtctgatcatacttcatcatccagagataatctctggtggaagttccctgggaagcccctgatacaggttggggagacttaatttttcctcatggttgaaagaatagggaaagatgcagacaagagaaaaagacactgctgtcgaatgtttgatgcaatcgtgctggtggtagcatagtgagtttttaaaatcgcatcacatgtaattttttttcagcttaagaaactttgcagaatcttgaagtagcttttctcaaattcaatctcgttttttttctacatcgttttttcctgcgtgaaatttttctctgactccagctacacctaactattgaaagctgttattctgctgctgataatgatgattatttctcaaataagtggcaagtgttgaagggatgggccaagagaaatatgttgtctgtatcatatatgctttgcttttatttatgaaaatgacttcttccaggtgaggcaatgataaatttgaagttgcgacttggctatttgcctcaccaaacaactgtccttttcttagagaacaaaatagaactaaagtaagcagaaataatttcattgtaaactggattgtagttcagcatgtactttttaggcagatggtaatcaaagctatccttactcaaactatttgattcatataaatagcatttttctgaattttccagtagatgttgctggagagcaaagaaaagagcattttttttttttttacaggaaaaaaagaaatgcagtagacttataaaagccaagaaaaaagattcttctccccaaactctgctgatagcattttgcataatttgctaattaatgaattatattgaatcattaccgtttatgatgttctatagaaagctattaaaacttgagttcgattttaaaattatgagattgttctctttagtccctatatataatgtctgtttgctgtgttccgttttcaaaaaatcaacttaactgcacattactattcagaacatttcatccctgaatgctaaaaccctttaacatgcaaatatgatgtcagaggaagaactgaaatagaataccctgagaagagtaatgatcaaacgcattataaaaatatgcaccagttgccaacatgtaatgaaatattaagaaattaaaagcatgcaacctctaaagtaatagaatttcattgctctgagactgttttcccactgaatattaagtgcttaatagatctacccgtaaaaaacaatcgaaaacctacatgatttgtcactgaagttctttcattatatgattttgaaaaattagcccaataggattttcctcagaataggaaatgtaattaacattggatattaagtgtcagatttccaaagcaaaagctataaggcttgatggagaaaataggaatgcagagagcaaacataagcactagaaactgaggggacccacgctggaactgctctgcttgtaatcactgtgataaaatgacaaagacgtcccagaggagcccaggaatctcgtacccagacaggaactgatgcaatttcaggaccaatgacctctatctatgggagtatttatttttggaaatgatcaattaactgatttcaatagtgaaagggaagtgtatatgttttttccaatgagagggggacgtagggtattacaaaagcacttgcagacaggacaagggtgtaacctatgttggagagctttcggttttcttactttaagccgacctagttctttgctggtggattcttctttggcattgaatcacctctttgtcagttttccttcctgaggtgtgaaatgctccataggatgttttgatttaacacctatttatttctcttttctgggaggaaaaagcttatatttagaaggcataagtgtcagctacttctattttgtaattaatgctctaagtccactgggctagggatgttcccgattttatttttatttgattcaaatacatttttttttgtacttgacccatagtggtttttttcttcttctgtctttaaataaggaaagctacacaacttggtgggagattctactttctagtaaagtttgtttgttgtttgcctcttgttctctttttttaatagtagctatcgagcgctgactatattcaaagtacgatgagctaagtgtgccgaattgcacccctaacaacaacaaaagatgcctctccactcactgagaatctgacgaagatgcaaaatatgcgccaaacagcctactggactaaaagtgccaggtcttaactccctcccttaggagagcaggggagaaaaggtcgctgcaggttgagaggaccctgaggagcctgtctttgaattaggggtgaaatgtgaaaacacaaaataatccccatcagcaaaatcagcgtgggcacagggggcacatgccaaaagggaacaaccgatgctagtatgatggagggtcttgaacggcaagccaaggtatttgatagccactggagaggggtgatctggtagctttaggggagttgcggctttggatgtggacagggaagtactggaatatggggtcccaccatacaacacacccttcccaggaaattctgaaacgtctgtctacagggcatctattcttccgttaaattgcagccttacggaggtattgctaccagtagcctatatcttccccttgtagcaatgctgttgagaactcctggtccagaggctggaagcctgtgaataatctgttgcattagcctagacttcagcagtaaggttgagaaacgctggggaacggagactggctacgagaaacaccttcgtattataattattgcaatttcttgtttgtactgcagatgtcatgccctcattagacagggattttgtgtatatgcatttgttttcatgttttcataagaaaaaccttcaccattcgttggagatcagacccgtggtttagaaggtgtgatgttctctccatgctatttcagtataatcaattagtgttatgttcatctctggtttcttgacattgattaggatggatttttatgatctttaagggttttcatctctctaaaaacatatatactttatttattagaattaattgcctctctgaattgcctgtgttgtcagttactttctataaaccttgactaacttaccttgaactctttgacgtctagtgtatttgactgacaagctcagctgtggagactactctaactatataatggaagtttatatgtgaacatataagctgttttcttttcaacagagttcacgatgagaaggagcaaaaataattattagtacaattaagtaagtagagtgtcatgcttttcttctgtaacacggattttaccagcctattcaggtggacacggtcaccaacatcacctcaaaaccaaactgtagatgagtgactttccttgtcctccaaccactttaatttaatttgttccatttacttttccaagctttccatcttcccaccattttaatactatcagagatggggtgctgcccatgacattcacacttgacattatcaaacacaaaaggcatcactcatgcacttgactgcattacaatggaaggaaaaaaatagatcccaaaggcttagaaattattgtctcgtaccttgaatgtagctggattttcttttctgtttcctccagcctgcctcatttgactgttttgccactgtgtgtttgcagagggttctaaaagccctgcaaaaatcagcactcacaaatccataacatacacatttttatattcactggagatatgtgtcttagtataataggaatttacaatcatatcattattgtctgttatttgttaggcaccaaccacattttgatgcagttccaaagttgcagcttgcaccagagctaccttctcatcattgacttcagttcttctgacggttcgacagtcgtagccaagcgttgtcctgactcacagatctgtggtcactgcagttcctttactattgctgggcaagccagagatttactgaaatccacagtagctctaatttttgtgtgtgtgagtgtggagaattcttaaagttagtataaatttctctgtacctcccttttcttcctattccgagcctgatggtcaaagacagtttacctctctgcccccatatataagacaacacttgtgacctgaataaatagcattagattgtggtgagtttcttcagtcatattacatcatgcatcacgatcgcgtgtgctgtaaagctttgtaaaacagccagctacatgatatcctgcaggtttaatatacttctgcagccttgtacttgggaaggatttctgtaattggagacaatctagtaaggagaactttttaagccatcggaggccaaaatacaagtttttgagaaatgtgcctttataggcttgaaactgaatggattacaaatttctcttaactggacagaatcataattgcctatagagtacggtcctgattatccagggtttgaatttccagcatggggattatccagatttcttccttgactcccctgtctttttcctaactacctgacgtgaaacatttctctaatcattggcacctctgctaatgctatgcaagggcaaatttgagcaggaaaatccgaactagcgaattatcattcagaagagggaattatgtagaaaaatctggtttttgtaactattcactaaagtcgactggataaatttaaatttggggggacatctttctatttacaaatgatgtttactgtagctgcatatatgctgttgagaacagcatatatgggtttcctacccaaaccccagttagttattctccaccattctcattttagtcattaactgggtgccaatcagtccttgataagttatttatttttaggatttgacccacacactgaaagcctcttagataccacaaggaggctgaaatggtgaaagaataggaagtggagctggccttgccagaaacgctgttactgcagaataggacaggagtcaccagaccaccttccaagtctgcagaacagggagcagatttctgtctactgaatattactacagaatcaaaacttgaggctgggctcagtggctcatgcctataatcccagcacttcgggaggccgaggtgggcggattgcttgaggccaggaattgagaccagcctggccaacatggtgaaatctcatctctacaacaaatacaaaaattagccgggcgtggtggcgcaagcttgtaataccaggtactcaggaggctgaggcaccagaattgcttgaacccaggaggcggacgttgtagtgagcggagatcgtgccgctgcactccagcctgggaaacagagcgaaaccttgtctcaaaaaatcaaaaaaacgggaaccaaaaaagaaaaccttgatttcctctcatattcacgtacatcagttgtggcttggacactttcataatcctgtggttatatctggcactttgtaccaatgtctctcatcaaatagtgtactcttctgtcatctctatttgacaaacatacttattaataatcggtagcagtttgaggtgcttaatacaaattcacaagctgtttctgtttctaaatgtataacataatataagcaataaaacatatgctatataatataattgacaaaatatgctaaaaggcaaaaagtggtgttgcctcagtggtactttaaaaaatatccttttatcactagattaaaactgagtctgttagaaagaaacatacttgaagttgttaaatgttcaggtgcagtcgatgatgtagtataatgaacaatagttttcaacccatattttaaatgagaatttaagcagtaatatagtacataaactgaaaatgtaaaacaactgttagaaaaatcattgacaaatctagtcacatgttctgtatgtagaggattcctcttagtattcgtatttgtgttacatttatatacatacatgtatgtacacacatgtattatagagaatatatgtatgtgcatatatctttatctatatctatttccagagtgagagagacagagagaataaaggggtgaattcctaataagatacagtatgagtacattcccgataaaatattgtggtttttccagctgacattattaatttcccacaatctgacgcacagtgtgctatgtaccaaggatgccaaaatgaaaaagacacaattcttaaggagtttatgatctaatctgaaattagatattattttcatgttgaattttcagttgtagatatatttagtaatcaaaaacattgagagagaaaaaaaaaaaatcaagcgttacaaagccattggagcccacactaggtatctctacattttacatgtcttgcctcatcaggaggagagttggaaaataaatataggcaggtatgatttggggaagaagattctcatataatataatcttgtcccaactaaacataaatctggctttatggaaaaaccaggctagggtttctgaattctctgttaccacttactgttgatgcaggccacagaccaaagataggattagtttgtctgattttcactcttctctgagttctatacagcattcaatcaagcaaagaatgtgagggaaagtgttgtcaacctgcttagtattaaacatgcacaaataatgttttgtttgaaaagatatgtaattgagcatatgtttttaaatgaaataggcttatgtgacaaaaatcattttattcttgatctatatggcatttatgatgtatatgttttatgtgtttataatcacctatcctatgtgatttatatacacacacatatagtctctagaggtcagtagaatataagaaatgggcaaaaattcatgtctagatgagacccagagatcctggagaccatttttcaaatggtgaaatgatgatagtcgactaatgacattaggaactgaaatcattaatcagtgttaacaaaaaagtcatgtcattcttgttcctgaaatgaatctaatctatttgttttaagcaaatttcagataaatgaacatttacatggcacgaacctttacagaaaccaagctgtaattactttattatagtttattataacaggctgtgattctccagaagcttttttgaggatttttttttaaatgttaccagaacaaaaaggtaatttgtttttaaacacttgactattacatccaaaacactatttctcttttagctgccaattcagtccccttgactcttagaaatgaatcatttcatgatttatacgttgtaattttatttgttcttatgaactaagtgtccctgatgttggaaaatgtattagaaaattgtgatttattttatatattaagctaaaattgttgacagtccagcacttgctgcacagttgagcatgtttgccaagtttttctctggaacattcatgcacaaaaagtgtaggaaatgacataatgtagccatgaactatttgatagtggagttgtccgtgactcttacacaccattttatgcaagaaaaaacagcacagcagggattcagatttcattcgaattcggggataaatgattatcttttaagtggagatcgcatgccttggcttagaacttaatatgccttgcacacattaatatcgctcacacttggaactaatctatcaataagctattcccatatttgtttacttacactagcgtggattgcattcttagttcagtttcctccaggataaatcctaaaccatgtattgcagcagaagtgcctaaaggtgaatagtcagaaataaaacaataggaggtgataggggcctgtggagctgtgaaaaggcattatgagtatatgtacacacacacacacacacacacacacacacacacacaccccaaacctatcttaaaacaaaacaaaacaaaaaacctactgaacatttttagagaataaccatatggagaatttagaagaactttaggtttatagtaccacaagattcccagtagatattccataaaaattaatggagcacttacaacgcataatctagcaattattaaatcaagaagatatgctgtgtttcctgtcctcaaggggttcacagtgttaactggatgctccccatacagcatctcccctgcctctgagcctctacctctgctctcccaatcttctacattttccattccatctctccaggattccttccagtctttcctgctttcctaactgtggctttgcagatgctcatcttttttgtctgctttaacactccagtttgtccctggctaaatactattcatctttaggccgaacattaaatgtcacctcctccaagaagtttttctcgactactcctccttaagtttaaattaggagctcccactctgtgatactgtaacaatgcactcaccttattgtaacagtgtcctcactatatataactgctggtttaattgttcatagtccacctgttactggcggagggtcctgactacaagtcattcatgttcttggcgttttaaacaaataattggataaaatgcacaaacaaagcagtgaaagaatgaagcaatgaaagcatagatttattgagacaaaagtgcactccatagagtgggagcaggctcaagcaagtggctcaagagcactggttccagaattttctgggatctaaatactctctagaggtttcccattggttacttggttacatcctatgtaaatgaagacttggccaacaaccagtctgattggttggaggaggtgaccagtcagatgctgaagtgaagttacaaagttacactctctgcaaatgaagacttggcccatgaccagtctgattggttgggggaggtaaccagtcagaagcattttccatttttcatctgtgaggcatggaaaggggagttgcaaagggagaagccggctgaggctgatccttttgttatctgggcatgaagaggtggggttttccttttcattcagttctaggaagtcagcatcaatcggccttagattccctacccctccagaccgtattctcccgcctcacacctaagctttctttacttttcttttttttttttttcagacggagtctcgctctgtcgcccaggctggagtgcagtggcacaatctcggctcactgcaagctctgcctcctgggttcacgccattctcctgtctcagcctcccaagtagctgggactacaggcgcccgccaccacgcccggctaatttttatatttttagtagatttggggctacacctaagcttttaaactcagtgaggacaggagccatgtgtgtctagcttatctgctgctgtatcactgatgcttagaaaaatatctggcagcataatgttaatttcatcaataactcttgaatgaatgtgcaaatatataaatactcacaatgtatggattaaaagaagatatccacctccaaaagaccacaaatcattaacctctgtgtttgttcccaagtcttagtctagggcagattcaaagtgtcctagggcatcatccttcttctctctctattttccaccctgaagtagatccggatccttaatccccagaatagaatcgttattttagttggaggaagatgtacactctttagatgttttcttcttagtctctgatcatgtaatttatgatgaaaagtacacttgtttggagggtagtctaaaagtggtgactacctctctccactctagtgatgtttacaagattttgaaccttggatatcagaactgtttaaatagaccatggactctgagcattgtgatcatgaatacagattgtctgttgaatatcaggcattttgctaggaactggagagtcagaaatgatgatgcagaataaatatatattgatttatttttaattaggcctatgggaccatgtcactttatgtgaggatattgtactcccaaatttctctgcttcttttccacacctctggtgaaattctaagaacttatcaatcaagatattttcctaaaaacattgtatttctatgttacacaaagacataaacaaccttagagtcatgctagaagttatttatataataatagaataaaaatgttaatcaaataataaaatttttattttaattatagtcagccctttgtatctttgagttctacctttatggattcaaccaaccatagattgacaatactgaaaataagaataataaaaaagcaggccaggcacggtggctcaccctgtaattccagcattttgggaggccaaggcgggtggatcacttgagtttaggggtttgagaccagcctgggcaacatggcgaaaccgcatctctacaaaaaataaagaaataagctgggcatggtgacatacacctgtagtcccagtactcgggaggctgaggtcacaagattgcttgagcccagaaggtcaaggttgcagtgagcaccactacactccagcctgggtgacagagcgagactgtctcaaacaaaacaaaacaaaaaaatacaaagtaagagtacgataataaaaataatacaaataaaaaaacaggtgatataacaactatttacatagcatttacattatattaggtattacaagtaatctagagatgatttaaagtatatgggaggaagtatgtaggttatacgcaaatactgcaccagtttatttgagggacttgagcatctgtggattttggcatctatgggggtcctggaaccaagccccacagatacggagggactactgtagtaataaacatgaaaggctggtcagttaactgttcctctgacaatatgcatgttaaatgatttcaatgtataactgtaatttctcttttaatttgggacatatcctccttcctttaatctttggttccctgaggatggtagcagactgttcatttctgtctcactctccctttccttctccagggtgtcctgttgaatccactcctatgtcttatgtgcaaactcataatacccaggatagtttattatatttattcttgaataagaaaatattttagggaaagaggtaatttaaaaaatggaacgtacttgccaatgagcaaatgtattctattagtagagaattataaccaccttataacaatcacagtatccctcatttccaaagcgttctggaatgagtaataatcaataccagagtaaagaaagaatttttcttcaatttagttagatgatttttattcacaaaaatatctaagttgttgaaaaaatagacctttgacttttaacttgggtttatttttcaatttggaaagtgcatgtaagtttgttaatgttaattagtaattgttgggctctgagggggtgcagcatcttcagtctgagcttattacagtgtaaaatatggattgcctttaccctaatggcctctgaatcctattaccatcccattagagagtgtgggattttagtaattctgttgttgtttccagtgggcagtgaatataatggggaagggcaggggttaatgcaattcatctcttttaatacttgtaactccaactcccttatcactcactgaggtttcattgggtttttcccctttctttctatatctttaaggcccaatatatttctctatgcttctcccagccagaatagtttggggagtatttcgatgattcttgggtttaaatagaattttcaatattagcctttcataaactgaagataaacaaataaggtagtatgtccgcttgttgtgaaacagcctgtcactcagaaaggttttcagtgactgtcattgtgccaagaatagtattgaaatggctcttcattcaagatcatttataaggccttttggaaggagaagcatgataccagtgggtcggatcaatgcacactagtgttctgggtataatgtttccatgtgttcctggagacagctgtgtcctgggtgctggtggtgctagagagaagaattggaaaagatttcaaagtgatagaaattagattcctttaaagagaagtttatgagcaatagttaattccctacatctccaacatgctcagtagatgttcatgtctgattatgtatccgtggttttattcatgaaatttgtttttagctaatacagcttttttcggaataaatacgaacatcagattacttctcagtatgtcaaaacaaattagtttcccacagtgatgcagtgaaaggtgtaactattttccctttttatatgtcagaaagcattactgggactgggaaattcctctttttccccccttagcccgtgagccatgtggtttgcaaaggtctgctttaattcacaagcatgttcacctagagctccagcacctccctctgctgccattagtgggaatcacatgctgagatccaaagaggcaaccacactcagaaaagactgggaatggcaggaggtgatcagaccatttcaatctgttgaaagtgagtgatattcccagggctcactgttcaccttctcagagaattaagtttccatatgtttcatcataaatgacatgaacgtgcaacataactgcaatatgcaaatgtccactggataacgtaatagaaaactggattggagaggaattctccttgtctccgtattcaaaatatcttgattgtccacctggttatggctaataggctaagcctggtgacagtgcttaggtctatatataatagtagtttgtgtatctgcattgaatattcgtgcatcacatttctccttaatttgaggtatcacttatatttctacacagactgtgagagcatttctttctctccatcaatgggtgtattgtgtgaaattcattttagaatgtaattatgtagtgaccaatacaattagctttcatccaaatgaattgatatgaataagcattgttaagggatattgttttcttttgatacttagttacttagttacagactactttttaaatccatttctgttcccacaatcacttgggaagctaaaacaaaacaacaacaaaagaaataaaatctactgtaagtatatactgaagtaataatcttttaaaaacagcacatatacaaaagaccattagcagaaaattactgaactcatggaaatgacatgtagatagaacctatgtagaattactggtttgcaaaggacaatatgagggattctggttactcaacaagtggaatgtggctttctgtttttcatttatgattggaacccatttaattcatcttgtctgtttattcttggaacttcccttcagatctccaagaaatataaaaatcagatgacaggccaggcatggtggctcacgcctataatcccagcattttgagaggctgaggtgggcggatcccttaaggtcaggagttcgagaccagcctgggcaacatggcaaaaccctgtgtctactaaaaatacgaaaaattagctgggtctattggcacacacctataatcccagctacttgggatgctgaggcatgagaatcacttgtacatgggaggtggaggttgcagtgaactgagattgtgccattgcatgccagcctgggcgacagagggaggctgtctcaaaaaaaaaaaaaaaattaatgatacttaggtttccattagagaatgatatatttaccattgtcacaaagccacacaacctttcatgtgttgtctctgttcagtgttcccttaatgcatgatacacaaattatttaacaatagttgaatattatcaaactagtagtaaagaaattggactctgcataacactaatagttttattttttaaacatgtgtcagaattcaaatataagtgtgaactgtgtagagcacacaggaatgctgagtgccacattttgtaccatattgcatccaatgcttttgtggaaatattccccaataagtttatgatagcaatagaaattagcatattttaaaaatatatattttaaactataaaagtagaattgctctttcagaaaatttggaaaatttagaaaaaaaattgaagagaataaaaattattcataatcccatccaagtttgtttgtttgtttgtttttaacccacttaaacaggtgaatatttaaaaaataaagattgtttcttgcattcattcttatacagtggaaattctcttatgcattaaatagcactcaaaaactttacattaatgttctatcaatgtgtatgccttacaaattccatgatacttaaaaataactttctttaacattttatttataaaactataataatatatttatttaaaagaatttggaaacaatatacaaacaaaagtaaaattattttgaaatgctaccgtgaaaaggtaaaagcttgaataatttgatgtatcattttaccatctttgtctatgtaataagtaataatagtaattactttgtttgatttatattttagttattctacagttttatgcttatctcttgatttacttaccactgaattctctgcttgattacatttttcttaaaaaagtcagattgcaatatttttaggatataagaaacttctgcttgttgtattcatagccaatattttttccaaatagtgttttttgtttttcatatgaaaatcagttttgttttcatatgaagatatttcaaatcttgatgtagtaaggtctaaggtcttcttctactatttcagatatcttgaattgtttctcagctttaaaaaaaatccccattataaggttcaataaatgcgtactatattttctcctagcaattaaaaaataatgttataatgacattaacttgctaagttactttagaaatgcatgtatgtatgtgtgtgtgtgacatgaggatctagtttcttaaatggttaatccattactagatatttgcactgttactatactgttttgttattgcaagtttatagtaagcttaatgtaatagaagaaccactcctttttattttttttctcccaggcatgtcttgcttaactttcatcttgattattcagttgtatctgtatgtgtatgtagaaaagcagaaaaatggtgccatgcctcagtagtatttttttcctctttaacttgagtctctttaatttggtaaggtatttttttagtctcatttttgtttctttgctctccaataaaacatgttttccattttgaatatgtgggttttgtgttttgacccacttctcttagatttgtcttaatcaggcatttcttcctggaattgtactttaaatacctatgtatttgcatacaatgatgtaagaaatttctcccacatctactttcttctcttcttgagaaaacaatgcatatctgttaacaaaatgttcatgatattcatctatcatgggccaagttcatcttttgaaatgtaactgcacaaagtacaatgctgatctaatatggttggtctttatacatttatgtcagtaataattgcactaagcaagcaagagagttctcattgctctagcttccccacgataaaattttgtaagatgtaacccatagaacaccagcctagtgcaaagctctgcaaagaaagggttccttggtggagtgaatttgagaattaattcatacaatagccatattttaccagtttagaataactgttatcatattaaaagctctgacaagttcaacaataaagacttgtttggtttgtttgaacccatcttctcccagatttaatgtatgacataaacatttgctattttttgaagacagagaatattatttggtttgatggtttgtattttattgaggggtaaatatataatctattactcaacctaggaacttacattgaatactcaaatcgggcaggctttcttccaattaatttcagtttccagtgagtcttgtttcttttcagtgtacaatggaagataactctaatcagatcttaagagacaattctcaaggcatgtcactcattggccatttatttgatgattagtagtggttgtagttgaagtaggcggcagtattatacaattatcatacatagtagctctataacatcttgcaaataaattaaactctttatatatcagtttttattttttgtaaaatgggaacagtatcctgcaggggcttgtgtaccacagaaaggatgcgtatataaagccctaaccctatttctgcatagaacagccactcacagaatgatagttggcattctcaataatcattgacaagaaaagttagcaggatatatcccctgctctgatccatctaaacaatggtgcaataagaagtaacaatttcataatgctttgcaatttacacatatttttatgtacgctgttgagagtgtaagcatcaaaataaaataggagaactggaaaatacagtgagggagctgagatcaagtgatacagcatttgccaggaggtgggtattccatgccacagtatacaccaatacagaatgaggacaagcgttcattccttctaatgaggactttacctaggttgggcaccaaaggctgtcacacagttggatggaactgaattaaaacgatatcaaagttcagttcctcagctccaagtgcttgctgagttcggcttcttctctggtaaccctcttatggaatgtgattttaaaagcatcccaaagttgtaagtacctttgtgtcgtgttgacatctgattcatcagtgggcaaacattctgctattgttactggagctctgttttatcctcctggaagagaagccccagctcagcaagagcggtgtggaaatgttggtaaacccctttattactttgagtctagactactgtaattctccatttgtgggccttctaaactgggttatttataggatgcaacttaagagaacaaggcagcccagagccttcctgacattttgtcccttcagcatatttaaaaccatcaactcaatccttatattggttacccataaaattttacattgattgtgaagttgttttacttacacaaatggtgcctccaagatgcgatttcattctgcctgtctcactgatttttcttttgcccaaccctggtcccttttaaagacttaaatttgaaagcttttggtattgtgctatgagcttgaggtgggcatattcaaagttatgtggactagttttaggtttcattgtatttttacagataagctcttatttacttaaataaaatacatattctttacccataagaaaaacatacatttgattttttgttttttttctgttatacacatcatatccaatgtgattccaatatagattccagtatttttctaggcatatcatataaaatgtttaatacaatgagatgtatatcatacttattatttagtagcctacttttaacattgatgttattgtggtctttttctttgttttaaaaactttattttaataattgcctaatattttctcttagaaactctgtgattcatttaattcatttggaaattattccttaagtaagatttatcaagtgctctcactttgcatggtcctgcccatagcttctgaaggtatagtaacagataaagatagatacagctcactttctgtggaattaattctgtaatgttggatattggctctcccttcactttagagtattattacaaaaaagatgactttgagttttaatcgaatcacgaagaatatttgatctgaccctctctgttcatttgtgctaagaaaacaattgtttttctaaaagggtaatcaccttggaaaagctttccatgttctgccctcttttgtagaccttcttcttctgatcatgtaccctggcttggtcattttcttatgaacataaattctgcctttccccttgttccatgtaaaataaaactttctttgaactgcatctggagaatttaggccctataaaccttggccctttgccaaattgcatttagccaccagcttagcccaagaccgcagaatctgtgtccattgctctaggcttctacctatccggtaagagaagttaggaattgagagctaaattaaagttgcaaatatttatccttatcttcactataagctctggatttgcctttcgatgataatgcaaatactccattctttgggtctgtccactgtgttaatagaaatactcctgaaattggaaagaatctctctggttacaagcacttcttcctggtgtcggagataaaccaccattgtggatctttgcatttcttttcacaagcattcctggcatgggtcctcataaagcaagagtgcttggtacttctccctcgcctcagtgaaatatccatgttgtgggcaaaacatgctagtaatatcatgcagctgtcattgggtgacaaccacatgtagatttagagatgactgaggtacctgtctttgctgaaatgtgatgttcctcatgcatacttagactcttttcatgaacattctttaagttgtatgttccctgcttgatggaaatgaacattgtataaaattgaagcaatttaaaaatatacagtatttaagaaaaactcaaattccttaaatatgtcagtggattggaaatctggcttgatgcacccactactaaaattaaactgtattaagatcatatgatacaatgccaggtgtcagctttctgttccttctgtctttagccatagaagttgtattccccattgatagataacatcagactttgcacctaaatgcaatatgtgagatgcaaatttgagaaagcacatggtattttattttaatctttaaaacatataatctacaaaaatataatgcttagtctaacccacatggcaatgtagtagctgaatatggctctagaaatgtgggttgtcatgaaacaaatctctcttctagatattggaaatcagattctatcaggacattcaatttagaaatagtgtttgcatccaactgtccttctgtacagatatgtaatttccatgttttgtttaatgtaaattacaatgtttttatttgttaaaaagagcaatctttaaagcctagaatcagaattgaatgtttgtaatgtaatcgcaattttgaggcattctttgtcatttatctttatagggtcagggattcagatagcaaaggagagaggattgtgcactttggtgtcttttcaaatagaaagaactaacctcaagcggggattgtctgtcttcgatcatatgttatcccagatgactaagaggaaaatctgatccgttcacttatgccacactatttttgatacaccaaagcccttgcaattttacttacaaacacagattaggaagtgaaaggttgattgtttctggcagtttgaaatgcattatgtttgtcctgaccccagctcaaatgaaaatagaatgtttccaaatcttctaatggtcctgcaactaaaattactcatttgaaactgccaggactgatcagtgcaaaatcaagcagccctttctgggttcttcatttggagaacatcagtttcaaggttttaagataatcatctcaccttattatcagataaatcttcttttacatgagcagctactgtctctcaagacagcctctcacttattaaaaagggaaaaggagggaaaagctaccagggaaagagacaatcagaagaaatgtcagtaaaatggaatcaaaagactataagatgtaaaattactttttacctttgttagtcatttagaaccacagaaactcttaaggtgccaagaaatatcgagcccaaagctggcttttgaaataagaggaaaccgaggcccagagaaagaaaatgacttactcagcaaattgggatgatggaggagatgaaactgactggattttgtcccatgatcaaggtttttgacatgaagtctaacctcagcaagattcacagcaaacagacctattctgaaacaaaagattaattttcaatccaattactttctcaaaaaatactagccctcaagtattcatgagatacgtcttgtattgctgttctcattgaggagaataaatagagagccatttggatttcgttagttgtttagtattcctttagcaatttcagacttatttgtgtctgaggaaggaagcctcttatatcaaaacatgacacacaaactaacagctggttttgacattgaacttcagatctagggttggtaagagtatttgcacttactgtttgtaatgtacaaatagatccttgtttaaatcctcagcaagaacagccttgtgtaaagctttatccaccgtgtttcccttccctctcctcccccataaaataaaggaagaaaaacttcattgcagtcactaagcatggggattactggaaagacagagtgactgtttggtttaaatgtaatttcagtgtgtaaatgttcacatctacctaaggatattgttaatggaagcaaaacctaaccccccttatttgattttgcccttcagacttgaatttttctcctaacgctattttgttcagcatgccccagtcctcttcatatgatggcaagttctatgttagatggttcaacaactattgggggtgcgacaggaatagcaacactgattagtgctaattaggtgtcagaccgtttactgtcattatctgaagtaaacatcaacaactctgaaaagtaaatattgtccctattttctagatgaaggaacagaggccccgaaagcctgaatactgtctacggtgccccacagtcggaagcaggaggcctggctttgactctgtctaaccctgttctctccatcctactggactgtcccccccaaggacctccctacaaaccctcagttccaagaatgtcttgagccaattcccattaatcacattgagctagtttctattgtttcatcagtgaattttctgtgttaatggtaaaaaataaaaaataaaaatgcaggccgggcgcggtggctcacgcctgtaatcccagcactttgggaggccgaggcaggcggatcacgaggttaggagatcaagaccatcctggctaacgtggtgaaacacccccgtctgtactaaaaacacaaaaaattagctgggcgtggtggcaggcgcctgtagtcccagctactcgggaggctgaggcaggagagtgctgtgaacccgggaggcggagcttgcagtgagccgagatcttgccactgcactccaacctgggcgacagagctagattctgcctcaaaaaaaaaaaaaaagaagaaaagaaaaaaatgcagaggcatcaagagataactcttcttccattaggacttctgcattcggtttggaagaaaggttttctccagcaatcagttcaccttcgggggacacaaaacgtggatagaactggaggtcccaagagcacctgtaggggacagttcagagcctggcttttctaaatccggctgcttatgcgaaaagttcatgagctcagtccttcagttttcagtcctcacacacatggagttatgatgatttctcctggcccaaatactgacactaggacaagagttgctggggcaaatttgccataaacacccatacatatttcttttcttttcttttcttttctttttttttttttttttgagacaaagtttttctcagttgcccaggctagagtgcagtggcacaatctgagctcactgcaatctccacctcctagtttcaagtgattctcctgcctcagcctcctgagtagctgggactacaaggcatgcacaaccacgcctggctcattttttgtatttttagtagagacagggtttcaccatgttggccaggctggtctcaaactctggacctcaggcaatccggcctcaagtgatctgcctgcctcagcctcccaaagggctgggattacaggcgtgagccaccatgccccatccccatatgtaactttcacgaagcttttgagaacatgtaaaattttccttggatactgggagtggttcactttaaacagaacagataaaataggcatttgacaccataaggagtcagggtggtggggagcaggtgagaggacagcagagagacaaatgataattccagtgctactaatatatatgtgtaattttatgttattacattataattaagatttgttttgtcacactttaatatctgaatgctatcttactttcaaacttatatatgcatgtcatatttccatattttcatagtattctgtacaaatctctcccaccacactaacctcattctctcataattacccatatacatacacacatgtgcatgcatgtgcacacatatatactgcttccactgggctgtgttattcacctatagttctttactgcctggcatattctgagtagacaggcaatgttgactgaaagaatgaatgaacaaacctgtgaataacagaatacaacaccatcacacccacattccatgagtttagctgcattaacccttcttggagtcagagagattggtccacgggagaccagtgaagcatgaaggagtgaggcaaatctggcacatggacatcatatgtgagccactgtctgttaactttccatttttactttacgtaccaggagagcagattgatattgcattttaattgtgtatattagaggaaggcatatggttacaacattctcttatttaccttctggaacatgaaatttgtcattttgttcccaaaataaaggattgaagggatagtgcctgctttttacacaagttcaattctccctcatgtgcaagtctcctgagatgtgtagcaagtcggtgccaacatgaggctggcaccattttcctattgccatggtgatctccagctctcctgaaatctcaagggggactatgatattttaaaagcaacttgaattttggtaattaaaaaggctgcaaagaataatctttctacattttgccagcttgggtaaatatggatagcaagtgatgtctagagaagaagggtattactgtgctttattacgtgggtgaccccgtgttggaaaatgaaaaccgtcatgaaagttatgtgtggagtatttatggcaattcagaaacctactgtgaaatttaaactacatctaatcacaaccttcctacaaacagctactctcttggagtcactagtattttaacttaaaggtatgatgatcagagtttgtttttgttttttttttaatgtcggaggcaatgagtaataatgtaaatgttggcagttatcaaagtaaaggggaaaaaagtgattctcttaaactggaaattaagttagacaagcataatttataccgcaggttaatcactccctccatcacgaaagttcttacattaagggttcttttgaacttcatttgagcaactgcgctctcctagcaaagcctcaaagattaaagggctttgtttcacttgagaagacagttgaaatttttttaggcattcttttgagctataaaatgaatgcttggagtagaggaacatggaagcagacattaaaaggcaaaacaatgtatgggagagaaacccaggctagtggaaagagagtgctttcttgtatctttgtgcatagctttgtatatagaatttatagcggaaaatgatcagcagtttaaggtagggcttgggaaattttttgggctgagtgtgtgttgtcttattaggtagggtatgaaatcttcaacgacagagaaagagaaagggtagaacaatcctcttaaattaggaacttcacaaacaaatgcagattcccaatttgcagatgggcattttaattgattttttttttacaaaaccacctacaacctaatgtttcagagttaaaaataaaccatataactctcaagtgctgtttcttccacataattcaaatctgattatatctgaacaaatcaccaactggaagtgaagaattttctatggatcagtttgattccattgggaaaatactgccagcaaaaatagtttggcggtccccgtggcaaaacttagaaacctgttttcttgttttgaatccctctgggtaagagcccttaccatgttgctcataatcttatttaatgccatttttagctggtatgacctgaagtggaatagccagatggttttgttgggtttttttatttgtttatttgattgattttgtgttgtgtttagcacagagatttggtgattttttagaaaattgttcactgctttttgattagtgaaatattctgtgatagctgacagatgacttgtggagtataaaagcacagtgaagtggctgagaatatcgttaaaggtttcatggctgggcgcggtggctcacacctgcagtctcccactttgggagattaaggtgggcagatcacttgatgtcaggagttcaagaccagtctggccaacatggtgaaaccccatctctactaaaaacacaaaaattagccagacgtggtggtgggtacctgtaatcccagctactcgagaggctgaggcgggagaattgcttgaacccaggaggcggagtttgcttcatttataggatacgtggaactcagaggagaaaaagtcttcccaaggctattttattgcaaaaatatgttaatgttcagactaggctgataactttttccttatatgttctccctaatggtatgttcctgtatttcctgttttattctatgcatttaactgaatattggatttttacattaaaaaaatatgtttatgaaattaaagaagattgatttgggcagcaaattagaacctttttttgttaatagagaaagcatttagtgtgatgtacttgctcttttctatataaaaaataatgtttttcttaattttaaggacagttctaaataaaatctatgctacttaaaagagagttttaacatcccccattgccttgtagtttttcttttcctgaaaatagatccacaaatgtcataaattagtctgcagattttaccttattatgcttcctccttcaaaaaatatgcaggaaagtgattatatgtggtgttcaactcaggactgatgagttggttataattatcaaggcagacataatgaaatgaaaacaactctttctctagggcctcagaggcattttcagtcactatcataaccctgtcacgctgggttaactgttttctgcccaagtagatgtcaacacaattaatttcacagtttcctcaactgatacagttagggttcatttgctcatctgggcaagaagatccacatatgttaagggtagaattgatttctgggtttttcctagacagatgagactgtggaaaatagacatttatctttatatataactaaacggcattttgtctctttttcattagtccttaaacatacttttgttcaaattatttggcatcgccatttgacattcatggcataatttattcactcatcaaatatttatcaagtgccagctttatgcaggaccttttgccaggctctgaggttacagcaagagcaaagcagaaaagccctgcccgtgtgaagttttcaatccatttgggcagtaattgcaccaatatacctaattaacagaaaaatgtaaaaccccactagataatttgcatgctactggtacttgttctttactcctggtataatagatgcttgcttgccattggagagtgttcaatagaacgtcctgtcgcacagtgacgaaaacattctaaactcacatttctaagacagtaggcactagccacatttagctattgagaactttaaatgtggtagtgtgactgaggacttgaatttataattttctttaatttcaactaatttaaactgccacaagtggcaagagggattaccatatgggacaatgctggtctacaatgtatcatcttattccttgcatatattttacacctgaaaacagcacttgggcagcataaaaacaggacagagtatacacaagtttaatttaacatttactccgtgagcttcaaggagcaagaagatccatgagagagtaactgtgtttttggatatctgctaagaaatgtgaaataatgtccttgattttagtgtgttcatagattacaaactaatctttaatttatgtctggaatactgtacctggttgggatattttaaaagtccaatttcttattcgttattgttaccctatgaatcactgagataatgtattaacttagttgattaatataatttattgctataaatcttccccttttgcttatgctagtgcttagtaaaaattgcaaacacattttccccggagttgtattcaatatcattccactgcaaccaatttctaattctcatttcctagagtacatctattgcttaataatgggaaaagaggaaaggaactggggatggtgaaggatggcaggaggaagagggaaggggaaaggaaggaaagggagagagaagaaaggggaagaagatagggtattattggatagaaaaaaaaaaaacacagagaaggtagcttttcttgccaggaaacgtgggaaggttttggccatgaatactgctatgatcattaaagttgctgtcgtatttctcttctctagcatttaaatctccggattcctttcccctgcaggtttgtagtactgagaataatagagcgttttcagaccctacattcctcagctgcttcttgtttgtttctcatctatttctcgccaaagaaggaaaaatgagccaaacaattttctgctccttcccctttccaattggtatcgaggaccttttaactcactgcctcatatgaaacccactgctggccatctgcaagacagaacgatgacgtgtgtgtgtcacctctccactcagggttcacgccttcatattgtctcatcatctgtatttttttattgatgaggacagagcaaagaaaaaatatttctctatcaatttctgctgaagattgagtgtttttggtcacggttaggtccagtaagcattgggggtttggtggttggagagtagatattgttgagactattttagaagacttgctcaagtccattgaaaaagaaactacttctttgtgaatgcatttaaactcacataaatccatctattctttcaattgatataaatgttatatagatgatgccttggtttttctagattctgatgatacagagaaagaaggagaaaaagacaaggaaacttcaataagtggaacttatattttgtcaggcagtggagcatggaaggagactgaaaataagtgcataaacaaggggcaaaagaaaatttcatagagataaaggctaaaaataaatacagagtagtatggtagtaagtggtcatgaggagggcttcctggaagagaatggtcatgaaagttctcttaaaaacaggagcatttgaacttactgtgggtaatggaagaagcctgccatgggaatagctttccaaggaacatcaagaataagaattgtaagatgggtatgattctgacactcagttagaaaaacacaaaagtaaccagttgaccagttggctgacatgacaagaagagaaaaagtggtgtgagagaaggttatagaaactgagccatcactagatcctcaagcacctggaatgtcatttgttcttgttaggggctagtaatcaattaacaggacactgggtttcctaaattccattagatatggtgagatttcattggtgaaactcaagccagaggtgtttccttgaattgtttaatgtcatctatttgggaggaaatccgtgttggcttccagatatcacagaccatttctgggagttaaaaatagtgtccaggttaagagatacttacaggatgtttaaaaatattcttggctgggcacagtggctcacacctgtaatcccagcatttcgaaaggccgaggtgggtgcatcatttgagctcaggagtttgagaccagcctgggcaacatagtgaaaccccgtctctacaaaacaataaaattagctgggtgtagtggcatacacctgtgggctcagctactcagaaggcaggggtgggaggattgcttgaacccaagagttccaggctgcagtgagttgtgattgtgccactgcattccagcctggctaacagagtcagaccttgtctcaaaaacaaaataaaataagagtagtctttaagatcatagaatcagtttgaggaatagcagtagagttgaactttctcatcagtgatgaagttgaggagacaggaagtacctgaatctcgaaaccctgctgagaacagagttcttgctggtaagacatagaaggaatgattacaacatagagtgaaaatgaaaaatgttgtaagtacctgatttttcattaagcacctcatttaattgatctggagtttcaggtagcatatgtctgtgttttggagtttattttagggataaggtacaaatttccccatttaataaacagctgcctgctgtagtggggcacatgtatctgggactcctgattggagtgaaataaaacaatatactagccttgtttctgattttcttaaaattaactaaatttaaaaagataaaaagaggtagatgagaggaaaagaaaaaaataaaaatacgaaacaacagtaagatctttcaatcttgtttactactaaaataatgtctggtacataggagataatcagaaatatttatcaagaagggtagaaggtgtaggtaggaaatgagtctgttctctgcaatgaaaactgcagcacgtaaaatagcataagccttcacttttagccttgaaactcaaattgaatagttaattagtgaattaccatttcattgatgaaacggggcagtggggcatttttttcaatctcttcatttgtattataaatctatgcagaagattgatgtgggtttggatcatcatcatgaggctttattttaagtagcttaatcaccgttaatcttttggggtaactttcttgtgatctaagtatctggtaggtctccttgtctataaataatttcttatgttggattagggtttctataagacttctcatttaaaaattccctactattttctctgtctgagaaagagtatgtttctgatacctggagcatcaggaggtcatcaggatagaaatgagacacatcaatgtgttccttcaaactgtcattggtgagcatgtgcagtgacccaggtcttttggcagatgccagggatataagcaaacctaggatcaggcatctggtggtttgcagactagtaggagggaaaaatgcagaactattaagtggtataaggtggtaaaggcaccatgaatggagtctgtcaacagtgcaaacagagatggaatgattgattctacttggacagattaagaaagatttcacacagccaaactttgaaagatattgtggaaacaaataggaagatgatatgctaggcaaacggacatggtttgatcaaagacttggaggcacgaggcaaggtgtgtttcttgaactgcaattaatgacaaggtcatcccttgtcagtgcagtgaaagatgaaatctaagatgctgtccaggccacatcacgcatatgctcctaaaacatactgagcattttccactttccccatgactgcaggccatggggagtcattaaagggctttaagcagaagaacgtacgattctatgttcatttttatttttaaggaccattttgataaaatagagcatggaaagagcagtagtcatttaaaaaattcttttttatatttatttattactgaatattaagaacctagtatgaatcagcctttgtctacatgcatggtataaggatatgaaccaggaataaacattcgatgttgagcacgctatgaccttcagacacatcagatgaaatatcaccttatccaaaaagggccagtgaataactgttcatcccaaagttctctgtttaaatatagtcttaggtccccagtgagaagtgttcccctggagtcactgctgctgagcatagttaggccacttgcatgcaaactggaggagtatgtgttatacaagtccttattttcatcaggtagagtagatatcacatggtggccagtttcgacatcaaatccagtgttactctgtaatgggaactcaattttgaactgcaggtatatatacatttagcccatgctgtaattacatctgatcgtgtaccaggtaaattgattggctgttttctcccctcactgtttctcatagattataggcactagagagtcctcatcatctcctgaagtggttctttcccgggaatgcacatcaggatcatgaaaggagcttttaaaaaatatgcatatttgggtgtcgcccagaagagtctggttcccaggttagggatagagccgagagaaatttgtagtgttaaaagcttccttagggggcttctcatgcatttaccctcttggaaaaccactaattctaatcagatatctcttacaacacaactaagacatagcttgttagagcccggactaaaactccagttccctgaggcccagcccagagcaatttctgttatattatctttacctgtgttcatccacgctgccctggaccttgagccaagacatctgtgtttgcactcctttcatctggatggtgatggcaggaggaaaactgcaatctaagtgcacttgtcagctccagctgctataacaaaagatcatagactgggtggttcaaacaacagacacttatatcacacagttctggagcctgaaagtctgagatcagggtgccagcatggtcaggtttttgatgcccttgattctcaaatggcaaggaagctgggggagaaggggacatggggagggaggagaggggcagaggggaaaaggagggatgggaagaggcaactctttctggtcccttcttacaaaggcactaatctcatcatcaggaccccactatcatgacctcatctaaacctgatcacctcagaaaaccacacctccaaatgccatcacattggagggctagggcttcaacatatgaatttggggaaagcaccagcatttagtccgtaatgctaagagggtagttcccaaccccgactacacattagagtcatttgggaacttttaataatatactgatgttctgggcctagcccacgagatttgcatttaatgcttgccaggcctaactcttcatcctgttagtgatgtaattttacttaaagcctaaattttttcgtcttcaaaatgggagtgatgttacaaactatgctgaagattacatgagattacagatatcaaaagggttgctcatctctaaagtattgtaaaaatatcattttcaccttaattaacccactttctttctttgatgagcagcttcaggtgaaatcagtatttcaagatttatatatcagcgctttaaagaccaggttttctggtagccttgaattggaactgctgctctcctgaatatatcaggaaggcaatccagcaagagggcatagcttaagggtcacaaatttaaatatctacagggcccaggcaggtcatataaatgaggaaagagagggctggctctagaaaaatcattcactgcttcattcggcactctgagtcacttctaattgcaatacagtagagagaaatgtctctctactattagagaagtaatagtgccaatatggtgacaaatggcagctggcatttgcctctcaggactgggaaaacagagactgaatgccccactgaaaggggcagctgtttacactcatcccagcgctgctcgatcattgagttttgttctcccagagaatccaaaatccaggcttttatgtaaaagctcctgatacttaagtgttagtagctaatataaacaaaacaaaaacaaaacagggagcatttcacaggctaacactgactggcataaataccacatatgtggagtttgaatgtttcctgtgtgccccatttggcctgcacactgtcagttgatgaccattacttcgggccttatactctacctcacccatcaactaaggcattgcttctcacatatattgtttatccacaaacaaaatacattgccgtgctggcacccagttggcaatttctggcgtggatccttatttccttttactgaattgtcttgcatttgtttctagggacgatagtcattcatgctatcaatatttactgagcagatactgtgctagataagaatgcaaaatgcaataagatagagtccctgccctgtgttgcttccagtctagtctaggcgatatgcccagtgtaataatgaggcctcaaagaatatcgtggaatacagaatgaagatagctaacccacccgcccctacatagcccattgcttttggttctttttattataacagaaaatgtacttctttttcttttacccagttttttttccctcttgttttagagcgcttggccaacgtattgagcctagtgtgtgaagaccacatcctagcatgtgacgccacatcctttggctcttttgatgtttaggaaatatttggtgcccagaaggtcatgctataaaactaaaagtcatatcacccaatgtcgcgctaatgcttaatattgtcaatattttacttataatgcataatatgaaaaagctactgtcagccagaaacaaagcccactgggtgcatttggttcaacatgaggccctagctttcatatttcttattctagtttttggtgctcagagatgccaagtggctcatcttggggactgtctcttgtagcaggcatctctccaggggagtgtctcccaaactttgagatggttatctgttaatcgaaggaaaaataagttgtgaaagtaggccatgtgcaccaccaataaacatgaaaatttcgttggcaagagccctcctttccttgccaaagtgaccttggttggcgcaaagatgacagagtgcttcccttcccaggtctgacagcattgctatcacagcacgtttgacaaatcgttcacattaaatcggggggcactttcggcagcgccgacatcccctctccatcactcctgattaccacacagacgtcaaccatggcaccaagcacatttgtcacagggagtaaaaagcagttgttagtaagagcgctacctgtcatactaatggactagagcttgttgcttcgtgtctcacaggagcctacagatttgcaaaaaaaacaaaacatgatttttttggagggttgtccagtgtttcctgaaaatgcttttgtgctttgatagagagaggtactgaaagcttgtcagatgggacacccaaacgccttctcttggaaggggaaacagattctaattttttaagtgattttgctttttagtgactgctgtcatttccttgtggccaaacaaggcaatagcaagtttttcagttgaggaaatccacaccctacacattttaattaaataatgtaaaaaaatgaatggagtgattgtttgctattcatgagtaagcatgctatcctcatgctgaaatcgtgtgaagtcatttgaagtaggtaaagaataggtttttttcttgctatcatcacttcctttagcatgtaggtgcctcatgtgtcattcatacactttgtttcatagtctggccataagaaccttcagagtgggccagtcacacactaccatacccattgtacagataacaaaactgagaatgagaaaggttgttgcccaggattacacaagtagagtcgcatttcttgcctatgcctgttgactcaagtccacaatatcaattgtacttggatatccaatcaaaagtatacaacttgtttaaatgtggcctgtgtgggccacgcatggctgcttcataactctgtttccaagccattcttctcttctccttaagttcctttaccagtcagtatgaatttgatttctgccttttttctttgcctgatgatgcaaaaaaaaaaaaaaaaaaaaaaaacaaaaccttacctagaaggttttttagaaattagagaaagaaaagaagagtactgggtttggaacttccaacagactgccctttataaggtcaagtgaagactaaatcatggtttgagggagtgaacttccggtagggcacacgaaggggattgttgcgttagaatttgaggatccttgctatactttattctatcttttgtaggcccatgagaagccactttggctctttgatgagataggaaaaaaacaaactgtttttcctactctcacatgttcaacacggaatacttaacttctggtcaccaaaatgtgtggagatttctccctaccagcaaccaatcaattctccagcagaccccagctgggagttctataattcaattccaatgctatctacatggagatagtgttagatcccacaggttaagggctcagtcccacaagactgtccccacttcagatgccaatcacaagccccaggttgtgacgtacacttttgatcggctataaatcaggatttctacaagcccctctcttaaattcaattaatttgctagagtgactcacagaactcatggaaacactttaattacatttacccatttattgtaaagggtattacaaaggatacagacaaacagccaggcagaagagaagcataggacaaggtattggcaaggtataggaggaaaggggtgtggagctttcatgccttccccagaagcaccaccctccaggaacccccgtgtgtacatctatctagaaactccttgaacctagtccttctgagttttgttggaggcttcattatgtaggcgtgattgattacatcattggccattgttgaccgactcaaccttcagcccttctcctctctccaggggttgggggtgaggctaaaagtctcaaccctctaatcatgatctttctggtgaacagtccccatcctgaaacaatctaggggccccctattcatctcattagcaaacaaaagaccctcatcactccagagattctaaaggttttaggagctgtgtgccaggaaccaagaacagaaagcaaatatatattacttcttatatcatatcacaggcttcttttgaattcactcttccaagtactataataagctagagtgataagcttgagatgggctaggttgaataaaaaacttgttaaatgtttgattcctttcttgttttattacagaagtcttagataaatgtttctggatgatcaggctggttcatttccatgggatattttagttaacatcaattttcttttcaggggaaaatatatgatctgtgattggctcttcattacattcttctcagattcataagccaggaagcctcaatgtattaagccctctgattcaaaaggagacagtcccttataagtgcattcattcgtcaaattttattacatactttctctgtgtccagcactagactaagccctgggaaaaccaaaggaaatctgtatctcctgctgttttaatgtagattatcttacaggtagaaatggtcatctactttgggcatgcccactatagtagctgtaggccttcccaaaatattcaccttcataataaccttctgactattccccaggggttcacttttcggattctactttttcccattcttattctcaataaactaccacttatagtgtacccttttcagatcagactagcatttgacattatcaatatctctacttttttttctttaataccaggtttcctttcatgctgcaatatataaaacagatcaaagaggagcaaccatgggtgaaacagaggtgtgaggtgcccagtgcccacaggctctggtcccctgggaacctccctagaatatacagtcctgctagaaggtggggaaaaccttggtctaggttgcatccaggaggtgccacagaaggaggctgcatccctccgtggaccccaaccctctctgcttggacacacctacttgagcaaggtggggttgagatgttcatgccagcaggaagggagagtttttcaagaaagttcagatagggaagtagttagaggatatttaacaggtggattaaatgatggcttagtctgttttggctgctataacacaatgccataaactaagtagtttataaacaacagatgtttgtttttcacatttctggaggttggaaagtccaaaatcaggttggagttggtatctggtgagggtctgctttctggttcatagatggcgcctcctcattgtgtcttacatggtgaaaggggcaaagcagttctctggggcctcttctataacggcactaattccattcatgagggcttctccctcatgacctaatcccacctcccgaaaccatcacatttgggactaggttttaacatatgaattttggcgagacacattcagaccatagcaaatgataacaagtcacattttatatcatgttccaaatactctgaagtgatttcatatatatttgactcctttgatccgtatttccaccctacaagtctgtctcgctgttcattttagtttacataaaaaatgaattcacaaagtcatgtgcaaggtaagaatttagcgagttactatttgagccaggattcgaatcggagttccagtgtctgactctgttctcgtcttttgcccaccacaacccccagctcacaacagcacaatgtgtcctaaatagagctgatccttgccatccattgctttctgctcccaccccttcattactaaccttatagaagcacatatctacctgtagcgaggacagtttccatcaagacacgcatttccatggaaacgaactcacccaacccccaaagataagttaatgtggcatttatttaattttcgtaagttacattgccttattttctttacatctaggcatactgcatgatttttttaaaaaaaaggctcaggaatgtgaccctgtgttaatttccatggctacatacccaatcatccaacagtggcttggtggcatatgatatattcaatatatttgaaacactgctgcatttaaaaataactttaaaaggttgtaaatgtcaaattgagatttgaaatatgtcagatagctgtcatttttacacccttcattaatttcaattggactcagtgaattggatttgacaaactgttatcatacattgactacaagcatgctacatttatgtagcaaggacctgacgtacgggatgttttgagggaaactttaatatatgacttctctttgacctcctagatgacatgagaccatcaaatgacaaatgtggcagcattcaactctaagattttccaaatggtggcatttggaaaatcttcaagaggcttattcagaaatggatgtgtccactggagagtttccagtaacaaaaatagacatatttgctttaggtacaaaactgcacaatttggattccagctaaggaaacagggttgtgaataaaaatttcctgttggcagatctcagcaggtaaagacacgcatggaagagtcagatctgactataaaaatgctatcattattcaaattaatagcaactaccaactatcaagtgctatatgaagagcatgatccatagaacataatgcttaaaaacccatgttctggtgtcagatcgtgtgggttcagacactggctccaccacttactctgtaacactgggcaagtcacttaacatctagatgtcttaattttctaatgtgtaaaatcacgataataaaattacttacctcatggggttactatgaggataatctgcattcaataaatctgttatcatcacaaaccagggctgtactaggtgctctgtacatactcatttaattctccaactatgctgtgagatgtatattaccagtatcttgctcgtttaccagtgaagaaatgaagactccaaaggttattgtgtccagaattaaccacctggtaagaggtagaggctgggatccaggtaactgaggacatcttgtaggtcagtttgttcatctgtaaaggttggtaattgaacgtaaaggtcccctgatatcaaccattactagatgcaatgacactaggaaccagcccagtgtcacccactgagaaagatgagctacataaatccaagccccaggtcacagaaagccaagtttatgctcgaccaggacaggacagttggtttttaaaacatatacatcctcctgtttgctcccttttcaagaaaataagtcaggctttatgtgtgtgtatgagtgttagtgtcatattttaacacagctataaagaaaataccaataggtaaataacctgctaagtatgtttttaaaatgcaacggtggaagaaattttatgtagaaatgactaattttaaaatcttatatttctctaagttaaaaaaattattcatgtttattgcttgttttctttttcttggctttagtatatagaaaggtatttgaaaatcaaccagatttttataataaatcagaattttaaattttaggaatctttagaaatcatagcatccagagtgttcttgcattcctagcttgtccaaatttacttgcttttgtctggatgaataaattacataactggacctagctggagggtacacgccgctactcaactgattatacctgagggtatgccaatcttctgatttaaaacatagtacctgacttttatgagaaatttcctatcttttgaatgtctttaattcaaaaaatgtatgaacacggtaacggaataaacaatatctgtctgcaagccatttttggcccctagtggattattttgtcaccctaagtctcatccctttccctacgttttgcataggatcctctccttcacccagcgagaaggccaaggtcaacttttggctcctttggggtcattcagtgaggtggtagtaatatacgaagacagccccaggccccaggcttctgtgccttggttagtttcactacattattctgctactttcacttcttataagacaagtgtaaagtagtgtggtctgttaactagagcaagagaggaaattttttttctttgcttttatatttgggaagtagaaaacgcttttagggtaccttcataggctaaggactgtgtgaaataaaaggaaggctttccagcctgtgtttttctggttgcatgaggaagagagaagcacatcaaaatgagcaagaatgtgtggcctaccccaagggatgggtaaataaacaaggagaaatggggattgctgggagaatcaaggcaagtcacttccagcttcatgcgatctctgtcccctggcagttagtttcttaaatcacatcaatcccgcatccccttttcctcccattcttccacaaggcaagcaggaaaccctcctagagtgtgagagagggtgatctcccctatctgtgcacttcatcgtcactgacggctctgactggaagcaaatgctgcctttactttatctcactgtgggggtttggcattcttcatataagttatgtttatgtaaacgaggactctaagggtgaaattataatttatgagaactgcatggagctcctgacaatattcataaacattccaaacaactttatctcgattcagaacaaaacatacatttttgtcacctaataaggatttttattataacaatatttctattctggactgtcctgttaccgtgaataatatggggtggggtgaattttttttctatatgtttagaaatatttgttcatgatgattcttccttaagaagtggtgggcagtaaatattacccttattaagtcttgctgatggggaaattgactgttgatgtcttttagaatgcaggtgttatttctgttgttggttggttgtttttatttcattttgtgtttaacaaagtaattagcaagtcgtagatccttgaacctgagattgacactccttgactcatttgccctttgttagttgttatttattgtattttttacctctgcaaaaatacacagtaagtgagatatctttagttgtgttgtaatttcagaatatgataaatgctctagctggcattgcacagatttcaggtggggcattcagagggggacttagacctctgacatggcagacagattttttttgaacctttagtaccatcattcaataaacagtcagaatatcttagttataattaagagagacaaccaacagcccattttgctccagagtcactcatcacttaagaaaaaaaagaaaggcaagcaatcaccaattagtttgaatgttaatattccttttgctggtggtggaaatagagaccaaaaccagctcctctttacctctgttaatccatttctacttttgatagaaaaaaaatccaccttttttcctcctaagaaatatttgaacaaaaggccattagatagaattttagcttccagatttaaatgctcattcaagaataaccatgtaatcagctgagcttgcgaagaatacacaatcataaaatcatttaattaaattccatcaatgctgtttgttttggtgcccatttgggtattaataacaccgttgctgtttttaatgccggaggtttaccacttaattattatctttgcttattggagatgttagcatcaatttgtagggttccataatcacaccctagttgttgcttcaccagatatgatgcactttccagaactagaagtcctatagcctgtgcttgatctaaagatgaagtggtggaaatcaaatgaaaacatttgttaaactgtaaaaatgtaacaggaaataagagcagttattcagactgtgagtaaatttgatggggtgtgaactgatcactttattgcactttgtttatagcattcttgccatttgtagagatggcagtccaatcctcttcattgtcttaattagattaggaatggattaaaggagccaaatctattattaaaaaggcaattctgctgtgttcctgaaaaccctcttttggtttttaatttcttaaattccactgatgcaaaatagcaaatgccttacttgtaattatgagcatgtatgcattcatttaaaaggctgtaagggtattagggaaatcaaatcttcaatattcttcagaattatttctgaagaaataagggaagggaggaagagagagaaggagagagggaggggatggtgggctgcattgcttttggctgtgatgaatgtgaggaaacaaacagtgtaattgtgtaattgttttcttcttcttttgatttactcaaacataaaaagggcaatgcatgtttatatgaggcaataatttttccagttacatttgttttttttaattcacttccacagctaaagtatttgaaaatgtaggtgtctcttacatctgacttagattgagcatttgttctgtagggaggccttccatgatgattatctggttttgcattttgcatgtctacctctctcccttgtgcctatacacatgcaactttcagtttaaagctttgtgatataatctgctgtaaacattacacaagtattgctcagaactccagttggagcagagcttctgtgttggaaactatggtgctttattttttccagtgggtgccctagttttaagagttgctttttcccttctttaaattgtgtcatcttgagatgtaactttttaatgtattttctctgcattttaaaatgactgtatagtcattcatagtgctacacatctgaacacacacatgcatacacaaatgtgtgcatgtaaaaactggtgaaattccagtaaagtctgtggtttagttaatagtgttacaccagtgacaatgttctgggtttgataacgtactatagttacgtaaaatgatcttggagaaaactgaaggaaggctacatgagaactctctgtttttgcaacctcttgtgtatcttaaattacttcaaaacaaaaagtcaaaaaattcaatgtattgttttagtccattaactactaaactgctaccagaaaatattgatctctatttgatctacattaaattaattctgttttagtaactgacattcagatgtcaccagccttttgcagactcatattctgtcgttctacctctgtgtattttgcaagcatttcctacccactcaactctaatatcccctagtagaggcttcgtgtttgaacagtctttgtagccagcgagcctaatgctatgctttaaacattgtcttcacgggcatttaactggtgaatattcaaatggaaagaaaagtcatggacgaatggttaagtaaaaaaagaatcactgtgctagcacaatgcttgctacacagtaaactctctgcctatattcagaatgaaggaataagttaattaattaattttgctcacatatgaattttgtaccttagcaagatgggacccagtgatggctgagccatctgttcttttaagtactttgtgatggacttggattctgaaattgctcattaattgtcattgcttcagtatggtgccgtgcttgggattggaggtcttgaagtgatacctaatttcggaggactgtgacaaaatttatcactaattacctgcccctcaaatgggaatcaaagccatcagcaacatacgatggtgataataatggttatcatttatcgagtgattagtattctaagcactttgcaggtattccctcgctttaattttactccattgctagcttagagttgagcagaaccacttgtccagggtcactcatagttggcttgtgggtgggtggcagagctgaagctgaacccaggaagcctgactccagaggatatgctcttaccaccccctgtaagctctcccctcccattcaggcttgtgcccttattctgttaaatggtgagtagttatcaacaccggagatgcattagaatcaaatcctctgggggcttcttcctggacctgcttccatatacacttattcattttgtcttcaccggacatgttaaacttccagagtgactctaatgtgcagacatggtgaacatcattcgcttagctgcatgtcagcgctcactcaatgtctgtgaacagtgaaagctacttattctacttataagttcattaagtctgtgtataactattgcaaagcagaatagttgtcccagccacctgtgtttggggagatgaagctgggaggccatcaaccttctttgcaataaatttcctcacgttttgtcaagcaacctgttttttgtattctcagctagaggctttccatctctatcccccaccatctgtcaccgatgttcatttgagtaccattttacctgtataaatgtgtcttattttctccactccctctccccgcaaaaagagtttctatactaggagtcctaaaaatttacctagttagggagtttaggcagttcaggtaaatgagtgaagaagacaggtctttgagtagtgagtacccccttttagaaagacaattggggtggttgtcactgaggcaaactggggagtgtatatttcatttctaggagcactcactactcaaagcccatgacatagccacgtggaaacactgcccagtgttctagatcttccagtttttctggagactacagaaatataattttccatttcttttgcttggtttttgttttggttttctattgtgaactggcttgcaagatagttccatttgttttctcatcactgtataggtcaatattgtgtcatcagtaacaatgtgaaaagacatgtataactgaaaggaagtagcagctttattctgctaccttttcacatttttaaataaagagttgatctttctttactaactaccaagtgcaccaggttccagtctttgtcagagattggcattctgactctaaacaaggcataaaatttggtggatgctgtttcctcatctgtgaaattgaacctagaggagggcattatggaattacagggcacattaaagtcatggtctctggagtaagactggtgtggatgggatcctcttgctactacttaccagctctgttcttttaagaaagttatttagcatcccctacattccctcatctgtaaaatggggacctgagacattgactctcacagttgtcttgaggattaaaataaattgtgcattaaagtgcttagacctagtaaaagcactggccctcctgctaataaaagatatacttaatgcatgcaatgtttttaatagactgcagtcaggcaaaccattgcctatgactttgtcctgtggctcttgttagccttaagcattgggtaaacttgctcactctgactttgctacttctttcattggcatttcaagacctctctctgttcctcccccttttaaaaaaattaataggactgacagcttcatggtaggtggacaaaaattcaagttgcataactcgtttctaccaccactaatgtggtccatactgatctggaggttatgctgtagaaccagagaaaatctctttgggatgattagaagcaaagtgtgattaataatgaatatatgtatgtattttaagagtagggttgtgttaaatgtgaagagtcaataaatgcctgttaaccttctgagaggtcaatagtcggccgtgtggttagttatgcagggcagcctgagcatctgcagtctaattcagacctgcccttagatctgacaatggtacatgcaattaggaaaatgtctccctaataatggtaatcggtgtaaaccaagaggacagggcacagctgcggggagcacttggagggggaaatcagaacaattgatacattcccaagaagcaagcctcaagctatcccttttcagtagaagtctgcagtacctttcaatttgctcttgatcataatttactgaaaagcattttaaaaataagtgcatgactcttaaagactgttcttggctcctttttatttttaacttgtgaataggttgggattatatgtcttcctttttaataaggctattgtggatttaaatatctaacttaaaccctgttggctaaaactttgctttttggcttttttttttttttttttttttcaagaactgagctcaaaatgtgctatacaaaagctgtcttttgagaacatatatcaattcagctttgcctcacttgaaatgttgatatttgtaaatgacagagctcccactctagacttacaatcctctcctctttcaatgctccagagaagcaatcttgggaggagaaatgttttgactcatctttgattttgaaagaggtttagagctctggtctcctttcatgtctcaggttattttttggtcttccccatccccgattttcccaaacccctaaataacaaacccagttccttggtttctctcctttaaaaagataatgtttcaatttacaaccagctctgaataattaatgatggtaatgatgtgagaatattttgcatttatggctgctttagattttcaagtcccttttacatccattttcttgcagatcccaatatcaacactaagaagtaaggagagagacaggatggaaaatactttgaacatttatttatcctttgatttacttatccattcagcaagtatttaataagtgatgatgtgggccagatattatactcggagcaaagtctacaacatgaaaaagaaagacaaggtctccatgcattttgttggaaggaccaggcattaattacctaaatgaatgaataagaacatttcagataatgataacttgctgtgaagaacataaaacaagataatgtctttgcagagaatctactgttgttacttcagatagagttgtcagagaaagctgtacaggggtagggacatttgagctgaaatctaaatgaccttacagaggccatagtgtggtctggggagagcctgtcaaattcaaagacgctaagatgagaagaccgtggagagggaagagtagcaggatccagggaaaggtagggaggggccaggtcatttaggaccttctatgctgtggtaaagataattcagaaccattacttcactgcctgcactatttctaaggggataagaacttccccctgattgggtgtaggaatggagaaaggccatatagacacaagtagactcatgcaactaccactgcactgtgagctcaggaagacactacctcattcattatcacatccctgaacccctaggatacctaacataggtaagcaattaacaagtatattggataaactgagctgggttgtgtcaaagtgtggccatggcccacctgcatcacagtcatttagggacaattatttaaaatggagattccaaggcttcacttgcaggcttatgaatttggaatttctgagagtagagttgttaacatgcattttcaacaaattctaagacacaggaaatttgagacttggcctcatttttacttctcacaagaagttcgtactacattataaaaatcttaaaggcaaacatgtttaggctaatatgtgtgtatattcatgagagactcctgctgacagctgcatgtgtttacactattttatatactggatcttaataagattacataagtgtttcaattttttacatacttgcaatttatctttattaatgcaagcaaagtgagtgaaattaggaaattaattatattttgacttttgttctatttggtttatttgattttattatcaaaaagtaaacagcagcttggctgagggagacatgatgagaagcacccctctgggctattcataccatcaaacctctgaaatccaagagctgaggactgaaaattttgcataaaagcgtagcaatataaagcatgccatgctttaaaagctcatgttgcccgcataaaccaacttttttaaaagaagaagcctcagatgaaacaatgaattgagattcagggtaaactacttctggccaagttatttccaaatactggcaaaggtatagattcctcactcactgattcaaattttagaaagaagaaagaatacatagaatattaaatgagccttgggacccatccttagacccaccattatttcttccataatatagagcagaggaaaagaatcaacattaagccattccacaaggttcaggggtgagtattattccagctccaggtacattgtgtttttgaaaatccatcatacactgtagacatgacaattgctttaagtagcatttccagggatgaaaatgacaaacacgcagccagaaagagggataagtcttgagagctattttgctgtgtgcatattggaattcaaacatccaaagaggagaccaggagggtggggattccttcatctcacctttagagtttttgttttgtttgcttctttctgataattccttcttccacggtcttgtcaaagctgcattgtgttattatcagtttgttcttgctgctgcttgacctgtttcctaacaatgtatagttgtctgtacttgtggcagggaaaagagaaaaggcacttttgttgttttaagcatttctttaaaacatctcttaaaatcttgttccctcacccccaaataaaatgttgcagtaagacattgtataagatagcaaaagagtgatatttgctttttaggctcttagctcaagaaatagggctgctattttttgtttcaaggccaactgctttgaatgtagatcattgaataagtccccctcctctgaaataaaaaggagactgcatttgttttattttctaatactaggttctatctattattatttccgttgtcctgttctgttcagcaacatgattttgacagagaattaccagggaagaccgaattctcttttcccaatttgttgtgtttctctttattatttcaaaaaacacataataattttttttaccttctttcagattccccactcccagtcgatttatccagtgcaatttcactttcttttttaagcttaccaccaaaccagtcattcttacaatcttgctgtctgaatgctacatcgcagccaacaggattttgtttagcctgcacagtgattttttattactgaatttgaatggttttagatgagcaagctccccactatgtacaactacctcacacctggctgcttcacattgttctcggaaggaatcctggcagtaagaaggaatctagcaagaacaactcttgtattgatcttttttgttgttgttctgtttgcacaactgcaaaagagagtgtgtggaatactagtggagatgctgattgttttggttttgtttcctttttaaatttttttcccattatagtaaaatgaaatctatcccttttgggagatttgaacaatgtatttaaaagttaggtgtttttccatggtaagataccatctcacaccagtcagaatggctattattaaaaagtcaaaaaataccagatgatgatggggctgtggagaaaagagaactcttatacgctgttggtgagcatgtaaattagtttatccactgtggaaagcaatttggggatttctcaaagaactaaaaatagaactactatttgactcacctgtaaacattactaagtttatacccataggaaaataaatcattctaccaataagaatacctgcactcatatatttattgcagtaatacaatagcaaacacatggaatcagcctaggttcccatcaatggcggattgggtaaagaaactgtggaacatatataccatggaatagtacacagccatgaaaaagaacaaaattatgccttttgcagcaacgtggatgcagctgcagatcattattctaagtgaactaatgcagaaatagaaaaccaaatattgcatgttcttattgataattgagagctaaacattggctagtcatggacataaagatgagaacaatagacacttagggctacaagagtagggagggaggaagccttgaaaaactacctattggatattatgctcacaacatgggtgacccattccattataccccatatctcagcatcacacagtatacccttataacaaacctgcacacgtacctgaatcaaaaacaaaagttgaaaagaaagttaggtggttttcatgttttatttgccaatatttaccatctaacttatgtactacatcttatcctcccaaagacaaaaatcctgacatataacaagtttctcatccacttaaaagctgtgttctgagctcttgatattttggctctgccagttataacttcaggattcaagaacttttccttaacaagaactaattttgttcttttaacttaaggcttcataacaagaagagttgttgggaatgacaaaatataatctataatatgtttagtaaacacttaggtgaagtgtttatctgtagatatgtaatatagagagctataaacaaggtactagttgcattgatacccattctgtttcattaagaaactattcaccctcttaactaagtccacttcctcttctttaatcacctagttctgagttattggctgattttcagtattccattccttgaggcctcatttagcaaatcacttccttaaatcatggctgttttacccccaagcagagagctgtcacttcaccttttcacagggagacatgtttagactttgagggctcatcatcatcagatatattctcatcgtagcaactcctcttctgaatttgctctttgaacaatgtttgcaaagctagactaagatgactttttgcatactgcctacaacagctatctggtattaccaatacgtttaattttatgtgtgatcgtgtggcattgtaaaatataagaagaccattccctggctacagtctctcccctactattcagattttttttcagttcatgtttaccttaattattttattatcacataccacctcactgaagccatccaaaatgttattattaataaaccattacttatcaagatttttagggactttatttaaaacaatgcttataaattatgaaatatttgctgaagtgtatgtgtgatcattttttatgtgtctgtatatcccagataaggaataaacaaaggtagaggtaaaaaccactataagttagataaggaaagtctgctcagatgtatcagttatctattgttctgtaacaaattaccccaaaacttcatggtttaaaacaataaacatttaataattctgacagtcctgtgggtcagaaatttgggagtgcattaatggggcagatctggctcagggcctttcatgaggtggcagtcaagacatctgccccagctgaggtcatctgaaggcttgactgtggcagggagaatcatttttctgggtagcttaattaaaatgactggcaagttgatgttggctgttggcaggcagcttaaggttttccctgctggagtccctccatgggttgtttgaatgtccttatgacatagcttgcatccaccaaagcagcggagtcaagagaaaagaagaagacatctcttctatgacccaaccttgggacccatccttagacccaccaatatttcttccacattctgctctttaaaagtgattcactaagcccagcccacattaaagcagagaaagattaggctctgcctttggaaggaggaagtgccaaagaatttgtgagcatatttaaaaactactacaccatatttctgtaatggctaagttttatgatatccatatcttccacaaattgaggtggattgtcaatgtttgtctttaccattctcaaaatgtgatcagaaggccaccgagagaggcaaggttcctcagttacataaaatggtctcaggttggacgatattatctggattttcatgctgtgtgtttctgtcctagcttcccaaattggctgttatacttaatagaactaaaaccattgattgattggtgtcatacataaaacaattccagtcttccttattcatttgggtaagtggtcgtttttaaaaagaaagcagaaacatgactaggtcagtagcttataaacatgaattttgcatatgactcacctggagcttttttaaaaacaaacatttctgggcactagcccagatgtactcaatcatgagttctagggaatggatccctgggaattgtgtgcttttttaagttcggggtgattctgatatagccagttagaaaagttggaacaactgctatacacaacgaaatctaaaaagcactcgaaaaggacaacaccaagcaaaagggaaatcattggcactctcatgataatcaacattattttgctttcagaaaaggctgggtctgggtttctaggcactttcccacaccagccccaactgacaaggacagtctggttctgtagctgcatccccaaaggcagtaacaccggggccgccacagtggtaagctcactggcccagaaatgcatttgttcacgctttcccgaagacaatgactctctttctgattagagttgtcctcccttttacccagaggctttccatgcaaccaagggagcataacaatgacatgagggcttggaaaggaaatgtcttcattgatttttatttcatgaattggagcctctataaaaatggcaaagacatgttttacagtgtcaatttgtggaatggaggggaggactgttaaaacccatccattttccaaaagtttaaaccactctaatgaattaatccatagataatggattgaattcagtgcaattaccctagtaagtaaggcttgttaaaaagagataaggcaacacactaaagaaaacagcaatttcagctattaactggatttcatctgggctctgataattcagtatatgagttccctttgaaaagagagaatgtgaggtcctattatcaatgtagctaccagatactagagttcacctgctgatattaaactgcagaaaaagaccataagatgataattctgacaaccattttcccaataacctcaagatatctaggatgtatatttgatacaccccagtaagtctttataaatacaaggctttgattccttaagacaggaagctcatttttgttttgactctacttctttttttttttttgaaacggggtctcactctgtcacccaggctggagtgcagtggtgcaatctcggttcactgcaacctccacctcccaggttcaagtgattctcctgcctcagtctcccaagtagctgggactataggtgcccaccgccatgccaggctaatttttgtattttaatagagatggggtttcatcatgttggccaggctgggctcgaactcctggcctccagtcatccacctgcctcagcctcccaatgtgttgggattacaggcgtgagccaccacgcctggtccgactctacttcttatgaatttaaattatcctagttacatacagagagatccacattattttgaataaactgctaaaaggaaagcctcaatgggtattacataaagtaaggataatcacaagtatattttgtgtttgtaaagaactttacggtagaacggcagtgtctttccggattatgcttcacatagcaaatctctgtgtccaggcatcagaaggagtttaacaccaagccttagtcctcagaaggttgctgtcaccaacttgaaacctgagttctaagagctcatgtgcatttatcttccagttcttactcctggcactgtattcaggtcttcagccctcttctgtcgtcgttgcttttttcttcctaaagctggtcagtgacgtctctgttttgcacgttcctgttatgtggatcattccaaagacattgtggtcatattctccctgccctattcaaaaatctccagttatttcaattcctgataggtgtgacccagaggccacagcataacgttgaaggtcctctgttgtctagttttcctcacattttcaacattcggttccattctcttccctcgtggtattatgctttgtatgttgactcctccttcttcatgatcagggatttctcttactgtgatagtgttctacctcctaaaactatattacaggcccctgtcagtacctcttcctttctctcctgtcatagccactgattccctccacctctgagttcctatggtagtggaaatcaggatgacacagtacaaggtggtatagagaatgtgggacttaggatgagctggcctgatccaaatcctgcctgtaatacttgataattttatacttttggacaaataacctctctgtcttccgtttcatttgtaagcataaggtaatacctgccttttaagaataccttgcagttgaggataaagaaagactttagcacagtgttactattgctaatattctgcagttgaccattcattcttactttctttattactcattgactttttagctgtgtattgcttgcattgttttccgaatacattggcaaccacctaaaagaagcttgtccctttggccacagtcaaatctggaatagagccttacataaattaatgataattatcataatttattaagtgcttactgtaagtcaggtactaagctatattaacccccaaacaatctttgaagtgaattctgttatcatcaccattttccacattagaaaagttgggcttagaaatccaaggtttcatagcatatgtgtggtagaacaagacgttgaaccaggtcaaaaggtttagtgttaacattttgacttctagaagaaaaagagagacctaggttcaaatcctggtttactactttctagatctgtgacattaggtgaatttcttaatgtctacatgcctcggttttcttttctgtaaaatgaggctattaatagtgcttacttcctagggtttttctgaagattaaatgagataatccatgataaactacttggcatgtttgaaaggctctgtaaatgctattcattaatacttatttattatgtctataaaacttgtacacttaaatctcatgcacaatgccatgttggtacatattttccaattgattatttttatatcactgtctctctggaccaaaacagttgaaataattcatagaaaatccaggactgagcaggtacatgaattgacttcacactagaacataaagcaagatagtgttttcaaactctgaacactttcaaggcttactgatggagtgataataacattccatactcaccttgtagtgtccagtaaatacatatgtttggttttctcagtgttatagagagagtcaactacattaaagtaatacacctccctgggatttgaggaaattattgcacttcttgtgccttatgacaccacccagagtgtgttataatcacccagaaaggcactgcttgttgtatcttgttgcgtgattcattatctagtagaaagaaggagaaggaggaggaggaggggggaaagaggaggaagaggaggagaaagaggaagaggggaaatggaacaatgctgtgggaaatccaagtagagcagtcctcccttaccctcaggaaatacgtttcaagacttccagtgggtgcgggaaatggacagtaccaaaccctatatgtacaatgcacatatttcttttttcttcttcataattttatggatagaattattcttaccttacgtcttagcagcctcagcatccttttttttttttccgttattaagtggagcacttttacttttttacttagaagaaacactttatggcttcttttggcatatccgaattaccagcatcacaactcttgtgctttggggccattatcaggtagaatagggttacctgaacacaagcactgtgacaccctacagtggatctggtaactgagatggctactacctgacagatgggtggaaagcattagcagcttggatatgctggatgaagggatgacccacctctgcagtgggatgaggcaggacagcatgggattttatcacaggattcataataatgttacacaatttaaagcttataaactgcttatttttcgaatttttcatttagtattttcagaccactattgagcacaggtaactgaaactgcacgaagtgaaattgccgcaaataaggggggagttatatacactcctttgagggattttgagggtctgggcaatatatggtgatttttatgactgttgatctcaaaaaagtctccagtggaactcccatatttctcaaagcatttattctttaaaatgcaataaccatttataatatatttaaagccaaactggatcagtaatctaggaatataacatctaagagtgtcactactcagaagggaaattaacacaggagagatacttggagctatatctgtgcatagcttttctctcctgggaaagccccagagtgggaaattgtcacctgaggcaaaattatacagaagattgatttattttcagtccacctaggaaagagctccccagtatcctcatgtacccaaccgggttttggaccactggcagagattgttcctctattgtaggatatatggttgttatatatatccattcattcatttggcagttatacattgagtgtctaccgtgtgcgatatgcttgtgcctttgggcctgccacagctgaatctggaatcgaactcgtggcagtttaagatttaagaaagatgagatccctgccctcttgtcgcttgcattacagttgagaaaaaaaaagtcagtaagcttggcgataagtaaacacaattacttcagctagtgatttgagctgtgataaaaaaagataatgaaataataaaacgaagagaggcaggcaaatggggctatttcacggcagatggtctgggtacagcacactcactgagagtgtgacatttgagccaaggcttgaacttggtgccagccatataaagacctggagtgttctcggcagagaaaatagctacaatgaaggtcttagtatagaacctgttgggcgtgtccagaaatagaagttggatgtggctgaagcatagggagtaaggagcagtgggtagagtagctggtgcaggcaggggccagcttatgtaagtcgtgcaggccttagcatggaatgtgagcgaactcatgactgctcctccaatgtggagttcttaaaagcacagaaatgagctgtcgctgagcatgtaccatattcctactactgttccacacaagactcacctcacttcctctaagcatgctctcactagacctcacccccctgggctttgcctattctatttattttgcaaatgttgctttaaacttcacttccttagaaaagccctccctgacccctcgactccccaccctcaggcaaggctaggacacctgccacacactctcataaatactttaccctttttaatcatagcccagattgtggattatgattatgtctttgattatttatttgcccctctctcttgattgtgagcactgtgaggtcaggaattgggtcagttttggtcgctgttattctctcagcccctgccatgatgcctggcacctagaacctagtcagcaaataccaaacttcttgatcctggtggtatgttcactgccccaagaaagtgaatgtcagtgggtctgattctgccatctcacatctgcagcaatcctgtgggggttttaaacagtccctgtagatgttgctttttacccagcctctcagcgacccagtagggcccacctgagagggctgtagaggcttcctgttgagttgggcttgacatggaaagtctgtcccataagtattacaagttatcatgggccatgatagtgtctatggagcaaagcatcttggatccaaatatatcaggttacccctcaagaaaaaggaagttcttagagaaaattgttctacatgccttgggaataaattagtctattacaaaatatgtgaatacatataaatataataaaatgccaaagtgacactggaaaaatcaataattctactcagcactacatattaaatcagctctttaatacatatttctaaggcagccattgccgccatatttaaatctacccagttgagagacataagtcaattgtgaatcccacagcgattaagttttttacccgttaatttcaaagcagtttgtttattttgttgctttactttggacttcatttggagcacaccagtataggtgactggtatacacactaggaaaattcacgcacacacaccatgcacatacatggaacatgtgtgtgtgtgaggtagctttagtacccagcacagtacctggcacaaagtaggcactatgtagctatttttattcaacatatcttaaaaaaaatactccatgaaaggaaatgccctgctctcgatcacactgccaaaaataaaacacaaacaaacaaacataagtttagatgacttggcaaacatgttttattgctttaaagtgtggtttctctgtcatgatttcgtatcattttctgaagtaaaatgaacagagttgatatgttatgagtaaggagtagcagagggagaaattgagaacacttgcaagactcctagattttgtactaaacaacatcagtgaaagagcaaatctatgagaaagtttaattttggatgttttgagtttgaagtattgctgatatatctatatggagatgtctgggaggcagtggcttaagttagaagatagagttaaatatttgagatccaggagttggtagtaaatacagccacagcgaagctaacaatgcagaacctgaggaggttcgctaagtaactcagaggcacatagatttatcagacatggcccctctgttcaaggagtttacattcctttcaggttgacaagatatacttgtcaacacttgcaagttcaaagttttgagaagaataaatgattaaggttagaatagttgccacaggcttccagaaaaaaaaaattaagacttgaattagcccttgaaaacggagtggaatttggagaggaaaattttcagaagacattcagggataattggagcaaatcagtcaaaatattcttgaaaacacatggcaaatgctggatttaatccaagctaattttacttcataatatcaggtagagtttcatctaaagctctccaagtgttagcttaagggatctttctaaagcagaactgaattggtggaagcaatcaacctaacagattagttgtagccctcttttcccttcctccctttctccctcttttctttttttccttccatctttataataatattgactaatcaccttatgtgacccaggcactataccctcctatataggtgcaattctacaaaagaaattaatcaatagaaaactgtgcctggaaatatatcttaaagaatgtagcagattactttgcagtccctatgtgaagggcagtattttttattaccaacagccattttgctttggttcattggttcaaacccaagagagaaatttccttctgttatcaggaatggttgggcgtttcctgagcaactggtttgtttctgtattatgaataccatgggtgttgtaactgtgtgtgcttcctctttaaattagttgtggaaaacttgggcttgggaacaaatttgcggctaagatgtactgaatcataaactgcagggttgggacaagggattcaaaaaatctcaacaagtgatgctcatgattcaatgaacttaaaaaccatggcttttgtttctgtttttaagaaacagttttgtaatgactgtttggccagtgactgcattccaatatagccccaggaagcatgtccagtttgcaatcacaagcaaggaattcttctgatatttggcatagaatttgcaagtaagttcaattgtaaaattccataaggttagagaagagttctagaaagttaggaattctctatttgtagttttagggtgtacttaaaagaattgcagttatttacgttagtatttcttgttatatcaagcacaaagaaggtgctccataaatatctgaagaacttaactgattttttttttttttttgagagagagactcagaaaagttaaatgactcaatcaaggtcattcaactacttagatgcagaaaccactgctggtgctaggactcacatttttgattcatagtccaatgttctctctgcagtaccagctccataaagaaaattgatggctctgtaaataaagcttcttttttttttttaaccacgtacttaagcttaagcaatcccatctgaatccccttagttccctagcttactcagccagggtgaaactgttaaacaaaccttcagtctacccagagcagtcattcatttgtcctcaaaaaccttttctttactttttttatggctacaatcatagagatgagtggaattggagaggaaaggttttagaggacattcagggataatttcatgaaaataagtattcatgaacataactaaaaatttaagcattgattttcagttgatgggtccatggttaagtttttggtagatcatcagaacgttatgagatcctagcatgttgaagtctcaactgggtacccctacaggcttaaatattgactttgccattatctagagcagtggttctcaaatgtggtgcaggaaggagctattgaacttttcatttatcacatccttgtaaaatgttgtgtacttttaatagcacatgcaataataatatgtgtatataatctatatacagagatatataatttacaaataagtatacagataatgtgggtttgtgcctttacaaatggatatgaatacatataagtttcagactactgatagagttctgaaaactaatttttctattgtatctacgtaagactactgagagtagcaaaccacagtttgttttttccttctctccctgtctctctcctgcccacctttcttttttctttttctttcttttcttttttattcttcctgagaatgttttccaggggtgtatctgcattttcaataaactaaactcagaaaggtaccacttacaaagttaaaccaatcaccagtcacaatagtaaataagcatttcagccattagccaaactcaatagctgtattgccactttgtctcaaaacattctctgaaatatcatcctaatttccctaaatacaaggaatctggctatgatcagtacagtctttttttttttttttttttttttttttttgagacggagtctcgctctgtcgcccaggatggagtgcaatggcgctatctcggctcactgcaagctccgcctcccgggttcacgccattctcctgcctcagcctccctagtagctgggactacaggcgcctgccaccacgcccagctaattttttgtatttttagtagagacggggtttcaccgttttagccaggatggtctcgatctcctgacctcgtgatccacccgcctcggcctcccaaagcactgggattacaggcgtgagtcacagcgcccggcccagtcttttcttaagatcacacacttaactttatatacttggcaagaaacacataaggaggaagtttttgttgttgttcttttgtttttgtttttatttgttcattgaccagttattttaatatgtttctagcctacttaaaaataaaagtcaaaaagtctacttaattatttttaaaatgtttagttcaccttctcacgagaggattttcacatatttaaaagcattttttctataaagaaataataaatcttttagctgattatggaacattctaagtattaataattagatttaagaggattcttttggagatgcaatttaaaaattctaaatgcatgatacacacttctgtgaaaagcataataatcacctatacaattagctaaatgattctcttgagttcaagaatataaattggtgagtggctatctgcattaatcagataatttccatgttttacttcgggatgtagacttttaaaaatattgccttgcgagttttattttaaataataactcattgaaatggaagtggaaaagtagatttaatccatgcttaatatttgtctgatttttgaaggatttagcactgttcctcagagaaccatggaggaaaggtaaaagagcccatctagaagcttcttggattagtttgctcattcatttcatccattcatttacttaacatttattgaatgcttattttgcaccacagtcatgtatgtcagctgtagactcatgcataacagttgtgattgctgacttacagggtatcaacttcaaatgatagactgacatttgataagaataccaatgatatcctattacattgattaatcattacttataatttgttttaaaataattgtattgtacatactaataaaataaccacaacttctagagctatgtttgaggccctatgctagtccctttagattttctctcatgcttttaagtaccctgcaagttgacattgtgtcacagtgtgggagctaagaaacgggctggactcagaacccagaaaatgtggctcggctctcttagaatctgagttatctgagtgacctagaacaaattatttgatctttcattgcctctgttgctcatgcacgatatgggggaaacaaaatcatctatgatttaaatacggctactgtaaatgttaaatgaactgataatatgcaaagaacttagaacagcacttgacactaagaacgatgtgtttgctatcactatgattgttgctgttgctatctgtattttaattgacaagaaataatatgctagtattaaaaagagaattatttacatattaactttgcttgggatgaagtaaagcaagcctgtttatcgaaaaaaatatgatttggtccttgaaggttgggtaggatttcaattcaagtaagaaaatgcattccagggaggaggaatgaaatgggtataggcatggatatatgataatgcaaagtaagtataaaaaaattagaatttagaccatttgacccagcaatcccattattggtatatacccaaaggattataaattattctgctataaagacacatgcacacatatgtttattgcagcacaatttgcaatagcaaagacttggaaccaaccccaatgcccatcaatgatagactgcataaagaaaatgtggcacatatacaccatggaatactatgcagccataaaaagaatgagttcatgtcctttgcagggacatggatgaagctggaaaccatcagcaaattaacacaggaacagaaaaccaaacactgcatgttctcactcataagtgggagctgaacaatgagaacacatagacacagggaggggaacatcacacaccggggcctattgtgggttgggggaaaggggagggaaagcattaggacaaatacctaatgcatgaggagcttaaaacctagatgacggtttaataggtgcagcaaaccaccatagcacatgtatacctacataacaaacctgcattttcagcacatgtatcccagaacttaaagtaaaaaaaaaaaaatattagaatttgggagtctggcatgtagggtatatggcaataagaatacaaaggccagattataaagttctatggtttggactataaagacagaacagggcaggtgtgtgtgtgtgtgtgtgtgtgtgtgtgtgtgtgtgtgtgtgtgtgtgtgtgtcagggggcatgcatacacaagtgcacatgcattcattcacactggaaaattcattgaccaggataacagtttgactctcaagttattattttctttctttaattgtccacatataatcttagcacttaccaaaagctgatctgaaaaggagctttaggaacaaaggacatcacctaggcacaaataatcacttaatttatgttaatagcaccccaagtctggacagcagctatcagttaaatagaccaaaaattagactgagatcaaaattactagcccaagcacagtattaattttctgattgatggtgagtaagagaaaactactgggctgagcttcagctgtatttcagggaacctgtacatttcttctaatttataaagtataataaatgaattaccaagaaggattagaagacagagtgtgaaggatgaagcattcctgtattcccctgatgtcagttgatctattaaattaacaagcatatagatagattatttaaagatcaatttagccacgaattgctttcaaatgaatacatcaggcatcaagccttttctctgagatcgttttgtaattggaatacatattacacacaacttctcatcacaggactcaagcagtttcaatcaggaggctttgctctttctgcaaagtgtgtgaaaatcaaaaatgagcagatccacttcattatgtataatgaggagatctgtagttactctaagtaatcgctgaaaagaattgctagaaaaatactccttgctcacatcactggcactgggctaacacttgtctctcagaaaatcttttcagcatgaaagttttggaattaagttcctaataaacttagaaagtccaacagctgtgagtaattatgatacaagcatatcaatccatgtgcaaacagatttattcggtaagctccaatcctcttgctaacccttcactgcaataattaagcacactctaatgagtttgttagtaatttccatatgattttcctcctaattattatttgagttgcccatgtttataatacttagtaatatccttaaagtatcaatggtgaagacacaattttggctggtgtattaatttgtatttccttattcatatgctaaataaaccaggagaaaacattcatttaaaggtcaaaatttttggaataggattttatgtgtgtgtatgctcatttcttatacacttattcaatacccatgaagcaaatgagtcatcttagcctaaatcaggtcatgtcattccctgcttaaagaactccgagttcttatcatggctttcaaataccattctgactttgtctcttaccacttgctacacaattggcttcagaatactgaccttcttcctgcttcacaaaaaggccaagctggtttatatcatagggtctttgaacttaggacagttatgcctggaatatccttttcccatcattttatgtagatggctcccttttatcatcaaaaaggggtccactcagatatcacttcatcagggaaaaccttgacttttagctgcaatagagctttagccagccattctctatcatctcacccaatcttattgttttaaaaaaaacccatcactctcttaaatgagctagttggtttattcactcctctttcttacacctagactctaagcttcactgttttcctaaaacagtgcctggtacatggtaaattcttaatgaatatttttacaatgaatgatttgttgaatggatagctggagcaggaaggaatgtcagctgtctgatctaccactcagtttatagatgagtaaactgacatatatttgcatctatgatttgtcaccaaaatgacacagcctgatagtgcagttctaggaaattatgtcccaagcttcctgactcctggtccaatgcactggtcatcctgctgcctgccttcactttttttcaatctgtctggttgtggttgttgagatatatgtttacacacaatatgtacttgggcactatttaaagattttgagaatcaaaaccctaccaacttcaattctttctagctatatggacaagtcacgtaacctccccggactttggttatctcgtttctaatatggatagtagtcatatactagctgtgccccaccaggcaagtgattgtgagaacgaagtaacaaaacaaattgcagatttgcttggtatggccgggcgcggtggttcatgcctgtaatcccagcactttgggaggccgaggcaggtggatcacctgaggtcaggagttcaagaccagcctggccaacatggcaaaaccctgcctctaactaaaaatacaaaattagccaggtgtggtggcacatgcctgtaattccagctactcgggaggctgaggcaggagaattgcttaaacccatgacgtggaggttgcagtgagccgagatcataccactgcacttcagcctgggtaaacgagagcgaaactccatctcaaaaaaaaaaaaaaaaattatttggtaaactggaaatatataccttgcaatgataataattaagacccggataccacttagtaacacagtataaagcagaaattaattcttgttacgtacacttttaaatagattctgacactgaaattccatagatatcacataaggcagtgttacctatagagaaatagaaacaaaaatagaaatagaaatatatatatccatatatatatatatatccatatatatatatatatatatatatatatatatatatatatatatatctttctcttaagcttagtggttctcaaagagtggtcctcacatcagcatatcaccaccacctgaaaacttgtcaaaaatgcaaaaatcctgaccgacctcagacctgctgaagtggaaaccctaggagtcagctaaacaatccgtgttttatcaagccctccagggaattctgatgcccactcaagtttgagaacttttgccttatatgattgaataaggcaaacaaaataacttttgtaattaatgaagccttactgtgtccatgcatgtttatagaagttcattgcaaaacctaaaagttaatactgcctcaaaatctaaaaaattaaaattgcatcaatacgtgtcgcctacttattttcatggcagaaggctcgcagaaccaaataaaccacggggagtagttatctataatgagatgggagaccaataatttatcacctatatatcatggctgattgcagaaggaggtcattataattacaaagacactccttctaattaggcagttcagtgaggaagtaaggaacttatcaagatggttcaggaaaaacaacagcaaaaaccacatttggtttttgtgaaaagatggtcactggtgttttctcccagaattcttgttgcatttctcaaacaatccttctggaattgacaagggaacagaatgtacggctgtaatggcttactaaatcttacaaagacagtaaaagttactgagcatcaaaatcaattttaatcatgaaacaaataggtattagagtcaaatctgtccacttcacttagaactcactgaacctgggctagttagttaactttctctgagcttcagcttcctcgtcagtaaaaagggaattataaaacctgcttcagagaattgttgcaaagactaaataaaaatgcatctaaaggacccactaacataccaccatgcctggcacaaaaataacactcacggcagagcgtggtggctcatgcctgtaatcctagcactttgggatgccgaggtgggcgaatcatgaggtcaggagttcgagaccagcctgaccaacatggtgaaaccccgtttctactaaaaatacaaaaattagccaggcatggtggtgcgtgcctgtaatcctagctactctggaggctgaggcaggagattcgcttgaacccaggaggcggaggttgcagtgagccaagatcatgccactgcactccagcctgggcaacagagtgagacgctgtctcaaaaaaaaaaaaaaaatatgtatatatatatataaacactcacttactggtggcttcccattttcatcctcctttaggtaaaaagcagcaaatagttctctttaaggctttttctctttgcttactctccatttttctgaaatatcaggtattcagggaatgagaaggagacaatgaatgtgagaagagagacatgatctcaacatatagcaacttaagtgtcagcatagatggtatttacaaaatgagccctgttctgctgagacaacagaacacagttgacagaaagtcttaagtagctatcccaaagatatatgtgacacacaagtagactccttttcactcctcctcctcatcttcctacacacaaacatatacatttgtttttttatacacacacacactcatgcgcactaaactgaatctattgtgagcctttattacctatacgatgtgaagccattgtttcttatcattcttgtgaagtataatacaagcatcatagcagagcttaaaagacttaagagagaaagaaaaagtgtagtagaattgtaaaaggattggacatacagaattcttcagtggaggaaatgcaatgcttggcttaactcagtgaactcagagaagaaattaaggactaatcttgatatcatttgcatgtgcatgctaagtttctgcatagacaccaagccccccttagcatgtttgtgtggatatagtatgtgagaaaggggaacagtgcagggatcatgtcttctttggacgagggtgttggaaattgcccctacatgtaaatcacaggacacagcaatgccacagtgctcagcggatgttcccaccgctcactgcaaaggggatgtgactttgtaatgacaccacagcagaaagcttctctcaaacagcctgccctggaattattgttaaatcatctatgtattaattacagctcctgggttttctaacagttttatagaggtatattttgtatgtcataaaattgtccatctgagggtagaattcaatgatttttggtaactttactgaaatgccataaccacaaatcagttttagaacatttttgtccccccagtaagatccttcatgaccatttatagttaatcttcattcccacaccccgccctaggcaatgactaatctgtttcctgtctctataaatttgccgtttctggaatttgccgtttctggatatttcctaccagtggaatcatgcagtatgcggtcgcttgtgtctagattatttcacttggtgtaatcttttttgtggtttaaacatgatgtagcctgcgtcagtggttcattttttttccactgctgaataatattccaactgcttctgttaaaaataaaaaaggctataaataaatgaatatttatttatacctctataaaaactgaagggtaacacatttccagtgaagactaagatccagattcagagtcaagttttgttctctggatcacacaggaacacttgcctgattacactttctttctcattcatttgttcatcttgtgaagaaaacaagtcaatgttggcttccctacatcacttagaaataataatttcacaatagattattcgaaccctaaatggtggaaatataaaagcaatttctggccaactgtggttaaaaaacaaagttctaggcattcatttggagggtgctatgatgcaaatacgtgttaagtaatgcaattgagttaaaaattatcatagtattgagatgagtcataggaatctgaaaataagtaggagcttcattacttttaatatttggaagtaaattaattcagtatcgcatagttttgctgatttcatttttttcatattctaatattgtatcagaaggattgctgcaatatttacatattgtctttgctgcatgcaatatagttaccctctcaaattatccacctggatccatttattttcataatgggcttctttggaagttgagttgtggaatgtcataaatgttcagggaaagcatgccactgtggactcagaaattacattaaaaaagcttccagtacacatgttgaataaaaatgggtcctataaagtttattaactaagcaaattaaacaaacttggtaataggtgtttcacatgaaattcctgaagcagcataaatgtgctttgcaacctgagtcccttgttattctcacataacatgtggctttttctcttttcccaatttctcttctaagtgtagcaaatgtttctttctttccctgggatgagagaagtccttccaaggatggtgtggatttcaagactcaagcaattccagagtgttgaaaaagagtcagtaggtggatttgtaatgacaaaacaataatagtaaaggtggtgacatgcactcagtaaatggtagctactattttgtatcaggcactctgctacagacattacgaggctggaataagataaacgcctcatgacatagcttctaccattgttcccatatggcagatgaacaaactgaggctcaaagaggtcaagtaacttgtccaaaatcacaaaactgagtgtcagagccaggacttaagtctagctctgtgtaatcttacagcccaggttcttaacaatcatactaaactgtctttcaaaatgacaggcacaagacctgtccctttcactcctgctggtactcagtgacgtacagtcatgcatctttcaacatcaagaatatgttctgagaaatgtgtcatttggtgatttcatcattgtgggaatatgcgagtgtacttacatgtatccagctggtatagcctactacacacctaggctgtatgggatagcctaggctgcacacctgtacagcatgttattatgttattgtactgaatactggaggcaattgaaacacaatgggaagtatttctgtatctgaacacagaaaaggtacagtaaaaatatagtattataatttcatgggattactgtcatacatggggtctgaagttgactgaagcattattatgtggtgcatgactgtacactaacaagtcaagtgacctcttaggacttagtctattaatctaaaggatgagaagtacattctaacatcaggtgtcttttctcgagcacaatcaaattttcattttcccaatctcttataatgactcatgaccgggtgaaggaggaatcagtgcaaattgcttgttgggatggaaacaggtgctagaagtgaggaaaaagcaatgttcaaacgcaaaggaagggtggaggaggaaaggtgtggagttgccacagggactcatagcaagcaaaaataaaatccagtttggaaatccaccagaaaatccccctcaatctcggaggcttctttcgtgttctttacaggaaacacttgtgtgttcctttccctttgtcagggacatataatttagaaagcagagaatttgttctttctagtttttccttttttttttttttcagtaaacatgaaggattaaagggaaatagacaacagcacttttaaaggatgctttttcgtaagactttcagtggatgttatccagtaaataagagtttcacagtatgctatcaatgttagtttggagaaggaaaggtcaaaaagtcaaaccttgatatctttatcttttcacaaaggttatttctgaaggagctatatgtaaaaggaaaaacaaaaggcaaatatatacacacacctatatatgtatatgtaatgcatatattacaacatagttcttccaatcctaattatatgcctaatgctgggcttgagtgtctattactttttaaactacacttgtgctattatttttcttataataaaatgagaataaatatggaattctctccaggtccccagattgctgtcacagccagcttagttcactttatattacccacctagctccagtacacacctgaatttgtgtctcttgctccaacacaacatatatatatacacacacacatatatatgtgcatatatatgtttttatatatatatgttgttttcatatatatatatgttgttttcatatatatatatatgttgttttcatatatatatatatatatatatatatatatgttgttttcttatatatatgaaaaacaacaaaaatcctttcctgtgtcactccaggtaatgggtttcactgtgtaactattcttttctgcaaaaggtttgtgttattatccttgggtattattttctgatggtatcagtgaaatgggtcattattgaagcactggcttacttatgaaagatgttattaaatactgtggaaatacggttatttccattaaaataccaaaaggaaagagaaatataaaaatataagaggtagttctgaggaaaccaagctgaacctcggaatatgagacaattggtactaaaaggtgttgttgggactaattttttcttggtggcgatcctgctttgcttcagttggacaaacgctacggggcaagagacacaaattcagctaggcaggtaatatcaatgcgtgaaccagactggctgtgatagcaacccggggacatagggagaattccatatgtccccccatcttatcaaatgaaaaataatagcacaagtacagttttaaaagtcatagacattcaaccccagcattaggcgtataattgggagtggaaagactacggcaagccagatggctcatgaaaaggacgcagctataattcaactcaagccaattgctccttccatcttttctgaaagtttgggtcaaattctaaagcaggataacagttgttcgcagttgaaaggagagaacgcagcaattgaaaagccattaaatacccggataggttttggagatgtgggacaattcctctaccttgtttatttcttgtaggtaatttggaactctcatgggttccaggagttgaggcgtgataataccaaagatgggactttaaatgactctgatgatgctatgtaaggtggcttggaataaggaaaccagtcctaagacattacggtagaagtagactgcagaagagacataaatataggtattagcacaatagcattggaaacgaccagacagagggaaggctggtggagttgatggatccacggtggggttaaagatccaagaaaatagccattgacagagactgttgagaacgatgactccactgacaaagcaggaccataagaaaacgaggatggccgggcgcagtggctcaagcctgtaaatcccagaactttgggaggctgaggcaggtgcatcacctgaggtcgggagttcgagataagcctgaccaacatggtgaaaccccgtctctactaaaaatacaaaaattagccgggcgtggtggtgagtgcctgtagtcccacctactcgagaggctgaggcaggagaatcacttgaacccgggaggcagaggttgcagtgagccgagatcgcgccattgctctccagcccgggcaacagagagagacttagtctcaaaaaaaaagaaaaggaggatgttgcgaagggaaggtgctgaattcattcagcatttactgaattatttcacaaggggcaaacattctcaaggaacagggaaattaataatgcacgactgccctggaggtgccccatgatctgacccccatctgtaggaggtgcttgtaagttcagttttagatagtttgagctcaagacactggcagaacccttcccaatttagaaactttggccttgtcttgactttccctctcacttatctcctacgttcaatctttcggtacagtttcactgcaagtcgccctgaagttttgtttcaaagagtgcctggggcacaagctctgtaaaagctttgggtacagattttctctgtccaaaaagcaatcctcaggacttgctacgatgtatccctatgtgcaaatacctttgttgaaaaacacggaagccaagcagtggtatagatgaaagcatggtgagccgaactaatcaagtgcatttttgaatgtcatattaaaatgccttagtaagagcatcatgggaaatgacccattctgcacagagactgaccagctttgtcaggcttatgcccagcacctggcttagacaaaggcttcgacaaatacacatgggtgtttatcattatgcaaagccagtgtgtaatgctttttctttttatattacaaaaagtatacacacagaaaacatatttttaaaaatataataattaggaattctactatttgttgatatgcaaaagaagggaattatcttttgctcactatatgtcaggcactgctcagtttttctttaccacagtgaccctgtttggggatctgttccagtgatggggacaacaggactgaatattagaaacctagatcatcctagaaaatctggaccatatggtcacgtacccgtaccttcctcattttctcctaacagggcctggaaactccagcaagttatttggaagtctgtttgatgtcagtctccagggagaagcgatgcgactgttctcttgctgcagtcggatggatgtctgtctgagaaagagggcggagggtggaagaggtgcagggggacccttcaccacaggctttgatctcccttgactcctcctgggatatctcaccttttgatgttgggaatcagttaattactagtcaaaattggtttgagggactaggaaacagtttgaaggctctgttctcaaaatgcctgtactttgttctgaggaactttcaggcaactttctgaagcatctcaggcaaatgagaagggctcggtctgtggcccctccctagtagcggcccagattttgatcctcttgtgctaccatggtaccatcctgatgcagcagacttcttttctcttcagagctctgtggtttcattggtagtgaaatgatgacttttaggattagattgttaaaacatctgtcacaccacaaagagtatgtagcttaataattccctctttaggtcttaatttgaaaccaccacctctcttttctgagcaacacctgattaatgctaccatgaactttttctgagcaacacctgagtagtgctaccatctcttgcaacacaaccttgatttgtaaggcactatattaaattagtgggctagaagtcaaatctcctgccttgcctttgctggtgcaagttaacatcctccaagttgaccttaaaggctgcaaaatgcttcaggagtttgatgggcaggtggtgctggagaactcagcattcttttctcttccaaacaaggctacacacctgacaccttgcctagtaatggaattctcctaatgaacacgttcccctagtctaaggcgcttgcactgtgaccataccacagggctgacaaagagataattttcagtgctcagaaaaagaaaaacacacacacacacagaagtcttttgagactgtctttttttcttatgtcatggcctattatggcattttcattttaattgcacatgaaacccatttaaagcggtgctgtaatgggactgttcccttggaaaacacagacaggagtgatatggatgtgtttttgaggagtccattagttactcagactgtcatcattgtgtgccttgagggtgctaacaatgtattaggtatctaagcaaatgtgatatatttgatcctcttatatgtgaatcccctgtcctcctcctataagtagtagattcatatcaaagtctctggcaacagagtactgctcagtatttcaaagataaaatatgcattcttatgcatgtatgttttctagtttttcaaatggaaattgagccatatagataaagcatgcaaacattgagactctggaattacttattgaaaagaatgattgataaagtggttattgtggttgcttcactcttcccacctccactttggaagatagacagcctgtacctcaaagagttttagaacttcctgaccttctgtaagtaaaaatgtcagttcccaaggccagagaaataaagccacagggtctttttccataaaataagctgcattccctgggtctcaatatctttagtcttctataggaaactgaaagaatttccactttgctttgactttccctgctgtggtcccttcctcatttagcatactttgttctttatgcataattggaaattaattttctaattaggttcttcacatttatgaagttgtttgatggggtgtcggttcttataacatggcctaaaggctaaaggagaggtaataattctttttttctggctttgcccctaattcagctaaggttcttaggaaatatatttaacttttatgagatccccgtaatacatctttaatgctgatctacctttgaaaggttgttagaagagtgctaactagggctttaagactcattatgatacagttgattttatttgtaatagttgctgaaacaaaatgaagtcatttctttggcaacatgaagggtatttagataactacaagtaacaacaactgcagaaaatacaatcagatgatactgggagacaaaataacattgaactgatacttgagaagcagaagtgaccctgaagattaaaaggcgagtatttttactgtgaatatacaagtagaactaaatcaggtatgagctgtatgagtccgtcacctggatgttctgtgacttgttatatagaacttgagtctatggttcaacactctctgatctgtgaaggcaagccagtataaaccaatgcatgtaaacagtctgtttcttgatttcagtataaaagttgaaagataaagctaaccattagacttggaagtaaaaactaaattctggagtcacaacttctacatatgtctcggatcatgttacttattactacaggtacaaaatagcgtgcatgtgaggagaacaggaaccaatattgcacattggtaaaagaacatcctcattttataggaaatcatgtcatcctacttgaagtgtggctgaagaaaaacaattagatgaatactcctcagcagtctccaaataagaactaccttgcacactaatttccattgtgcatcaatatccttatttgaatttgccattcatgtatatgtcacggctaggcaaaaactgtaagaacaaagtgtaaggctgaatatatgatgattaaaggtaagtgatactcaacctcagaaaaaatatttgtctgactcttgactcactctttaagttactttctaggttctgcacaatggaaattagtgtgcaaggtatttcttatttggaggctgctgaggagtatccatctcattttttttttcttgagccacacttcaagtaggatgacatgatttcctacaaaatgaggatgttcttttgtcaatgtgcattattggtgccgattctcctcacatgcatgctattttgtacctgtagtaataagtaacatgacccgagacatatgtagaagttgtgactccacaatttagtttttacttccaagtctaatggttaacttaagatcttgttaagtatcagcatagaaagaggctacatggtagaatgggaatatcactctgccctgtgggactcaggaggcctggtctgtgtgtccagctctaactctaagtgcttttgtgaccttggacaaattatctaatctctttggtccaatataggtcaaagaggttctttctgttctgaacacacgtagcttccaagttcttacctatcacatgcaataccccaagaaattctggtcactgcaacttcttgaacaagatatactgaacccaccagaagagagtatagcacagtcattaagagcacagaatgcagatggcatatttggttttcagcattgccacctctctcccactacttaattgtcttagccttaatttctacagctgtgacatggactaacgatcttatttcactaacctttttctctttcccttgctatcttatgctcttcttttcagttcttaatggtagggttttcttttgttgtaaaggtctagacagaagaccttgataaactagactatgccaagagcgaggaatcatggattatggattcatctttgggactggaaattacttgaccttaaatgcactttctctatggcatccaaagtcatcttttaaaaatgcaaatcaaatcacattatgcctttgtttaaaaactatcaatagtttctcactgtactatatttagcataaaatccaatctcattaccacatttaacaataattttgggcttattccttgctttttcttcttctttattatttttatcctcttctataacttcagtctcctcctcctcttctgccttcaggaggagaaatctatagctccaaatatgtgctcagtcccttcttgcatttgcaacagtgaggggaacacatcccccttgaatcatcccccttgaatatctggtcagtatgtcaaagctggaattcatcctatccttcccccaaaccaccaagcaactagcttctgacttctgttagtagtattcctattattccaggtaaccagcctcacagtctcattccatttgactcctctccatgtctctctttccttaattgctatcctttctatgtatgcctttatttgtacttccctttgcatttctactgccacagtcgtcactcacatcaggtctttcggacctgaaatagtgaaataatattcctctgagtcatctaacttctccctctttcgcttttattacaggttaaaaagctacaagattaattttctggagtacaactctgatcatttgatgtctgggctcccaacattagctatgtgataaagtctcaactctttggcttgactttcagagtctaatgcaacctgaccctgattacttttctaggctagcttactgcttttcatatattattctattgagtcatctctttatttttttcagcaaaaaatgattgaggaccaacagtatacaacatcctagtggtatgctaacaatacaaacgtgaaacttcgcaaaatagaagagagaccaaacacgcacccagacagacacacacacacactcacacacaagtattaagtggaataatagaagcaaagaatgtgatggaaaatagagtaacagggaagtaattttatatatttatttctttttctttttcttagagatggggtctcctttatttcacaggctggaatgcaagggtgaaatcacagctcactgcagcattgaagtcccgggcttaagacaatcctcccaccttggcttccagagcagctggaattacaggcacaagttaccatgcctagctatctctatatatttaagtaactcttaaaatattcttgaacttgaccttagttggatagcttactaattctaaatactatctcatatttcccactttttttttcttttgcttatatttcttcttttcagaatgtgctggtttttaatattcagtatctggtccgtatttaaaggcatacttattgaacttttatttttgcatccccagtgtctactttccttggctccatctcttccaagccttcagccaaagcagtttgagtgaggattgagcccttttccagaggtgggtcatgtgacctagggctaaaccaatcaatacgctacatttctctggccatagggattggttctggggtggcatgtgacaagctaggcaaacagctaatctgagggcttttgaagaaaccactgggaagaagtctttattcctgttgaacttgcagctgaaaggttggaaggtctggggttgccacatccactttgtctgttggagaatggagccaatctaaaaggagatagagaaaaaagaaatcaattcttgacactgtctctcctccaaatcaagtcacactatgcctctggaatttttagttacataagtcaatattgtttttttcttacatcagtctgagtcatgttttctgagagagaaaacaaatacagccatccaatttcaaatagtagtacttttactaactttttttttttactacctttatgggtactgccagttcaatgcggtttttctctaccattttgtgtctctcagttatggcatgtatgctgttcaacctcattttagagttattggtaaacttgcctcctaccagatttgaatggacaaaaatttctctttaaagctcttcattggcccagtaaatagggcctgaacaaaagtgagacaagtgaggtgcacaggggtccacgatgaagaagcactcacttccaggtgccaagtctgcacttagcagtctggagagcgagtgcctccttatcatttgctccctgggcacctcacttgctttatctatttctgatcctggtagtggagtaactactcaatacgtgttaggcgaactcgaaagaatttcacattttgcatggggatggagatgatccagaattgcattttctttgctattatactcatctgacatatctcattcacttttttttttttttacatttacttcattttggagtcatctagcattatgcagtgattgcagggagggtttgtgatggtattactctaaaaacctctaaatcccatttcccagcaagaagacaaactaatagctctgctaagcaatgcatccagaaataacatggaatatggggtagtgaatttcattttcactcatttacttatattttcatagctcagtgtctgttgtggagcctgaattatacaactcattatctaggtcaatctagtgagctatcctgtcagcacagatgtgctacttttgcaatagaattctcagtggtaaagttgcttccaagctggcacctattattagtaaaagtattaaataaataaattatagaaacagttgaagcaatgaagcctacacgataagtgcaataggttataaacattatgtcttcattatataagcaattgtgttagttatttaagattacagacgatcgatagccacatcttgtttgcgctagtgttggttcactggttgtaagcaacagaaactgacttcaaatagagaaaaggttttacaaagaaatatcagaatcaaatcaatgaacaggttcaaaagaaaaacactagaacagacaggaagcaagacagctccagtgaactaggtagcaggaatatatgttgaagtaataaggcataaataaaatgaatctacaccaacaatttttccatatatgattccactaaatttttgtcattgcattactctagtcaagaccaaatcctaggacaataggttcattcctggttataatcatatggccacctcttgaccaaggaaaagcaggccaccttgattgaaagtcctaccaacactgtatacaaacaacagatgtccattactttagttcagttagaatctgaaaggcttcaactgtgctacttacacatattctgggccaattgccaacttgtgttgaacatgcacaaaatcattttatcatgacactttgctgtatcagtcacatcacatttgttcaaatttgggaagcatgaagcttcaaaaatattcatagatgtgtaggtgaatttggtaggaaataatatttggtctttctgtatgttaattcaactatttggctaatcaaagtatatgatggtgtcatctatcagcaaacaaattggactgatcttactgtgagttttgttgaaacgtttttgacagtagatatggagaatgtctaagacacaagttttaaacacaaaatactatcctaaactagctcttttccgcctgccagggccaccttttgaatctgtgacctgtgcagttgtctgtgctcagaacacttaggttaacatccttctgtcctctcttgactctcttgaagctgttaataatttgttaacaaaagacctgcagtttcatattgcgccgggccttgtatattatacagctaatcctgaaagacacagaaccagtggaagccagaattacttgctagtgggaatactcaggccataaagtgctgcaactttgagactctttaaataaatgccatcttttaacactctaacaaggtacaaaaatcccagaatttgcacactccatattcaatgctctttcttcattggaagggcagcagaggtaagggatgggccataatggtagagaagaaccatagaagaaccagtggatgccactgacttagcatgtctcctgagcacatgtgaatgttacataaatactcattgaatctttaaaaagatgaaagcatgagcacgcatggcctgtttgcaggtccctgaggtgtgaacaatcgtggcatgtttgaggaccagaaagaaggccagtatgcctgggacagtgagcaaaggcatggtggaagaaggaaagaatgaagtttatgagggacccaggaaccgtgtcaagtaagggctactaggccagggtaggaaagtaaacatcatgggaagatgacttacttattataacatcatagtattttggtacattaagtctgaagcataaaactttttttttgaattttatcttattttcattttattgtacttattaaatatatgcgtttttaaaacaagttgtgtgaaggaaaacatattttatatttactctgttacaggttccaaattaaagaaatcccagttaacttggttacattatatatcaacagccctttcctttaatatcaaaaggcttttcttgccttttaaaagctttatttttaatgaacacataatgttatacatatttatagggtacatagtgatattttgacacatgtaatgtatagtgatcaaatcagagcaattcacgtatctatcttctcaaagatttatcttttttttttttttgcattggaaacattcaaaatcttccttctagctatttgaagctatatactatattattgtttactgtagtcctaccagtggtacaaaacacttgaacgtatttcttcctatatagctgttattttgtgtcctttaacaaattctgcctatccccttcttcccctatgtttcccagcctctggtattctctcttctacttttaatctctatgagatcatgtttttgtttgcttttgttttttatctttcacatgagtgagaacatggaatgcgacgtttaactttctgttcctggcttatttcactcaagataatatccttcagttccacccatgttgccatgaatggcaggatttcattctttttttgaggctgaatactactctattgtgtgtatgcaccacattttctttatccattcatctgttggtggacacctatgttgattccctatcttggctattgcaaacagtgctgcaataagcattcggggttcaaatgtctcttccatacactagtttcctttcctttggataaatgcccagtagtgggattgctggatcatatggtagttttatttgtagtttttttagtaatctccatactgtccttcacagtggctattgaagcataaagcttaatacaatgtcatttagagcagaggtgggccaacgttttctgtaaagaataataaatattttagcctttgctaactgtatagtctctcttataacttcttacaactactaaactctctcactgggctgagtaaacataggctatactttgggtgaaagtagacatagataatcttaaatagaggttgctgtgtttcaacaaatcttagaaaaaatagatagtaggccaaatgtggcccattagccacagtttgccagtccctgatctagcagagcatggagccacatgcatctatattagctgcaatgcacattaaaaatgcagatgtttgtgtcctcttccagatgcactgaacctaactttctgggtttgaagtctgaaagtctgtgcttaataagttgccatagaaagtgttattgcatgcttgtcttagtctgttagtgctgttatgacagaattcctgagactgagtaatttataaagaacagaaatttatttcacttctggaggctgggatgttcaatatcaaagcaacagcatttgaggtctgatgaggaccttcttgctgtgtcctcacatggcagatggcagaaaggccaaatgctgtgcgaagccttttttttttttttttaagaccgagtttcactcttgtcgcccaggctggagtgtaatgcacaatcttgggtcactgcaacctccacctccagggtttaagctattctcctgcctcggcctcccaagtagctggcgttacaggcatgtgccaccgtgcccagctaattttgtatttttagtagagatggggtttcataatgttggtcaggctggtttcgaacttatgatctcaggtgatcttcccacctcggcctcccaaagtggtgaagcctcttttatcaagatcttaatcccattcatggcagttctgcccttatgacttaatcacctcctaaaggcccccacctcttaatgctatcacagtgaagaataagtttcaacccatgacttttggaggatattcagaccacagcaatgccaaaattgagaaagttgagaaccactggtctagaagccagtctatccacttaggtccctttctaaggtattaaaaattgtaactgattgacctaggatagcacatggggtaatttctcagggtagaaggactaatgtttggaatggcctgtattcaaattcagaatggattgttccaggagactgtaagaaagatcatgtagcaagaataatagcaaggagagaaagctctgctagataaggctgtgcagatcaatcctccctttgagttccctggttttaattattgatgctaaatatacatttcccttaattgttttgtgaaaataagttaaataaagaataaagccattctatacatgcacaggcaaacattacactcttttcaaataaacactgggatgattcctcggagtgttcctattcaaatttggttgcaaaataacacccacagaatgtatttccaaccacaaaatactgtgacagtaagcagccagcacaagagagcctgttatggtttatagattgcaatgattatattgcgggagcagttgatgcatttgttggtgttcattctatttcacatttgcatttaaattcctgtggaacaaagataagataaagaggaaaacaaatgatgcttatttgttgttgtattgaactcctattataagtattgttttaaaggagagtgaagctttgcaaggaagcattccacatgtcctttacaaaacatgaaatacactttcaattgtcaactagaaatatgcaggaaaacatatccctgggctttcataaaatcataaatcaataaggaataactgaaaatgtggttgaatacaaggaagcaaatgaaatactcagtactttcctttatacatttatccacattttattgatacataagaaatgtagaactgcaatgagttttgaaacactattcgttttatttcaggcattcctttaaagcaatgcttgatatgtttcctctttcaaataatctgtgcatccacagcatcgtcctttgatgaatttatgcagatcagttctacatccagggtaatgttttctgctcctctaagctattttgctgggatcacagggaaaaaaaaatctttttgtagagttcgattgtaccttctagttactgactgggtataaggttcctctactcatacaaaaagcacatctgcctccccatatgatgtgtttgccataattaatttcagaagaagaatgagataatgttacctcttcctctcaaattagtaagttgcatatcagtgcctagaacttatttaaatcatttttaaaacatcacactcatttctgtaaatacacctgaaataaggtaaaaattaacaattaaatgacaacagttaattatatgatgtatctgaactcataagcaaaaatttctctgactttaccatgctttacggtgcttttctcaaaggaagcattagtcaggtccttttctggatgctggcagtgacagcctggaagcattccttaaagggagggctgtagaatgtccttaataagagatgttggactgggcgtggtggctcaagcctgtaatctcagcactttgggaggtcgaggctggcagatcacgaggtcaggagatcgagaccatcctggctaacacggtgaaaccccgtctctactaaaaatacaaaaaaaaattagccaggagtggtggcaggcgcctgtagtcccagctactcgtgaggctgaggcaggagaatggcgtgaacccgggaggtggagcttgcagtgagccgagattgtgccactgcactccagcctgggcgacagagcaaggctgtgtctcaaaaaaaaaaaaaaaaaaaaaaaaaaaagatattacaccaaaattaaatgtggtggtcaaattagaataattatgtctaaaaacctctgcttcctttttgtcccttcttggatattgataatgtatactgacatattaaaggctctaagaagtcagaaaaaaaaatgtctttagctttattttttcaaactttttgctgacagtaacttatcattttttaaagtctaacaccttgcattggcacttgtatttctggaaatgcatgttccgaagttctgacctaagtagtaactagtatctaaaggaaagtacattctcctgtctgtattacatattttatgttccttaacatattatatgtatcagccatatttattcattcatcatttattcagcaagtatttgaagaacttctctgtgccagtagcttgtgggtgctggggactcatctttttaagagcatatttttattctattttcaaaatgtatgaaaaacttagttgttagtataaataacaagttatatgaaaaataaaagtatcacagtgcatagactcagcattttaagtcaagcattcagaagaaatgcaaaatggtagatatttttccttagatgccattagggcacgttgcactgagcatgtaccttatttactgttgtgactgtccctggaatactaacaatgatgcatttaaatagcttatagttatgagttttagaatcagaagcaaataaatttgaaagcattaattccagcctcctgctttagctgaatttctattatctaaaccagccccttcaaatgttttgaaaatcagatcatatacaacattttataagcttcctatcttggaacgtgaatttagaattcacactctggctcatttttccaactgtaaagtgagtgagttgggttaagaaaatctatttttagaagaagtagtaagcattgaaaaagttcacagcaatttcaagccatagatttgaatattagcacctggaaaatagtaattctaattctcattcttacttagctggtgccacttgagtgatgtccctggagctgaaagggattgccaagttaatttggtcaagtggttttcacaaactatacatcttattaattattcctttgatgggctggtctaaacccagttcaaactgacttaagtaaataaggacaacagaaataagaattaataaataaatactaaaaagtgatttagaagatattgtttcacttcacctccgagcgcaggggtataattagcttcaggcttgcctagagtcagtggtgcaaaccatgtcactgatagcttaggcatgtttgtctgtctccctctggcttagatggatctcaaacaggccgtctactcactggttcccagaagctgcaggcttgcataatccttacaactagaaattcaatagaaaaagcattcaccttcttagttatcctcaggattgactctccttgggctgccctggtcttatgcttatgctgcaaccaatcattgtggtcatgggaatagaagggcctgattggccaggtttggaagatgtttctatctatggagtaggcagagactgatgataaaggatatagagtggggtggggtggttttccgcaaaggaaattaaggtgcagccaccaaaagaagctgatgcttggcagacaaaatcaacaggtgcccattgtatttattttttaaacgagcatccacacagaaccatgaggtacaaggtaaacaaaaagaggagattcttgctagattgggtatggggagttggggtggagagagactcagagatctgctcattcagccacatctcacagctcttgagagaagctgaccccttcctcgtttgcctggcatgatcttggtttatgtgtgttgttcattttaattactgataacaccccgttttactctcaaaagtggcgtggtttgcttaatagattttatggttactggatcgtggggattctttaagctttattagttaattcaccccaaacacttgtaaaactcttgatctacatccaccaaggcatccacttccataaatcagacttctgtgtttcatctgaataatatgaaaccttggaagagtttaactcatcatctcctctcattttacttgtttcccatgaaaatgaaacttattatcatttgatgcaattaatatttgtttttatttacccacatttaacaaatgttttgttcaccattgtttcttgaatatcaatcttttccctgggataaatttttacctttctgaaccgttcctttgggagtttgctactcaaagtgtggtctatggacgaacaccaccatcagcatcacctgagagcttatcagaaatgcagaacctgaggctcactaagtcagagcccatagatcaacaagattcccaggagttcagtagacacagtcaagtttgagaagcccattttagaacagtgaacttaacacaagatgttttcattttctattccattttgtctctgattctctcatattttaacctctgtgtctctgtcttcaatattatggataaattatatcttatctttcattgctgtctgctcactgtagtctcctaggtggcttaaaaactaagtaccagtatacacatttttagagatagagagacagagagaatggggatggggagagagagagagagagagagagagagagagagagagagagagagaaagagagagaatgaatgcctgggctcctcctcagaccatctaaattaaaatctgggtaaggaccactacaccaagagctcctttagttaggatttattggtgacatgctctcatttttctgtttgtctaaaaaatacttatgattcattattgcataatagccagttatacaattctaggttgctatttatttttcctcagtgtttcagagattgaaaagagtgtctttaatttttgttgctatctgttgagaataaactctttttctctgtaggcaatctgagttttaaatttctgctcagtactaagattcttattgtcttcaatgttatgcagctttactccattgtgactagatttgtatttcttatttcttattgtatctaggattttttgcagtttctaaatctgaggattcagattactgtcccatcttctatacattctttgctatctagaatgttaattggatttgcacaagatattttcattttctattccattttgtctcttattctctcatattttaatctctgtgtctctgtcttcagtattatggataaattatatctttcaattctaatcatttagtgaacatatatgcgtcaaatttttctatttcatgattttattttttcacttgaatgtccatttagaacatatcacttctagaagttcattttataatcagactggtttttccttgagagtgtcttgctccttgctcaatttgaaaattctttaaaaaatattcaaatatagttataggctgaatctcataatttcactatctaatgttattttctgttgtttctgctcaatactgctcatgaacacctgtctcttgttcatgttgcaatttgagcggagagtgaagttatgttatctggaattgatctgtggatattttgtgaggcctgagttgagggtgcattccatccttgtagagaaatttgtgttgacctctgccaggctctgtaaagtacaactgagtcaagaccactttgatttcttgtcttggggtttcctgaaatatgctggttatgtaaatttcaaagccccttggcctgaggataggcctgcgattatgtatttttcagaagagatgttttctccttctagaattcagcattagataaacaaaatccccttgcctaggtcttagttgactgtcaaaacttttttcagtacaatctttccctgaggggaaatgcccagctgtcaattattcattttgttaatgaggaaagtgaggctcagagttcaacttgctgggagtcacactcagcccctgaaagcagaaatgaaaagagggcccagatcttctcatcgtccagttgttttctcctccgacaaaacaagctacagaaatagcatcaccttcttctaataagaatggcttcacctttgcctccagttggacaagtaacagcaagattcagttattcctcatggttaagtttgatgaattatagaaataggttacttagatatattttaagaatcataagaacataaaaaagtcatatgagctaagacttatagtccccactattcagtattttgtcttttatagtagtaccaagggacattggtgtgacatgatgatagttgccctttgtgatattgtcctcaaagggggcatccctaactgggaaagatctatcatccaagaatttctctaaagccttcttgaactctcattacatttttggtttgtacaaccttaaggcactgctttacaaggaattgatcttatactagtcaggacatgggctaaataaccctgaagtccttttaaaatatgatttcaagtatcataaatcttgttggataatcacactctgcaaatggagggaatacagtagagtgatactgagctctgaagtcaaacagcctatgtccaaatacaggctttatccctatgtcctaactgtgtgaccttgggcagaatcttttactcttctgaatctctgtttcttctcctggacaagggcagtgactgtaggattatcataaggttactgggaaaaatgaatacaataatatacataaaattacttagcacaaggcttggcatacagtaaacaaatgaaagtattctcagtattaccattagtgatattgtcattagtgtcggtagatgtcattagtgtcatcctggtcacagacctcaccaaaaaagtggctgcgatcccatttcatatgttttaaaacatctggaggctgagggcagaagaggatataagagaccaaaaaaaaaatgaattattatactgtgaaagaattttaaattttatggattccagtatgtactaaataaatcacaaacttttcaggaaacaattgttaaaatatctttggatgtgctgttgtgggagtgcttcatattgaaaaagagagatataaactaaccaagtaaataaggttacttgcggttccattctgtattttacccttacataaattgactctgatatttggtcgctgggtttcctcaattattttatttttgccaaaaaacaaaacaaaaataatgtggcgtgtaatagctctaatgttaataaaattgaatgtttatttttccccctggaaagtggcctctccactctttcttaaatgtcccattctgcctcgacatttactttgcactagtaacaacactcaattttcattgacattatcttctaaatacaatcagatcaaaaatcgccaacatcattctcattcctctcctgcaagcagataatacaagacagggtctagctgataacttccacttcagtaacctctgattccactacttgaaatgctttgtgtggttttctactagaccagaggcagaggtatttgtgtaaaacaggcgattcccgtcagcaaagatgcaagatgtggcatttgcctttaatttccttttgctgggtacagggactctgtgaatgggcaggtccctgagggtgacttgtaccaactggagcctgtgccagcacggaccttcccaggcacacacttaacatttttccccaggggcttgtgcttaaatctgcaggttgaaaggaactgaagtgaaacttctaagaaatggtggtgagcatttaggatgttctaactcagttcacataagtgttgatgtgttctgtgacagtctcaaccccaaacgaagtgcactcatgtttactggcaaaattgggaatagtttttcaaaaatttaccatacgagtaaacttcccagtttacttaagctctccaagcctcagttgcttcatctgcagaatggaaacaaacattaattatgatattgaataaaaacattacattattacatgtgctaagttaaaaaatctcaaaattactaatattaaatattaatatttttagaattatttgagagttggctgagatcactcaaggacagtacttagagggcctggcatatttacatgtactcttcatatattactagcttttcatagtagtaatcctaatgtaagcctatgctaggtttcttttcacaaatggtctgaaatattcattcttctgtatctggaaagcaaagtggcctactgaagacattatataaattcagtccaaatgctatttgcacttgatatgcccagatgtttgaggtggaaaaaacatattgaattatctggatacttccttaatttgggggagaataaatttcctatgttggatttttgaatacatttaaggtgctcaaccatccaggtttgcctgagactgaaaggggtttctgggatatggcacttctcagcaatataactaggacaatcctaggcaaactttatgagttaccttatacattatagctccctgtaaataatgtaagacactcaaatatgatgaacttttaaaaatacacaggtcttttgtcaatgcaaaaaaattctttggtggagaaggagagagctgtatccttacatctgctttcagttgcaaaaatagctcaatactgaactaaaactggcttaagaataaggcccttgagtctggaggtggatagtttctggcttggttcaatagttcacaatgcctttgaggactaaagaatctctgtattggtgttggccgtatttgcccttgaagtttcattaggcttcatcttcaagcacctctctctgccacagtgacacccaaaccaggaaaggcaagtcaggggagaatctacctccagcatctctcttttttcatcagggactaaaattattctaagaatcactcaaatttctctcatgctttattagacaaagccgagtcatcagtccacccatcagtcaatcaaccaagtgcatggaattattagatatttagacaaaccataggtcatcctctggtctaagagagggacacagcttctctgagcacctgttaatatgaacaaaaatgagatttggccaggaaagaaggagggaggttggagaaacaactgctgtctactgagcagacaaacagtatctgccatgggcagtggagaggagacagtcgtctcactaatgtccactcctgttctttaggcagccatgtatgtcgctgataagagggcttcttgctgttgatttcccaggtgcctgggtataatgggaatagggcagatgtgccaccttctattgaatggcgtgtgttgtgaaggccagggaattcacatgaaacttctacatatctcagtttctctgtctgagcacttaagatatggccagcagcctcctaaaccagaagaggcatctaaccaaggaaaacacagtaaagaactcttcattttgaagtttgtttcttgcctgcaaatcaaataagatattgatctttcatctcaggagaaagtctttcattggcccttgatggcacaattctcataacaaagtccccaacaaagaaaatataatctggtgttctcacctttgaaaatctcctccactccccaagttgctccctctaagtgagctgaatgtgtatactctaccctctttcctggggctgcttcgtttatttaaggatgagagttcaaggtcactgaagaaaatctttctcagctccaccaagagtccccttatgaagaaacagaaatctagctcttgtgtaaatgatcaaatccttgtttaacagagacttaccttgtgatatcaaggtttgttgtctgatttatactgcttatgactcctgtgagggtgttatgaggtttcatgaactaatgattatggagtttaatattttttaaaaacgttccacaaatgttaaatgctattactccttgggtcactccctgtttgcatttaatataacttcctgcatcattcatacgctgtaatggagaagcagattccagggacattccctggctacttaggaatcaacagataccagtgcagcataaggtttaattttcctttttgcttttaaatgattcctaaaaccgttctgagagaccatgaatgagaatgatgtggaaatttctgatagtaaaggcttattgtaagcacagtggctcaaaactgtaatcccagaactttgggaggccaaggcgggcagatcgcttgagtttaggagttctaaaccagcctgggcaacatggtgaaacctcatctctataaaaatacaaaaattagctgggtgtggtggtgcacccctgtagtcccagctacttgtaaggctgaggccggagaatcacttgaacccaggaggcagaggttgcagtgagccgagatcccccactgaacttcagcctgagtgacgggagtgaaaccttgtctcaaaaataaataaataaataaaatatttgaacagaagtcgaagaataaattaactgcagaaggtgcgccattttaactgagcacacacttggcataacaataagctgattcttttatttggaatttccaaaacgaactttaaaaataaaagaggaggagcatttctaaggaatgcagtatgactttggtgggctcacggttctcagtgtttacatgcatccttgaatgtgctgctttatacatttctctagcagtttgtggtttgtgtttgtgttcagatgtgcaaggataatagatatgggaaaaagagtgatgcattttaaaattataccgtttgtagattgtggagaaagttcttaataagaagtaaaaaattagaaaatgttcatttaattgatttggtgtatatagttttgttcaaaataaatgtgtgaacatgtcttgctcaagaaaagcagcatttaagagggaaactcatcagactgatggttctatccgttgaagacagttaagatggaggaagcgtaaagaaaaagaaaaacacaaattagtatgagcacaaagaatgagcttaaacaaagctatgattctctcattcacaaatattatatattgtgcttttttttttctgatatcccccccttggctcctgcttctcattcctgtaaacagcagtgacacatcacacctgctgaactttttcacctccaactccaaattagaggaaagttggcttcatactgattgtactttactggggacagacggcagggtggcagatgggggagggagtgcctgtaattaagcaaaacggtttaaagtgtagctttcttagacaaaccgtggttgtaagttatagctgctctttacttgctaataattgcaaaatctattgctgccacttttgaggtttttttttttaaataaaagactattaaaatggaataaaagcttaataagtagattagttagaacaatagtcctcatgagaatgttttgattctgagtatagctgctaaagataaccctaaatgcaatcaggtttagctccctgcatgtgtgaaaggaaggtaataccctcagagattttgccaacagatgacattattttttaagtatctctttctacatttaaattagtctttcctctgggcacctgcaacaaaacctttgttaagaatcaccagagaaacagagctctgaataaatgctcagtggaaaattatttttgagaatttggttttagatgtttcacatcaaaaagatggatggcaatgcatccaagagggagcgctttgtgatccttctctgtcctctttgaaattttaaggatcaaaactcccaaggtgtccagagataagtacaaagggagccctgcaattttactaaacatatacacattataaagcgcaatgtgatccaatgtcaatgaaagtgtgtccatatcctgtcctttttgttttattttattaatttcattcctttggccagatatttattctctctctgtctctctctctaattctctccccctctctctcatcacatttttttttctgtgcactgaaagacctgtatgagactcaggaaacaatcattcacagacttgatcattcaaattgcaatgaacgttactactcaagagtgttcttcagacaggatggcacagacgatactgagagtcttcattacctcctgggacatgcacgttcacagtgagcctgacttccacttcctgtctctatccttccacttttttccttggaaggtattttcttttagattttcctatgtcagtgccctctagattacacatgctgttttcaacagcctgctgggcaaatctatcaggttccaaagaagtagtctgttttgcattcctccttgccatttttccttccccattcagttcatccttgcttcttttttgcatcccaagccattgcatttactcagctctgtaggagagactgggaaaccctggcactatcccaagtatgtagtttatgaagtcccctgtcaccaaattaattaaagggactctttcatttgcctgtctacacccacccaaatatgacaataaatgtgtaatcttgtgacttgtttcttttttccccaccatttgaattcagccttagactcatagttgttgaagtatagaggatatagaagaaaggcatcattaatatgatttggtctgacacacacctaccccaccccatagttccgtagcagtgctttatgaggataatgtgaattaaaatgaagtttatgttgagactattttgctgttgtataatagccctgacataaatggagaagcatttgagagtcccatcagccaaggagtaagctcatatttatttagcatagtcataaaacaggttaggtatcagtcactcacactattattttgaacagtagaattttataacctgatgttttaacatttttctcgggcatagctgaagtcagagtcatctggagactttattgaactacacagactgggccccactgcaagactcatcgacagcttgagtaaggcccaagctggtagatatttttagtttcccaagtgatttgacatcgagttaggcataagaaccatgaaaccagacttatacaaataaatattgtattttatagtgatctattatgtatgtctttatgaataagtgtgtgtctattataaatatccatttatcaccatgtcatgttaatccctttagaacacctataatataggtatattctacgtaaataaaatctttagctacagatatatatatatttatagctacagattatatatatatattatatatttatatatctccagaaatatagaataggcacagatattttcctaacaattatacacaattcctgaatgatacattctgcttgtaatatggaagttatgaattctctgggctataaacatttcaatagtcatagtaatgatcttttatggaactcattctatgtgcactgtgctgggataaatgtttttcctgcattatctcacttaatcctcacaacaaacctgtgaaactagtgcttgcatttctgctctaatgtaatatatgcattctttaaaaatcttgcaatgtgcaaaattatgcagtgaaaacaaaccaagatgatttatagtaaatctgtgttagagcagaccattcaaaacctatacaaactggtaactagggcatcaacaaaacaaaagacaatttcataaaataacaaaagacaattttataaaataacacactgacagagtatcataaatgtctgattcatttgtgtttgtgtgtatatgtatatatacacacacatatatatacacacatatatatacctttattttataaatatatgtacctttaataaaaaagatagattgattagaacctgatttaatatataacattaatgaaataaagataaattgattagaacctgatttaatatagattcactccccttgacataaaactgagatccatgcctgtggccttctggtgatctaacctcaagtactagaggggtgaatggatcacatacataccccacaggcaagtttcctaacccatcattcctcttaggctttcagtagaagcttagaatcaaataatcttatgtgatactctctgaagaaggtttggcattgcaatatattccactggttatttaaaatagatctgtgcgatctgaaaatcaaactgggtgttaacgcggtggattcctaaatgaaagtttactttaaaagatgtaagttcaggtgttcacgcaggcacctatttctctcagaagaggacttttgacaaaagattgacccaaggacaaaagaacaagagtggtgtgacaaatcattccaacagaaaaactttgctaaggatagctaatgaaaagtaagccaaaaattagttctactcttctaccctctctgtcaggcaaagcaaaaaaaaaaaaaaaagatgatttctcgaactcttaatagctcataagaggagccatgccagtttctctggagataccagcccaacctaccctccaacccccaaaacacacccagaattccaaaagattccaatatctttaaggctttgtataaaaagcattaaacaatcatgtctgttatggctgatagcagtgctaccaatgtgtagatgccacttattatatggccatttctatacacgtacctgtaggtaagactccataaagtaatttaaattatattttattatttaaaatctttcaggtttggggcgatggaaaatgtctgctgtgtattgttcagtattgtttcaatttttgcaatgtgtatatactgtttcaataatcataacaataataaaatgattctaattttagcataaaagatggttcccattaacaccgttttgacctgacccctatgccaaaataagtttgctcagtactcagtgagaaggatgctggtcctcttagttgtccaatggggaagttctctgaaacatcatttgtctctactaaagcccttgacatttgttccttcaactaagatgcatagaacatccactatgtaaactatatgtcaagtacttgagaatgtgatggccaggttcagtatttagcataccaaatgcttgtagtagcataggaggataatagtctgtgattgaaaagaaaatccaaatcactgctcaaatactcactttcaggctggtggtctcagaaaagggggtcaagtttagagaccccaattgaatctacagcttctattaaatttgaaccctagggacaccttttctccaataccttatttttttttttgagtgtagaacaattcatattatatacacccttctattgacctgtctatttgaaccctgcaggcacttgacaactaatgaataaaataatattgtgtgctcttggggctactgcagactcttttgtgtctataacggctcttatttttccagcaactgggagaggatacaacatggtgagaggctgtgtagaataactgagatagcatgggctaaaccccaggggcactaatgacattgtatccacagagcaaaatttgaatgttctgtaatgatgtcattaaactcctgaaaaagctaacttattgctgactagaatttctccattacattctctttaaaagaggaataaactccagggtgtgtagctatgcatgggtgttgacgttgaatagctgcctccagtcactctgctgaaactggctgaccttcttgcgtgcagtttagtcaactcagctgccctttcaatgaagacaaatgaatttccaggattatgcaggtcaggtcaccttaggtcaaaaactgattatacagtcatgccatcacctttgttctacctgggtatctttgaacgtttattctttaggtgctcacctttgatttggtgcccccaaaatgtttattcctgtaaaagtacatatgcaagtcaaatacagaaacccataactgatgcctctaacaaattcacattttttcccatggaggcagatatgcaaaactgacagtcaaaagcatttatttgaaaggcagaattgcagtaaaggaaaataataataatttttaacagacattaaaaattcgagaccaagtttctactgcttataacttgccttggacaagttatatcatctccgtgtgtctcaatttcctcacctgtcaagtgggggcattaatagcacccccctcttggggtggatcaagtgagataaagatttaaagtacttagtaagtattcagaatgtggatcgtgcaagagtaactgtacgtgaacttttatcagaggagcattagttaacagaaatgttatctttctaaagccagaatttaggttgtgtttctatactagctggtcacattgtcagcattgaagcttttataaatgtcttctagcaaatcaccacaatttttacattgttgggctctgctgagctctagccccagacaactccaaatttgcatttctcacttttgccttcttcatttcactgtctcaaaaaacaaatgcaagaaagtaaatcttcaacttagaacacccattctgtcaaactgatgtgctgtctgatgaatggtgagaaaaaaagaaacacatcaccccaggaatatgtaagctctccaaaaatatcaagtaagcccaatgccaatataatataatgagagtttgtaagtgcttatagtctaatgaaattggcatggtttattaatgggctgtgcctcctttgaatttggaagacaaaatgtcttgtttcctgtgatttggtgtgatacacaaagacttttgatatctgctgatatttaaatgaacccaaggatgtagaattcgatagtaaattgtcacttgaaattctcaagaagagaatctattttcagataacagtgatcctctgcttccattaataatcttgggctctctaaaattatatgaacccacagtacatttttgtaccatgtggctgatgcacaccttgaaaggctatgtctgagtgttcaacgacttgttattgctatgttcacgtgtcaccaggactgcctggctttaatcaaagcatccctggggtcatttgaaaacaactatttacagaaactttggacattttcttgaccacatgatttaatgactttatatgggaggtagtcttgcacagtggataaggaggttagaatcccagctctgctacttaaaatttggtggctttatttcagggtctgtatctttctatcaacatagtgggaaaaataatagtacctagctcaaagggagtaaatgagatctggtacacgtccagaatgaaaacagaagcaattgttatgttaagtcagagagtcgcattttcatgtagacagtaccacaaaaatattgttagatccaaataataacacagtaaatttatcttccctccattttcccatgttatcccagttactgtacactgctcaggttgcttgggtagtacatgaatgtcaaagatcagtctgactttcaaaaccttaggaaaatttacctaccccatgaagcctgacaatgacctagaacagacaacatgaactctcaagcccattcaaggagccatattatctaagccctggatcactgtaacaactccttatttacacagcacattcattccacacatggtcaaattttccagaatatggatgtcataggtgtcattgttttagaggcaggtccatgctattaatctttgattattagtatatttttctacctctgctattttcaacttatactgcagcctgtttctttacacagattttttttgctttgaaattaactacctttatctcactcattagtccccttctttactcattcttcttcatccatcgctaaacaattatcccataaaccagctgtcaaaacgcaagatgtggttcccggtttaattgggaacatacagtctgggtgaaaagggaaaactcaatgcacctgctctttattcttatttctaatgtctggtactcaagagtactttgacaaatcagaaaatgaacttgaaaatgtgtacaaagcaatatggcaagtataaagctatcctgtcacacatagaatatatacatttgtgtctgccccagagaagagtgatcacggttaaggggtttcattcacagaaagaagacttcctggagaaagagtgtgtgtgtctgtttcagaagctgaaaaggctgctttgggatgatagtttttatgcaaagtgactgctacctgctgctttattctgcattcatctcttataaataatatgtttttaataagccactgtatcttttgttggaacaatgcttcctagaattaaacacacatttccctcactttcaaaacgcccttgaaaacgttgtgattatactgggtctttctttgtgactcttatgtgttttgtcatcaagaaaaagtcaagctaattgaactatatgaggacagtgcacctgaaaatgacctcctgaagtcagctgctgtctataggtaattctctcaactaaatgtatgcatgttggacaataagggcacaaggtggtcagtggcctttccctctgcgctccatgcagactattccatctgcctttccacatgtggaggacaaaggaatgtcatcaagtctctttctcagttcctagtctaacagcgaacccttgtttaataatatcccagtgtttctagttaccccaagagaataatataacctgaaatgattccctaaacacagcttattttaattattcctaatgataagcaaaattttaccaaacgattctttaaagcaaagaatcacatttgctttgaatatgttattatgcatattgcttgtcacaccacacataaagatcttctttacaaagatctgcaaggaaacatttcttatgacagtactggaatagatgaggtagagaacaactgctttttttttttctttttaagacattataatttgttagaactttttggtttctcttggttggtaggcaaatcagagcaaaaggtttgctgtgattgctgtcttccatcaaaatctgtcagaatacattatggcatgtattctgtgtactaaccttacctatttttttatttttcaacttttattcaccacccaaaaagcatcatcattttgtaaaatcttgctttcaacatagatttctataggaagtatcaagtggttttggcgaccatttagttccaaaatatggtttatatattttaatgatatttatatatgataattatatgtttatatacttattatatatttatatatgataattacagaaaatactataaacctatttattaaaataccagagattctaagataagtttgaatagaatgtggttcaaattattaatttctcttccccaaatttaacagatccaagctactatactatttataatgtagaagaactagaaatagtctaaaagttaatcaataggcaattggttaaatattgatatgttgatgtaataaaataatatgtgactgctaaaatcatgatatagaataatacttaaagacatggaattatatttgtggtatattgtaatttaaaatgacaggtcacagagtagtctatgactgtttctgttatgcacaagaatagattttaatacatatgcaaacacatgcagaaaagattaaaaatatctgccataaaattatgactgtctctagataatggaattacaggtgatttttctatttattttatttttgtgatttttattttgtatttcctaattctctacgattaacatatgttatatttgtaatcagggaaaagtaaatgtctgaaaaagcaagatacgaaacacttcttgttatcacgtataacagattagttcttccttttaaaataagccattaaaaaggattcttatatactcaatgcagggcgttttttacttcagtggcaatggtatatagtgcctgaagattggtaaaaatagctaataagcagattctgtgcacagatttatccttttcttccctctgtcctcccaccggagtctgtgtttctgtcacagcacttgttacttaaaagtccagttatttgcttattatcctttgattccagccccagccacccattagactgcatctcatttgagggcaaagatgaatcacatttttttaggcattccataaatgtttgtggagtgagtgagtgtgtggctgagtgaaagtaaaaaaagaagaaacccttggtgccaatcaggccagaatagcagcagacaagacgccttctctcacagccaattttcttggctgactttgtcagtataattgcttcaaatccgtattttctctacctatctagctccagcctaaatgttgaatattgtattttccctcaaagaatgtcaataaagattttatttttttcaattactgttgcagagaatgtttccctttaggaaaactaaaatttaataacttttcttcggcaaagttgacgatctctttattctcgccatgatgactgtagtcaatcaggagtcagttggaagccaagctgaacataaagtaattaaaagaaaacccaaacacaaatgcaccctcttgaaaacctaatcacattatgagctctaagcatgagttatgaggtagctgtggctggctgggttttgatgaagtacccataatttcatatcagctgccacaggactttctgacttctctataactttaaaatgtgatttaccctgttatcatctacttatacagtcttcaagatctacctaggaataaatagtactaataacattctaagctgtattgctgtaagattcttatttttccatattcatatggtaaaattcaaatgataaaaataaagtaggtaattcattagatttcaaagctctggctgttaaaataaaagcatttcctcaattcagaaatcctggcatgaattcatatgttatcagctagtactatagatgaacttcttttgaaaatatgtacattatttttattcactttagattaggagtaatttgatttatttaaagttaagcgggtatgcggtagtgattaatttcaacataatatattcataattccactcttaccagttttctctcttggtactgcatgcaaatctttatttttaaaaaggtaatttaataggaaaacctttgaaactaatttcttaggcagttttcctgaaacatgttattagaaattgatactttggcattataagcagtgtagatttctattgtggaccagtattttgcagaaagagttacattttattgatgaaaaatctaaagtatagtcagtgtccctacatgtaaaaaaaggaaggctgaaccttcttgcaatgttcacctggaataggctgggagcttttctagaatgaatgaagcatttatggcttatggtccatcatggtggtaatgcttttttaagtcagctcttttcattggccaagataacctttatttttaagtgaacacactttttataaccatctggttaagtgtcatcagtctgtctctgcattaccttctcttttccttgttaactccttaccctgtgtctttaagacacaggctttggagaaagtatttcccagcctgtagtggactttccttctcagtgctcccataggctttgcagctgaactatttaattcatcgctccatcttccaaccaatattgagcccatttaatgccagttatagtacttggcactgggcatggtgataaaaaatcatgcctgtctttatacgattatggactttcagaaaaaaaatagccacaagtagggacttttgggaaaaattatgccctaacatagaataagttaaaaaaaaaaaaatccctaagaaagagttgggggaaaggtttccaggtaaaaaggcattataaagactgggggcaaatgaaggagtggtggttcacaaatcagaagttacaggtcagagggtgaaggctagaaatgaagtggggagattgaaaagggtgagatattgggaagtcctctaagttacagttaggatgttaccttaaagaccgagaaatatcttaagcacggagtgacacgaggagatgcacagtttagaaagcttagtttggccaaggtgtggaaaataaatagacaggacctagttgagaagctgtagatgctgtaaaccagatgagagacgacggtggcccagattagcagaagagtgtggagatgcaaagtactggactgaacccaataatgcttaggaaatggcaggactttgagataaaaacatctatctaccacgcatcctcgtcattccaaattacaattgtttattttgctagatcccctgtgtaactgagttttttataggcattttttataaatctggagcctaactcactgcttaacacattttaagtgcttggtgcacattaaggaataaaccttgattgatgctgtgtcataaacttgaatgatgttgtttttagtgtatccgtgcctctagaaaacagttctactgaaactgtaagagaaatgaagttgtgatttgagttgctaactacaaaatggttttcaaatttaattttctgttttcacattttaaaacaattacgaagtcaaccttcaaaatgggaatttttactctataattatatatgcttataaattgttttaatatgctccctaaaccccatagttcaaaccacattttcaatattattgtttcaattatttcagaatttttctagcatctatatgcacacggacacacacattgtttttcttcttttcttcttttttaatagaaaaggaattatacactacatatagttgtgctccttgctttttcctaatagcatatcatggctatctttccattttagacatatagcctagctcattgaacagctgcagctaatttcagagatggaagtacaatgattttattattcccctactaataggcatttatgttatacctattttatgtgatgtcataagcaatgatggaatgaataactttgtatatatacttaatttctactggacagatacctaaaattaggcttgctgaatgacaggatatatgcatattaagagtatgtgtgcttgtgtgtgtatgtatatgtgtatatatacatccatattctagctatgtatttgtttatatatatatgcccatgttctaattatgtatatatgtatgcatatcatatacataatacatacaaatatatgtacacatgcccaaattgccctccaaaaagattgtaccaatttgttatcccaccattagtgtaggagtacccagttttccatatcctcatcaaaactggccaaggtaggaaaaacatttttatctctttcaattttatatgtctgggtgacttctagatgttacttccaaatcacctattttctctttaactatgttcattctgccattctattatccagtcctactcttaggcatgtgtgtgtgtgtgcgtgtttgtgtgcgtgcatgtgtgcacatgcattctgtgttccttgagaaaaaaagcacacacacaaagagagaatgcccttccttccttcctttctccttccctttcttccttccttccttctttccttccttccttccttcctccatccctccctccctccctccctccctccctccctgcctgcctgcctgcctgcgttccttccttccttccttcctcccttccttctttttttctttcttttgctctgttgcccaggctggagtgcggtggcatgatctcggctcactgcaacctccatctcccaggttcaagcgattcttgtgtctcagcctcccgagtagctgggattacaggcacacatcaccaagcccagctaatttttgtatttttaatagagatggggtttcactatgttggccaggctagtcttgaactcctgaccttaggcaacctgcccgcctcagcctcccaaactgttgggattacaggcatgagccaccgtgcctggatgagaatgccttttcatagaaacttattgttatggatgcaatactctcttgcatttctttcttgataaaatgattatcaataattttgaaaaattattcttcttggattctggcaaactcctctgggataggtgtttcccttctttcatagtattggtgttccttttatatggagattctttgttaaccgttcgtatttatatgtacaggcagagctcaggctgtaatgctcgctcacctgccattcacctcctgctgcgtggcttggttcccaacagacggcctggggattagagactcccaactttagatggtataggcacagaactgtcaggcaaactggggaccctggctgtaacagcaagacttatggtattagatgcttgataaaatgtaatcagactttctcatagtttacattacacagaataattatactcaggctttgtcctttgttgttttattggtgaggagacaaataattaacaaagaggaaacacagtaatgacacctttctttccccaggaaaaactttcaaattacctataataagacttgatttaaaaatatatatctcaagacattactgcttttaaagcacatgacatctgtttaatgtattggacatgtctgttaccatagtctcctgcactaatggataataataatagcaactacacttatttctttcacagcaattataatctgtattaattgtgtacatttgtttgagttagagatttattgcctgtatcctctaatatctctgtgacatgaaggaccatgtctttttttttttccccccctgggcatcagaaataaaaagtcaagaaagtagatatggccctggctgccatttttatattagtttgtcctagttgctgaaaagaaagatggctcctatgatgtcatccttcccccggttgcacaaatgtcactaacctcttaagagaagaatactgtccatgcaaaatagaataatgtccactgcgcttatcgttaaaaactagagtgtggttttgttgttgttatataaatacctggttgaatgtaatataatcccaaaagctactgataattgggtttatgtgggagaataaacataggcagcgttagaaataacattgccattttctccatgccccaaatagcatggtttcttgagatagggaaaaccatatttgtcagacctgaaatttatgtttctctgaaaggggcacctgacattataatgaaactcacaaaagcatggaaagaggtttggaagaaaacgaaatgttccaaagtgtagaaataattgatggaatcataataatgctaattttaataacaatcgatctatgaatggcctgccagcttcactctccaacacattgtactcttatttatgatgactgtaatgtaattggaagtatttttcagttaaaaatgcgtgtagtacttgcataaaaggaatgcatcttaggtggctgggtggccattttgcttgcctatggctccccaagctttcaaaaagaagacattgcacactccatgtggatgtggcagtggggaaaccagaaggtctcctcctgcagctggcgaaagaaccaccagtgccagcttctcttctccagtcgtcattcaataaaaggacgcagaccaacactaaaatttattttgacgaggaaaaacaggaagtacatacccaggcctctgtgatgaggtctctaatacccactgggtgcttttgcatgagacagatggtctcagccttgcctacccatcccaactggttggtggtctttccaaatgatgccacctggctcttggttcttatgtgggtgagcacaggggtagcctttgtctcacataagcacaaagcaggaggcttttgcattctggagactctcagttcattctctgtgccttcagcatgaaaaatgcaccactttctgtatctacctgatcgagattgagggcacacgctgacattttatccatggtgtaaatgagtaagtacgtggggagaatgagtcatgcaacaaataaagaaatcttgtgctctcagatagagcttgggtaatatgtaaagaaagattttaagtctaaatcccttgtctgtttttccacattgctagatgggaaacaaagagataatttagttaaaacattttgttgagaggataaagtatgctataggctattttaagggtactaaattatttccttccatcgccagaagtctttttcccattactaatacgaacagtcgtatttgttgtaatgttataactgtcctaataagaatactcatctttactgagcacctactatattgagccatcttcacatgcactatctcagttgatctatgaatattttgttaataaatatccagggtctattaatgccactatatcatagatgagagaaaactgcaacatacagagctgaagccgtgagcctaaaggtacattgcttgtaagtggaaaagctaaattggaactcacataagatcttatggaatctagaccaccagctctcaattggtactcagtgctgccttggtggctcctatcctagggtcacattttagaaacagactctgaggacctcatgtggaattgttagtcatcaatattgctaagcctttcttctcattactgtcgaccttttcagaaggcaacttaaaaagagaatggtggaatgtttgtatcattgaatataagtgctatttttgaaaagtgactcaaatgtatagtttaagggagaaaatgaaatcatctgtgaacattaaaagttatctcttccttttagttatctcttccttttatttttacatggcacatgtctgccatgccaaaataagctctgccctcctgttttcaggccccaagcctgtgaaactctgggtcttcataagccatcttgaatcaatcagttaagcgatatccttttatccttttcatcaccttcctcagccttcctcggccttctttttccttctgtactcaattgtactctttcctaaagaatccccgatgtgatctttcacatgctgtgggaggaaatgtattttcaatatctcagtggttgatactgctggttcattgatatatcagtagtttttagagaatgtttactcctgtcttgcacttaggagtgtctacctgttcccaatgtgtgtagaagtgcaaaatctttttataagagtttaccctgaacatcatcaaaagaatcatgtagttgcaattcatgataaataggttatctgtaatgatatatgatagtctgtggtaggtggtaaaaaaaacacactgtgttcctgttgctaactatagggcacatttgcctttgcaaaaatgattgaagggtatagagggcgtgcagcaccaaggctgggtgagaggcctcatacgctttttcaacagtgtatggttgagtaccagcttgtagaagcaggtagttatcagcatgtggagcaaaataccctgagtttaaatctagcactacccctagtggtggtgttaccttgagcaagtcacttccacatcctcgtcagtaaaatggaaataataaaagtatgtttctcataagattgacataaagatgaaataaaataattcattgaagagcttaggctagtgtctgacacataataagacagcgtgtattgatcacttactattattttccaagatccaccatacttgtcccgtggcaaagaacatctttgtaaggatacatttgagaaggataggctatttccttcctaaatgcttaaagcaatgcagattcatgcttaatgaccaaaaagaccatttgtgtggagcctatgacttttcctatccttaatgttttagattagagatggaaaagtctgctgtcttaggtgaataatgatgcatgtctttatgacttaaaatgttcaaaggagctgtagagcattttttaagagtcatttcttctcaggcattgtattctgcaacccaaacgttgcttgctgtgtagttacttggggacctattttctttaggtagtgtctgcatagtagtcactctggttcaccgagggctttaaaaatggaaacgtttacaaaatagaaaggcaggtagggctccgcacaagtgaggcctgatgtgtttctatggtaaccccattccatatcacaagggtcaatctcatggaatgagatgatgttcagagatatgttctggaattttcttggctgtcaacctaactatttgggatttgaaaaaccaaaaaggatgggtagaccacttgaggtttgctgggatgcctggagccattagagatgacttagatgaatatggaacctcaagaaatgaggcttctgacacctcaggggttccctcagcttaggagccccatttctattaggttgatgcaaaagtaattatgtttcttgccattgaaggtaaaattggtgaaataattcaccgagcacatgttgaaatccaggaggagagagggaggagcatcgtccaaaacagccccagcttcatccccagagtccccacctgttgaaagggctattctcaaatctttaaaaacacattgccaaatacttgtaattaacaaaagggaatctagagtatgggggaagttatatctctgccttaatttgatcatctggtgttttgttactgaccttgtgtgatgtgttctccggttacctcggggaaaattgactcaggctgtactatagggcaccaagaaatggtttaagtttgatttctttaagtcaaagattttaaatcaaaatggtaccaatgtcacattacatttgatttatttgcatatctagagaatatatacgtatatgatctaagtattcagtgtaattgtcaatatgtattttttaaaatatgcatatgcacaaaggttatggagacccttattttctgaaggaaaaaaatagctggctgaattttcatcatcaagtagagaaaggtgaaatggaagcattgggagagggaacacatacatgtccaacttagttatctgggaaaaactatttatgtgggaaaaactatttctctacctacttaatgttttcattttgttccaggctcacgttgatggatatgcaagtttgctcacttactgtgctagcattgacgttgagagttcacagatgtttcagttgagatatttaaaaagaaattctaaatgatcaaggtactttgagtttaaaacttaaaaaaaaaatctactttatccagccaacttcacactatttatagtagcagaatttggtacagcaaaaggaagtgagaattgttctttcttcctctctgtctctctcctttccctttttctttttaaatggtacatttttgtatgtgtgagaaaacattagaataaacaaataagccaagaaaaaaaagcacttgaaaatagactgcagtcttgccatttagcaagaatcactatcaacattgtgagaaatatgcttccaggactttctctagaatgatatttaatgttgtaataaaatttacaacaataatagcggtatttattaacagttactctgtgccaggcactttgaaaggcactttacatttaatcctttatgaactatgtgcattgtttttatcattcttgatttatggagaaactgagggagggatcagtcaagtgatttcagcaacgttataaaggtagtcagagtaaatggcagaccccagtttgttctcaggaagactggttcaagattaccttctcttacccctctgtcatactgcttctcactgtgtgtattttgaaacagcaatggcgtggcgttttactattgctttatagtcttttttctcttactgtattgtgaactttccccccatgtttttatgtattcttctgtggcatcattttttatgattctccttgtgattccatctaaaagagcatgtgatcacatccttaaatgatcccctattgttgggcatgtagactgcaccacaatggagaggttgtttaattgagaatttccgtcatcatcctcaaaacactagtgttccaactaactcatgtaccaactttgtttgaaaaacaaaacagattgcatgttgcaagacagagctgctggcaaaatactccatcgtgtcagatttatacaaacccatctcctgtgtattgcaccatgtcctagaaaactgaaaaccatgaaaacaagtgctcatattttaaggaactcaatgacagctgataaaatattgcattttctgtagcagtttttacataaagcttccaccttaaagaaatggatttgatgggactaggtggtaattttttaacacaagcagtgacaaaataaacaccatctgttagtattgacttattccacagcattctcaggctgggtgattttatttcacttttttcagaaatggttaatgacacatctggtagtcagtgaaggtacactctgggtgattaaatgtggtcataagtttacactaaatgctgacagaacatttttttttcttttccattataagcaacggggcacatcggagtgcctggctggctactcattttaaaccttgtgtaggattaactgtttggcggtcgttgaacttccggaaaaacgttgttattttgagtcttctgagaagcagataccaagacaggattaggtatgcaagaaatttattgagggaaacacctgtgaaaactaaagcagaggtgcaggagaaggcgagaacagccttcagatggcaatgtgagtctggcaccagtgaagggagagtgggaaggaaagaggagtgggcaggaagagccccaggcagcagcacattctaaaacagtgtcagccaggacgctggggggtcctggagccccagttgcccatccgagcttttctgcatcctgcataaatgggcatgaattagtttcttcactgtgtccagtcattggcagagaacagacctaggaacctcagtacacacacagtagtggatctgaaggggatagccagtatggccctccatcaactctgttcccacagccagagatccgaggagtgcattttcatggtcaccaaaaatctcaacacaaaaaaatgaaatgatcaccgaattcatttatctctgcatgtctttttaaagaagaaaatacaatatttaaaatggccttttctcccctaatgtctccattggtctagcaggcatggcttgcactgcagaagactagcgtagctggaatagtaggtcccgtttatgctaaattctatcagtgaagggaaaggggagagtcctgaacactgttcttacctcttcatctgttcttttttttctttttttctttttttgagatggagtctcgctctgtctcccaggctggagtgcaatggagcaattttggctcctacaatctccacctcttgggttcaagcgattctcctgcctcagcctcctgagtagctgggattacaggcgtgagccaccatgcccaggctcttcatctcctcttaaactctcagagactctgctgctgctgttaattttgctttcagtgtgaagggttcttttggtttgccataattttgggcccatgacccgggaacttcacctcctatttgaaaagaaaatcatctgggaatggaagaggcgaaatttaggaaaaaaacacacttttttttttttttttttttttttttagtaattcaaaccccaaaacatattttgaggggcagaaggaaaaataattaatgctgtatatgatcacttcctacatgtcaagccattatattgttatcatccttaattcttaaactcttttgagacaagtaaagttatatttttatttacttttatgtatttttttttaagtttaacagaagaggaaagtgaggttcagaaagatctggtgactttttattggcacacaatgagaaagaacagattggggttttttccctgtttttcttgagttggtatacagagtagatttgccaaagagctcctcagttatgccagttactttacttatttgggaaggacttctcatatttatacagatatctttcttcacatcctgaaaagggcactgaacagagagagctgcatgctattaccattttttgcgactaaatacttgtgtggctgtgaattagttatccaggccttggttttttcatctgtaaagaaaggagattgggttagataacatttatcaaacttcagccattttccattttctatcaccttgatttctgtcccatctttaatgccacctataatatattgcttgatattttatttaaaataattcctccttgcaacttaagtgtctttaaaataaaaacattttgtcaccgcttaaaaggaaataccagtataaacaagtaaaattacacacacgcaatcacacacacatatatgtttgtatatatgtatgtacgtatatattcgtatatatgtatatatttgtatatatatccgtatatgcgagtatgtgtgtgtgtgtgtgtgtgtgtgtgtgtgtgtgtgtgtgtgtgtgtagagagagagaggaatataagcaatgaaatgctaggaacaaactgagactttctccttaatataaccagaaactttgaagacaaattgaaaacaaagtatttctaatgaaaatgttctggagacccaaagttgtttgacactttgtcacacttagtatcattttctgggcaaccaatgtcttatactgtgtcagacactggaaaaacatgacttatatattctgtctcacacacttgtgattttcctccctgccccaccccaaccttcatttacctttggcctcattttgcctcatccttccaattgcaaaatttgtaaggaccatctctcctctgactgcagaaatactctctgcatcttggctcatgagtagaaaaaaataagacctggaacaaataagaacaatttcttcctgttcttctgggaagtttcaagggaaggaagtagacagagctcgatagtctgggtaaagcctgaggcaagtcacactgtgtcttccaccagcaggtgtttacccagttaagatcagtttaaattgaatagtgtgcaaatgaagatggagttttcccttatatcccatttctccaatcttattgtgccagtctgccttccccgcttctgtccctcagcaatcaccaccagaaaattgtccttcactacatattccttgatggtattttagaaagagtagggtcattgcgctcaaacagaacttggttcaaatcccaactctccctgacttcagggaagagacgctgtggctcctggtggttaggagaactgggagttctccaggagagtcttcaggaaattgatggacaagggggatctcgctggcaggggaaagagaagtcagaggaagagaggttgggggcatagccctggtcccaaaccagttggcttttgcagagggtaagtgatacacaaaaaactatcttaagtagtttggacctgagatctgaagttgcccgtgtggttaaagtctcacctattttttagcaccatttgcgggagaggagtacctccttcttgaccctctgccttgctaccaaaccctctgccttcctgaataattgcttgatagccttctctttcttcctgccctctttgccaccccggaataccactacctgaaatgatctcatttctgcctatgtctacttgcttagtgctggtctcccctcactataatgtaaagttcataggacagaccttatctgccctgttcacaagttgttctcagggtctagaacagtgctggcaaatagtattaggtcaataattattaaaaaggtcaaatgaattggccgaaggcaattgcccccattcactctaacttagtaaattagttcctaattctggctgtgcactactgtcacctgaggctttattggaaacacagtttccagatcatcacccctggacagtctgattccatttgtttggggtgaacctgaggaatctgtatttttaattaacatctcaggcattttggacacagccagtgcctggactgataggtgggaattactcccacaggaaatgttactgaaaacagaactttattatcagcatcacctaaaccacatttcttatgttacagactataaattaaatatatatgcatgactttaaaaatatatacctccaagccacttccagtttgtgtatgtgcttctggcagaagcaattgtatttattcataccctgtatccaataaggtagggagacccagctgttcaagcaggtgcctccttcccaagaaaaagatagatcgattagattaacaattaagtggtgaactgttgagaggttgcccaaatggcctttgggctttcttctagaatggcatcaatgcacagtagaattgtggcagatggacgatagtgttgcatatgcactcatgctgggaatgaggccattttgagctcctccactggtccctcaaagggctgcctggtcggcttgatggcttgagttggcagtagggagtaacaactgagagcccgagctttagagacaaacagccctgggtctgaatcacagaatggccactgattaaagggcattttacatagcctttgcgagagcctcgtatgtttcatctgtaattaggaatgctgttctctaattcattggtttgtgctgagctattagtagagtgtggctggcattctgtatatacgatgctcaataaatgcaaatatcataacctctgggaagactgacttataccattccactgccgcaattgccgtaccaaatctccaaagactaagaaatctgcccctattggtcaatagaggggctaggcaaaagtgtttggttggtcatggaaaattgaggataatggaactttaatatgttaaaaaaattccttctccaaatttcatttgacacttgctatatgaatagttaggatttaatgaatacctttttatagagttacataattttcctgtaagatgcattgggtttccagaagaatgttgaacttgattcaattttagcttgattcgggctattcaaaatttatttcctgaggaatagtctcattggataaacttaggagttgttactggaagactgggtaactgtcataatgccaaacatcggtgctcctctccctcactgttacctaaattttaagaaatttctaggcaaaaaaaaaaaaaaaaaccacttgattaaggcagaggttattaagtatgggcaagagtgaagggcctggagttgatagtggaaaaaatatagcttagggaatttcatacccagaagcaaaaccaatatgtacatagatcttaatgctgtgtttcacttacagttcagagtccactgccttgcctagcatgttcaagatgttgtagtgccaccatcactgtatatgaaggctaattacttggaatattccttactgggtataagtgttccccaaagatttagcttaaggatggaactcaagagcccagcacaatcattccttttaactatttaaaatatattttggatgcacaacagactaattgattgaatgcacttttcacaattccacttatctaagatttttagaaaggcaccagaaatctcaagttgagattttagtattatcagaaatgtacaaaaatcatcagcctcctaaatcgacatcttgcttgagttcctctattcactctacctcctctgcacttatccagctcaatttctcatcccaagtgagcccatttaacatcttgtggctatcaacttacaaggtaagacagtaagagagggctggttctcaattatggccttatgttggaagcacctggggatctctacaaaactgggatcctgattgaattggtcagggtgtggcctggaactcaggctgttaagagcttcccaggtgattctcatccacagcccaggttctgaaccaatatttaaaatagcagagcatcccttaaaatagcagagcatccctttccccaggactagaggtgactcagctgtattttctgtgcctgtgtttgacgaattagttgcaaattatattcctgcttttacatagtaattaaaacagtcatgttttcatgggaggttccttcatgctgagcctatccactctgtcatttctttgcttccttagtatgttgtcttttaaatgagcttagtggaaaaagtctggttggtgcattctgagcctgctaatcatttctttcctttcccatccttttgagaatcgggccccagctcttaatctcttggtgtgcatgaatagttctcattagttgtggtaagtgcgttaagtgaaactaactatagaagctcactgaaactggaccgtgtaatcacattgttcatcagaagggattttaatgtttacatgcagaaaaaaaaattgtcatcacaagtagataaatagcccattattttacacttgagttggtacagcaggagcaaacagccaccaaactacttctgttgacattccagttgagctgcacataagagacatgtggatgtatcctgtatattctcagacaacattcatctactcttgcttctgatgtcatttcccaatggggtaaatatgtctctgaagctttattcctcctttgtgggaatcggatccccagtttttagccatgcttattcacagagcagaattttccagagtatgggagctacacataccataggcacagcacctgcagtggcattaaataagttgggtcacataatgaggggtaggcaaactttatctgtaaaggaccagatagtaagtatcttaggctttgcaggccatgaggtctctgttgctactactcagttcagccattttagcactaaagcagctgtaggtaaaacgtaaagaatgggtgtggcaccaaaaaaacttttatgcacactgaaattggaatttcatataattttacatgtgaaatgttattcttcttttgatatttttagccattaaaaaaatataaaactccttcttaactctagtttgtataaaaacaatccttgggccagtttgcagactcctgccattggaggagtctcagtgggatgctagactttaatgcctctctaaaacatatgaattttacattttaacagagggaaagggttcaggtttgtctctgaatcagacaaaaatagttagctggaaataaagcatattgtgttgaactttttacattttattttaaacattttattttaccctctatctgtggctactaagtgaatttctacttagaatggtgatttaaaaaaaaaaaaaacaaaacagaattggctgggtgcggtggctcacgcctgtaatcccagcactttgggaggccgaggtgggcggatcacgaggtcaggagatcgagaccatcctggctaacatgatgaaaccccgtctctgctaaaaatacaaaaaattagccaggtgttgtggcggacacctgtagtcccagctactggggaggctgaggcaggagaatgatgtgaacctgggaggtggagcttgcagtgagccgagattgcaccactgcactccagcctgggcgacagagcaagactccgtcaaaaaaaaacaaaaaaacaaaaaaaaaacaacaacaacaattgatttacaaacaaaaatattaagtaaagaagaggccaggtgatacatggctatgatgaaaatcatgaggtgatatttatgatatttgaagggttggtatttgggaatctgctgtccaggtttgattacctgtgagtgttttttccttgggaggaatatctgtagttctgaaaaaagtagcttattattttttcactacaacttatgatattataaaaatttaaaaagagcccctgatgaaacatacacatttcctctgatactttcatcaaagccagccaaggtataaaaaccaaggtaaagtaaggttaaaacttgtgatgagtcctgaaatgcatagaacaatagtagttccattgtctcccttcacagtctgtggatttcatgtagttctctgccacactttttatctcaacacttcacatgtttttactgaaggatcaggagctcacttatttatcgttctctaaaatggtgagcctcccttttctttgtatgaaaatactcaatatatgtttaaacaaatcaacagaaataggaaaaacagatggtgaaaggattatgaggcattctttgaaaagagagtgtgctgtattttctacacgggaatgaccagttgctctttgatctcaaatgtctccgttagcgcgaaggccctgcttgcactcaaaaccacactttgtcggagagactcgtgctacagcctcctgaggatctcccagctgctcctcttgcacctccctggaaccattccttacttcccacctcctcctcttccattctcacccagcagccagtaagaccttaaaaagtgaatcaaccagttaacagtcttgcttaaaaacctcaagaagctcatcacctaacttgggaaaacaagcgtctacactctctatctgaggccgtcaaccaggccctgcacagtttagccctgccattccatggcctctgcgcatgcttcctcttccttccagcccttaccctcctccagtttctcacacttgcctggttcttgcctgtctttagatgccaatagcaccacagtcatccctgttgtgacaaccaaaaatgcctctggatggtgctgaatgacctctcaagggtaaaacccctgtctgcctgagaaaggctgctccatctggaacactgtcccccatgacacccgctccttgtttgaagctcagcaggcacttcccttccatagaaggccctccttggctcccacttttagaaatagttcctccgatttgaacctttcattctatatttcacttttccttataaggacttatttcgaattgtaatcacgtatgcatcctgtgttcattagtttaatatctgttgactagattataagctccctgaagccatgctaatttgttcactgctttattttcagcatttatcacagtgcctggcacattgcagtggattaatccatatattttgaatgaaagagttatcaatttttttttgagatatagtttagctcttgttgcctggagtgcagtggcaccatctcggctcactgcaacctctgcccccaggttcaagcgattctcctgcctcagcctccctactagctgggattacaggcacccgccaccatgtccagctaatttttgtatttttagtagagacagggtttcaccatgttgggcaggctggtctcgaactcctgacctcaggtgatctgcccgcctcaacttcccaaagtgcttggattacaggtgtgagccactgcacccagccaagagttatcaattttaagtcaaatttatatttcataatcttgtggacctactattctatcaccatccctagctgttatgcttaggttatttaacaaagaaaaataagtcatcgggaacttgaaatataatcgcctgacaaggtatccctctaagtgattaaatttctgttttattagggttcaaacaagtgctcggtatttgcctttattttccaagaaaataaatctatctccaaatgccacagagagaaatttatcttttcctttactcattgtatgcactgatcttgtgttcagatctgattacccttaacaggcagcctctatgtgcagtaacttgagctcttttccttagtttctcctttaccagtaactccctggttgtttttaccttcgtaactacctttccggtcaaagtactgcatctctttctgtaagatgatggcttcagatcaccttctcatttttctcacgtttattttcaaatgtgtctccacacaagcccagcctgtcatagaccatgttttactgttctgagtgacttgacattccctgaccagaccatgctgtctgtctctccatcaggctccacactgttccctgtgctagaacactgtcatccataatggtctcctaaaaacagccccttaatccccaagattaactggatgtctccccgacccacctacccaggtcctggtctcctgggtggccactgcacagatatactgtactgcagttgcctgtttatttggttttcccttccattgcttgaaaatgcatagtgggaagaacagagaatggcttccataaatagtttttctgtgtgtgtgtgtgttttgttttgttttttgttttttttttttttttttttttgagacataatctcgctcttttgccccggctagagtgcagtggtgcgatctctgctcactgccagctcctcctcccggattcacgcctttctcctgcctcagcctcctgagtagctgggactacaggtgcccgccaccacgcccagctaatttttgtatttttagtagaggcgggatttcaccgtgttagccaggatggtcttgatctcctgaccttgtgatctgcctgcctcggcctccctgattgctgggattacaggcgtgagccaccctgcccggccccataagtacttttaaaagaaataatgaagttccttttaaagtgtaaaccccttagaactgagaattaattctacagttagctagttataaaagtctagagaaaatggaacataagacagccatatcttttggctttgattagtaaaaagaaatatatatgactgtcacagaagatagtcctaaatgtgtaagatgcttcacaaaacagagataaagagtatgtcctgtccttaaaattaaaatttggaaggattaatagtggctcaacacactagaatgctgcgttaagtagtatgtgaagtctcatccaagcccaataaaatgaataatttgatccatcagcaaagtgtgctatgaatatcaagcagggaaggccagaggtttagtgtctaaaactaaaggggtaagtaaagatgtaaaaggaacacccaaacgaaatctcggcttattttaccttatttttaagtcagagaattgtgtacttgaaaagacctctttccacatccccaagtcttactttacagatgaatcaccttactttcagctgaagcagctaaggttctcagaataagtatgctgagcatgtctctgctgtagccagatagaactagaacaatgccctgccctgctgattatctttgtaagaattctgaaccctgctgagtttatggggcaacattcctatggcctgacttgcagcttaagtggcttctgaatcgaacatccctcctccagtggttgagagacacagactggcacttagtaacaatgcagcaatgatatatttagtatcaaccatgagccaggcttttgctgaacagtttactatgcagtaggttccccacaagccccaacaatcctatgtagtagaaagtattagtttccctaatatgcaaatgagaaacctgaggctttaaagatgaactgacttggaaaaatcacatagctagaaatggagagagctggactttgacccaatcagtctggctctgaattcacttctgtaaatgcaataatatattggggttcagggaaaatttttacatagcacttttgaggacatcttgagttcttcagacctcttcacagacatgccatatcatagaaacagaaaaaaatttgcaaagacacttagtgtctctgaaaagatagaacaggcttaaagagtacctgactcaaaaaatttacaaaatcccactgctcccttgatagagagatcagatggaacatgaaataaagtacttcctttaaagtcctttaagaatttaaatgtgaagatagaggtcatacatgatatacattaagatgaaagtaattaagagctagcattctctggggacctgctaagtactaggggttgggccaagtgttttacaaacattatcactcgaatccccacaacccttgggcaggggcctgcatgttcaggttgtacactgcagaactccaaggggcaccattcatttagactaacatgcatggtagctttaggtggtgcagtggcctgacctatgagattgttaaacgtttaatggttagttcagacttcacatagccaggaagggactgagctgggattggaacccagaacactttactcacagagtccttgcttctcactgctcttggtacacctatgcccctgtaaacatcctctctcagggtagagaatcaggctaatttaatcagcatggccatgcttttctgggttatatgaaattattctctgtaagaatctcaaagccagcagttaatgatttggtaccattatcagttgattgtggatatcacaattcggtccatcttgaagtggtatgttttgataaactgattccatttaaatgtgtatcgattctatgttcagtaccattatccttccttttagtataacgtgcactgaaaaaataaaattgcgttcagaaataatacttagttcagccccagtacacacagttgttatatttcttaaaaaaaaaaaaaaaaaaaaaaaagctagcaagtttttggggaactccagggaaaacaatatgtgaattaattttcgtttcaaaagaacagcaggaattattcaggtaaaaatatttatgttaatatgctacaactgccacatttcatctgtgtgaccactagtgctttctaaacagctgctagaaaaatgtacacaagaaatgtgtgaggtctatggaaaatgtaatttttgtattctagctattacattttttcccagtcattacatctcccccaactcttgcaggatgtgggttttttgcataagttgcaaattcacagttaaatgaggcaccttttggacttggctaaatatgtatgaacatgaagttatgaatctatgaactggtttgaaaggtagaaccatgtgatgttggcattatcgtcatgttgggttttgggtgtttgttttttttttttacatcagtttaaaattactttgcatgaaattagcatagagtagcaattactcattcttactctgtataccttctcacgttccagtgagaagaagaaaacaacataggttcgtgacatgtaatatttgagaccattgactttgcttctcactaactgcatgtgataatttgggcaggtcactgaagctctggttctgtgtcttacttgaaaaataggaaggataataagccctcacctcatagattgttctaagggttcattaaatagatacatacatacaatgtttggcaaagtgcctgattcctagttagtggaactctaaattgtagttgttattactgtattgtattattctctggtctgcattgggaaaggatctgcctgcattgctgtataagtattttgttattttaatgatagtttctaacttttcaggtgacctttccttattgatatttatgttcatgttgtgataaactggaactatactaaaagtaaatatgtctctttaaatgttattttctatcagttccttctagagaatatttgttttggcaagtagaggtatatcctgctttaatcaacccatcaggcttattcaattcaaggaattttcaaccattttgaagattgcaaaagctattgagaactataaaatgtgttccctgcctttgaaaagatctggaaaaggattattgacatctttttatacagaagaggaaacactctgaaacgccaaagaaaggtttacatcaaatataataactgatgacatgctgatttaagcatttaatgagcaaatcctattaactctgcccacccattcattcagttacacaaatgaaataacatctgaacttccatgcatgggtgaccaaatcccatacacaaggtaatgaaggatagagctgcttgggttttactatcatgtctttccatgggaaagttctgcctttcacgtgtgtctaggtgctctctttattagctgaattcatctctgtcttgccaacacacttgcttatacactgatgctatgatttgggtcttgtgtgtctctatggggccagattactcatagaatttcactttgttttaataaagaaagggctaatttatatatgtatgtatgtatgtgtgtgtgtgtatatatatatatatatatacatatatatatatatttctttacatagtaaaagttttcccaagaactgctgtgtttttttgtttttttgtttgttttgtttgtttttattgtttgttttgtttgagatgcagcctccctctgttacaagactctcaggctggagtgcaatggtacaatctcgactcactgcaacctccgcctcctgggctcaagcgattctcctgcctcagcctcccaagtagctgggattacaggcatgcgccaccatgcccaggtaatttttgtatttttagtagagacggtgtttcaccatgttggccaggctggtctcaaactcctgaccccatgattcgcccgcctcaacctcccaaagtgctgggattacaggcgtaagccaccacgcccagccacttttttattttcttcaaaagtccttgcttacacacacaacctctctccctctgtctccctcttgctctatttctgtcttgttcttgatttctctctttcacatatgcacaggcagaggcactcatacctacattcatatagaccttttagtctttcttctcatggtattattccatatgccacaattgcctcggctacaactagtccagaaatttccaatccatagccatatatgctaaatgacacctatagtaagtggtatacagccttaaaaagactacattaagccagacatagtggctcacacctgtaatccgagaactttgggaggtggaggtgggtggatcacctgaggtcaggagttcaagaccagcctggccaacatggtgaaaccctgtctctactaaaactacaaaaattagccgagcatggtggcacaccaccgtaatcccagctactcggaaggctgatgtgggagaactgcttgaacccaggaggcggaggttgcagtgagccaagatcgcaccaatgtactccaacctgggtgacaagagtgaaaccatctcaaaaaaaaaaaaaaaaaggctacattaactcctgatttaagcagcaaatgaattgggtgtgagtcttacttgttaaacaaagaagactctccgtaggattactttatatcatttagaaaaagacagtttttatttttttctggaaatgtacggtagaacccaagaagtagtatactaaattagtactagtcttcaaaaatgtatagtctcattgatgtactgatttcagaaaaactacgtcagcaacttaggtcttttcgtgtgatgtagcaattagttttctgctaggctgatagaagaaagtaaaaagaggcaaggatttgttcctcaaattattgtgcttaggtgttttgttgtgcttcaaaagtttgtgtttggtttttgtggttatttaacccctctttccagccccctttcttaacctgaagaagaggtggaaggaatagagaggaacaaggaaggaatcaagcttttgtcttaataagagaagaaattctttgagggtgcaaaattatttctaggtagttctgaacttggtttcctcagagaactgtgtggtggaaattggccgtggtacaagcctatgttggattaccttgcttaaagcttttaatcactcatttgagttccaccttggtatgggatattgagaggtagctggagggaggatgcatcttctccacttaccttcatgaggccacccaatcagtcttttcacactctgggtccctgtctgaacagaggacttttatttgtcaatacagataattcctctgggtgtaatcttagcctatactttaatttcaactttaagaattttgtttttctgagagctacaaccatggcacatcttatccaacaggagccattcctactcattcatttaatacaaacgcgtaagaccaaaatcagtgtgttaggtgaagtcattccttgtgaggaaaagtaaatgcctctgataaaataatgtttcaccctcctgcatcatcataattaagaagataaaatgtattcaaacagaagacttaaataccaatattaggtggcatgggattgagtacagaaatagcaatgaaggaagagggcagtacaggccagaaaaaatcaaggaaaaagaaggctttgaataagaactgcacagagtgactttgagttgcagtaaccttatgtgggttaactggttttgcgttttttggctgtgttgatggagttgaaagaatcagccctttttacttgagtactttaaatttttgtgcattatctttaggctatggttcttgatgttgaaagaaatatgatgtcttcgaggcttttctctaggatgccaaagagtggcaccttgggtataggaaaagagcatgtgttaggtctgctggagtgtgtgtaatagaggtagatggagctggagtgtattgattctttatttcttgtcagtccttggcatgcattattgacagtggagattgaatactttgaagttggtaaaagtcaccatcaagaaactgtgttgctttgagtttgcaggaataactgaggagagaaagacaaaccccttgctgtgctctgcctacccctgggctttttgtgcactggattatgaaaagtgatagaagactggaactttttatggtaaatatctaaagggaaaactttgtccctatagtaacccttttagcaaatatggttgtcatgttcctgctgcatatgactgggactgtgctgagctcaaacgaggtgatcagttattatcaacatataaccagctaatggatgagcaaatatttaaggaaacaaaataattatcaagatcttgacttcttatattcttggaaaggtagagtaattgatagaaacctgagtgtgcctgcaccacccacacaccctgcccagcttggttgatctggatggaactttagaagacgttctttatgattaacctgtggctgtattattggactcctccttaccaattgtctacctttgctatctatttctgaatatagaggtaaaagagggtgtacagtaaagctttgttatttattggctgtggtggggaggggaaataaggattatcataacactcaattagagttacatcctgttcagggcagttctccaagtgctccctctgctccaaacttagtgataatttaggcttataaagcaaagagacattattaaaaatacatcaagtttcatcattgacacttcctaccctttgacaaatacttccctgtttcccctactccccagcccctgcagtttcccattcctactctctgcttctaggagtttgactattttagatttaccatataggtggtatcatgtagcagttgtcctttatatctggcttatttcagttagcatgatattctccaggtttatccatgctgttgcaaatggcaggagttccttctttttcaaggctgggttatatatatatatatatatatatatatttatttatttatttatttacttatttatattatatattatatatatttatattatacaatatatatttatgccaatagatatacagtgtgtgtatatatataattataccagtatatatgtataattataccagtatatataccagtatatagatggtgtgtatatatagttatactatatattatgcatagtataatcatatactatataattatatagtatgtaaaaatatattatattattatatagtatactatatattatttatgctgtgatatatattatgataagtatatattatatatgtatcacagtatatataagaaaatatatattagaaaatgtgatacagtatatataagaaaatgtgatacagtatatataagaaaatgtgatactatatatatatatataagaaaatgtgacactgtacatatatataagaaaatgtgatactgtgtgtagatatatctatatctatatctatatatccattcatctgtcgtggacatttaagttgcctccatgtcttaaactattgtaaataatgctgcagtgaacatgggagcacaaatatctctttaagagctggttttcaattcctttgaatatttacccagaggtgggattgctgaatcatatggtaattctgtttttaattttttgaggagtatctatactgttttccataatggctgaaccaatttatattcccatcaatagtgttaaagggttgcccggccgggcgcggtggctcacgcctgtaatcccagcactttgggaggccgaggcgggtggatcacgaggtcaggagatcaagaccatcctggctaacatggtgaaagccccgtctctactaaaaatacgaaaaattggccgggcatggtggcaggcgcctgtagtcccagctacttgggaggctgaggcaggagaatggcgtgaacccgggaggcggagcttgcagtgagccgagatcgcgccactgcactccatcctgggcgacagagtgagactccgcctaaaaaaaaaaaaaaaaaaaaaaaaagggttgccctttctccacatcctcctcaaaacttgttttcttctgttttcttcatagtagccatcctaacacatggtaggtgatatctcagtgtggttttgatttgtatttccatgatgattaatgatgctgggcaccttgtcatataccagttttccatttgtatgtcttctttggagaaatatctattcagttcctttgttcatttttaaatcaggttgttatggtttttgcttgttttgctgttgagtaataggagttccttatgtattttggatattaaccctttatcagatatatggtttgctaatattttcttccattccaaagatagccttcttgttttcttgttttctttgctgcacagaagctttttagtctgatataatttgacttatctatttttgcttctgttgcctgtgctttattgtcatatacatggaaaccatttccaatgtgtttgtggcatggatcatagtaatggtttcatgggtgtatactcatctccaagctcaccaagttgtatatattaaagttgtgcagctttttggatgtcagttatacctcaataaagtggttttgaaaatgcaccaacaaaaacagcatgaattgtacatagtataattctagaaatcttagaacccactgcctgaatgccgtctagaatcctagcaagtctaccttctgtatttcattaggctgtggtctcagatcccgaaccagactgaagacacatagaaacatctgaacatctgaaatctgtactgtctcttcagtggattctaagctgcctcagctttaataaaggtctttaagtaactctacttagtagagactctccatcacttagaagaatggtggccagaggcatgtcaaagtcagaatattaggtatggtttaccaaggtgaaaaggaacggtgtggtgctcggagttttctggtccaagcatttgttgggtcaatgaataagagcagggcttacctcttgccttgctatgtttaaattcattgatattgagagacagtccagggttggatagacaaatcgatcttatctgaaattctgattcctattgattggtagaagctgcctaagatgttgagttaagaagattataatgtcatgacatctggactcagtacaaagaagagttatcacaactgaagagtgtatgctacggggaagaaagtgatggagagagagagagagagagagagttagatgataggctatattatatatacataccttttagatacaaatatactgtattatcaaaatcatatatgcacttttaatattgagagtgtcactgttagggtgaaactgcaccatatagatggcagatactgtctacttgcccaccaaattattccctttcttctcaggcaaacaaggcaactggactacaatttcatcctctcttgaagctagacagggccatattcctgagttctagccaatgagatatgtagaaatggcattcctcacttgcagacatggaaaataaatctttccacatgtgagtcccagttctatttctccattcactggcagaagggatggagaggacttgggtagaggaccgaggagagggcagccacaaggaggagcctgagtccctgaatgactgtttggatttgaggcctccccgccagcctctccccctctgcctgccaacctgcattgtcatacagtgaaaaagaactatgcttttaccgtacagtgccacagaattggagttgtttgctctaactgactaatactatatatgttaaagttttttttataaaaacataaagcacaatgggagtatataagagattgtaattataaggtagcaaaaacaccatttctctttctatacaaacctatattgttatgtgtgctaagaagtctccccaaagcattctttcccttttatgaaatgggcgagtctagcacttccctcccctctgcatatatcacacagatgcctcaaactgtctatccaatacagtcctacctcataatgactgtcagcatctaaatccaagtatagtcacagaaactatgccagagctctggaggaagtctcagtggtgggcagacaggggacacttctcccccaccgccccatctgcagctgcgtgcatcctccactgcatcagtttcctgctttgtagtcctgtcttttccaagctgagttcactgcgtggtcttctcttatccccgggttatttgatcttttactctaattttctcaccagcacttttctatttagtttttatagaatttatttctccttccctacatgtaattttttgtatctatcttatttgaatttcatttcatgtaatccctccagtgcatccaggccattttggattctaaacgtgttgtctcttccctgacagctgggtattcagtgtagagtacaaatatatacttagctctaatgtccacaacacttataacagtaaaactagagtgaaagtcagaagaagagatggtggcggtccagaagcccagtccaactggtctttgctcttgcaacagggcagcaggagtgaatggagaactgacatttaggacaggttctctgtctctttctcaggacagctttgtctctgtatatcgtactcaatctcccctctcttcagacccacattccttgaccacacgaaagaacatggctgttgacaccccaaagttttacaccttgtctcttcaagaaaatggctcttttaggagtggttcaaaaaatgagagagaaaccaaaagcgagagtgagagtgagagagtgtgggaggaaaggcaagaatgagagagagaaagagagagagggggagagaggaagactctttttggtttaacttgatcaaccatctacatttggtctaaaaaattctagaaaagagagcagagttttggagtaaaaatgaggctgttgggatctcgaacttctggataagttgaggggaatcattataaatcaggcaccacccccaaaagatctactggtgatggtagtagagaaattaaaaggtagataaacaaaggaagaaaaagaagtaatgatttaacttcctttgaacataaaatttaccagtaacaatcactctttgagaagaagcatgttgttaacatattctgttgggttctgtttgactctgtggtggtatgtgtgtgtatacatatgtacacacacatacaggtatacacatgcatacacacacacatattcagtgaatacatactatttgacatgaattacaccaggtactaaagtagcccttatttttaagtgactttcgatttcatgggggaaaaaaacaacaacacacaaacagagaagtcacattcttatatctgctgggcagaggagccctgggagcacttaagtaacctaggaaaggagaatgacagaaagtcttcccagaggaacaagtgcctgagctgactgtgaaaggctgaacaggaaggagccagatgaacgacaagagagcagaacattcaagacagaagggataatgtgaatgaaggtgtgacaatgagaaatagtatggtgtcttctggaaagggtcagcccagacttgccatgacataaattaggaagtaaaactaggaaagcagtagggaaagatgaaagggcagatttcaaagagcctttttgggcaggttaataaatccagacattaacctgagggcattgggaaaccactgaaaggttttaagcaaaggaatgacacagtcaagcttgtatctactacagatcactgtggtatgacagaaatgcacaaaacgggtttaagatgaagacaagctgggagacagggagactagttgagtagttactgcggtaatctagggcaaagatgatggagagctaactaaagcagaaatagtaacaatacagctatctattattcatgaattcaacaagtagtcattaacatgtcttctgtgtcctacactgtgctaagcattttacatgaatcatcttactgaatccccagaggcctatgaagccaggtactggaattgttggtgagaaaaatggggctcagagggctgaattacctggccaaaggttcaaaactaacaaggaacaaaggcagtattcaaatccaagtctgacaacaaactttagtaatcaaccaccaatccaataataatagctataagcaggaaggaatacaggttaaaaatacatagatgaaattagccaggctaggtgattgactaacttccgggaatatgggagaagaaggcaccaaggataattctcatatatcgagtatgggtgtctgggatagtaagtgcagaaaaactgttttaaatgtttgacattcattccaattcactgcaccaccaggaaagtcagtcatctggcaacatcgctagcccactggcccttccacattctgcagctagtcaatcttcccatccttttcggcctggacccctgggccaatatttccagcaatctgctttacagtgacttcagtctctttgtcccctggcctttcacaatgcccaccttgccaatcacatcccttacatcaaacccactgtttatctgtgccagcttctgggcagccattcagtgatatctgtaaaattcagccaggtactggtgcttttgctcaatcatctcttttccttcttctcccatcagtcccccttcctgttttgcactgcgctcatctccttagacccaaccagccacctgttctttgcagtgtgcctttgaataccaaggtcatgcaagttgaggtctctctacatgtttctctatctttacccatttttctctcttcactcttctttcagagtaacactcttatttcagagtaacttatttcagagtaacttgccaccaactgaaccttgatctatcaattgtgtgcaaattatttttaatacattgcttaaaatttactcatggtacaaattcaaacttatttttaatccttatcatatctatgaaaaatactgtctttgttagcagagcattcatcatcctaaaataaactatgagaagggctagactttcctcatctttatctcaggacaggatgaagtaggttaagctccaatcaactcgatcttaattagcccccaaatgatgctttacttccatttctaaagccttagttagtgaattactggataaaaaataagtttaataagtaaagaaaggcaaaagtcatgaatatctctacaaatgaggtattttagtgtatattccattaacaagttttaagatgtcatcaattgtaagatattttttaaataagaggatttgggggaaaattaaaagtacaaatgtcaatttaaaccagatttcagaaatatgaatatgaaaatgtgagaaaaacaaactggatcttataattaagacaacacagcaagttttccccctagaattatgtttctgtctgtctagtatgtagctgtctaacttggtcattttacaaaattcctattcatgccacaatcccctttgttaaaaagttttgcttcattttttgttttatagggaagaactatctgagacacctggtaaccatttctttcttagtttagaaattggttttgtggtactattactcaataatcctattcagaaatataagcatagcttcagtaaaggttgaaatatcaaaaggaaagaaaagcctataactgagggagcttttttgaatatggaataaaacatgaatctagacattagaaaattggaacatatttttccatgttctaccccagtagaagtttagagaagaaaagagttaacttgctctaaaatgcagtatatttctttcggcaaacacccatatgtgttagtgtgtgcatgtttttcttattaggtgaaaaaatcatgctaggtctggattttagcatcttcttgctagaagcaactgattgtacctatcaagcccaagacagagcccagacaaaagtattttcctgcctggtgggctcacagtttgtgcagctttatgtatgtatgaacatccattcatatatgtgtatacatatgtgcgtgtgtatagtgtgtatacacatgtatatttttaatgacattttggaaaggatacaatagtgtttgtattttgcagtgagtgcgccagttcataatctatgtttattagaatgaactaaattccttgagcctctgccatttttcctaccccctacgaagattctgttttcccctcttctaaaatataacactggagagaagtgccaaatcaacagcccagaaatcgggaagctccttttttaattcccatcctgtagtactccccttggatttctgtgccaaagctggctgagagcgctctcacttcagcttcctatttaacttggctggtactatcttcctggtgaatcatttcacgaatttgggcatgggtactgatctcatacatcaaacacacaagtacatacatacaatgcacacacacaaactcaggaacacctccatgaatgctgaccacatgcacttgcatatgcaagcatcaggcatgcgcacacccccaccaccacattcatgtgcatatgcagacatgcacatacatgtgcacctccatgctcacatacatgcgcacatgcaagcacaggcatacatgcatacatgtgtttatacacatatgcacacaatttggtgagcacacatgcacgtacatgcatatgcatattcatgtacaacacacacttatactcgtgcgtacgtgcacacacatacacacgtagacctgatgccctttttctctttagcacctaaaatttttcctctgctcccattttctcatttcccttttccccttcagcattcccaatattgacatgcttgaggttattatatagttcatcattgttcagaatatgctatctctactcacaaggtctggatttatctttccacaagaccattgaacagtcctgtgtgccagctatggaagttttcataacctgcctgaatagaagaaacatcaaatcactgaagcttaaccctaaagaagtgagggtcacctcagccttgccttctgactcaggctgttcatgttgtaataagtgagggacatggaattgagcacttcacaaagccttctttatagccaggagtgtgatcacaagtagggatttccatgtatttcctgacacatttccctcttactttgttgtgaagggatcttgattttcatgttctagcacttcccccatggtgcggttttctttgcactagactgaagaaagagagttttaagttgcttcttctgcaagggcaagaagtcgcatggattggggagtgggtttacccttccctatagatcttatctctgctctttcttctgttgtttcgtgcattgagaatggcattgttgggtctgatgtctgctaagtctctagaaaatactggaaacaagagcaaggggaaggtggcatctcttagctgaattacccaagtccattgaatcctgccttcttgttttgcatgcacctgggcttcccaagcctctgagctcaggattttccaacctgctagcgtatggcccaacaaaccaatggcatggaagcccttgaacaataaacaaataataggaattggcttttctaagaaaatcagacaaataaaagaaacaaatttactgaaaggatttattagccagacttaagaaatgtcgaccagcaccaatcctatgaggttcttaggatattttccctgtcttttgcttatcactccaacccagaccctgtgccaaaactcattaccactggggctatctcgacagccccacactgtagcatttctccccaggattggtggggcctggaaacgcatcataggtgaggaaatggcttccaaatgttagcttagaagggctgaactactgatgtagataattaattgaaaaccttctacccatttctttttttctttttaggttctttaaatggaatactctctctttcttgttgatagaacttaagagtatctactttatactgattttagtgtgaggctcaaaggatgccaagaaacacaggacatagcttctgacctcaaaaatctcttggtcttggaaggaagaggcagataaattagtattatggcttatctggagtacataatcaatggacaatgattgggaaggctcaagcaaagatcccaagagggaagctgtgttgacatgataggccagaggagatagattttaaattatgtgttaggagaaagagtacagttagttacaataatctaaaattcaagcaggggagaaaatatctacaaaaaaatagtgaacacctggtttctttgaggatttcttaagaagtcttcagctggaggcaggtggcatgggctacggtagaggcccagatgaaggggctatagaggccatgacaacccgttaatccaaaatgagccattgaagggtttaaagcactggaattaaaatatcattttcaattgttttaacccctgggatgttttgattttatggttatgaacaaagatatgttcaacagaattctaccaaggttgataaattattattgagacaggatttcctagggacaataagactaagccaatttaattgctcaatcggtttcatatacctttccatatagtgtcatttatgcagagtaaatgataaggtcacattttctttagagtcaaaatgacagatgaaaaagttcacgtagcagagtggtgggttcaaaacttgcctctttggattctcattttatatagaacatgcaagcttctgaatacgaaatatattcccactgcattctactatttttcagtttgaggattcagctattttagaagtttccgttattagggattaaacaaattatatttttttaagcgactgaacatgttttaaataggatttttatgaagaggaaaagtagaagtccagcaattaggcacactttatttgctgccatcgctctgaaagtggtggagtttggagtgaaggtataatccttgcagccattgcacagacccacaggcgtctgccagtgtgtgccaggagcccgaggctcttcaaggccatggaggagcatggccccccattcagcccacattaactctggagtgcagaaaagtgacgaggtcctttgtagtggaaacagtaactcctgtcacgaaggcttgaaaacaagtcacttgggtgttgatgatgactggaaaactgtattttgaaggatcccaaggtatctctttaacattcatgccttctcccacaatctgctagtctgccgacttcagctttcatctcctggaataccacccagttctcgctgttgcatcgtatctgtgaaatgtgcatcattcccctgcctttcatctgagagtttataccaagattcaagttttcatcggcagtgggttcatgtcagttagaattaatggcagtttcactcattggcttttattgttaatatttacataccttccagattgtggcttttgggtagggaggccaatggaatgcaaaatgagccaaagtcaagaagcacagagctttgctcctttccttgaaaaaaaagttgcattttatttgtttttaataaataaaatgagctttacagcttccagtaaaatagccaaaaataaaatagaagactgttttatgcaagtcttaggaatccaaatgaatactaagcagtggtatttgggagctgggtaaaaactttctgacacaagcattactatgcctataatacagaaatccgaagggaaaaaaaatcagtttcaagtcttttttataactttattttcaagtgactaaaatttacataaagccatctttactcaactttgggtctttttttatattttattttattttattttattttattttattttattttattttattttattttattctattctattctattttattttattttatttttgagacagtcttgctctgttgcctagactgctggagtggagtgcagtggtgcaatctcagctcactgcaaccttcacctcctgtatccaagtgctcagcctccctggtagctgggactacaggcacacactaccacacctggctaattttttgtatgtttagtagaaatggggtttcaccatgttggccaggctggcctcgaactcctggcctcaagtgatctgcccacctcagcctcccaaagtgctaggattacagatgtcagctaccatgcccggccaactttggtcctttctagcactaccaagaccactctatcctgctttcctgaccttggcattcaattaagtattttgaatgcttcatcctcaactatgaactgaccctcccgctacccgcctcactttaagttctcaaaatgagatgacttagaagtaggttggacatgttctcaagtatcctaaaataacctgggttgtatgtgaaagattcgatggacataggcacctcatactctgaacactttgcctccttgaatgcttattaacttttgctaggatgctatactttttataccatccatctcttctgaaattttattaatttcagaataaaaaaattaattaattttttttggcttcttgagtaagtgttttccctttctggttgaaggacttatagcaaaggaattgagcatgacctttggaatcagctcttcaatacaatcaaagctgcatcgagaggctgtgtgcccttggtttacctttctgagcctctgtttttgaatctgcaaagcgggattgattaaaataaatacagactgtaacctctgtggggtagaaactgtatctgtttgctcacaggtgttattccagaggaaatgcttgggcaagcagaactttgtctaaaataccacagtgtacttcctgttggaattcgaagttggtagttctacctttgtcaaataccctgacttctcttttgagattttcacactgctaattcccaaaggagatttattttaaataggtgatctttgaaggtctctgctgttctgaaagtctgaatatctagcatgcatatatgaattggattttagctgtactgtcattgttatttccggaatcaaagggacttactggcttcctgcaacatgacttggggaactccaactccttttgcaaagtcaagctcgggggatctatcacccaatttatttttgtataaatgtttttccatgtcttcctaattgactccactccccatcctgttgctgtggaactggccctgctccgaggacctcacctgaagctgtgtggtgtagaaaggatgtgctgggcttattgtctgacaaattgggtcctgttttggggccactcacagaagagctggtgaccagggcaagttacaacttccctgtagctcagtgtctgcatctctaaaacagggtaatcaccactgtcctctctgcctccctggagacaatgtacgtgaaagcagtgtgaaaaatctcctgggatgaacaagttcaggatgagccattggtagtattgaaaagcacagatcctacagaaccctctgggactaaagggggccaaagtcaaatacatagttcaaaacaggttaagtgagtcttgatatctgaattattttatccattgtatagtggaaagaatatgggttttgaggtcatattatagatcgggattcatacaaattaaaaataagccaatttctaagcacaacaaagcaggcttcagttaagaaagtccagtttgagtcaatagtttgggttggatttttttttttcttttcttaagaatttaccggttcggtgatctctgacatatcatttaacctctctgagcctcagtttccttatcagcacaatgatgatactactgcccatttttcagcttcttatgtgtgaattagagagaaaatatataaagcactgagcatagtcctgaagacacacatgcccaaaagacatatttattattgtttctagtttttatgtttttcaggtatacaactaaacctgatgttgaactcaatccatatgttaataatgctttttttaggtatgaagcattattctgcatttatatgcaaataaagacaaaaagatgtctacccataaaagcaaagacaggttgggaatgtagttaaagtagatgagaagaaggaaattctttgtcaaattgaagattccattcctattaaaaacacgcataacttacgagctaaatttcaggatggaaacactttttgaaatggattggcctacatacttgtgaagactccgcgggaccaagtcctgttcttctgtcaatacccatggtttcaataacatagcacagaggactagagagagaaggcagttctttggtgacaagaattgagattttaggacaacactaggatgtgagaaaaattcctaagggtttgagttcagagatcctggagaccagaaggaagcttcgaacagctggagtggggtttccacaggaaaagatgtgtttctaaggaggtaaaaggtgaagtgcatgtttgatgaactgagaatgagtgcagaatgacaggcaattaatagcctaagctgtggaagaagttcgagttaggactaatggacagaagaaagtaaaatctaaataaccagaatattggcaataaagtacatgcgagagagtcttctgcagaactgagcagatcctccagaacagtggttctcaaccagtggcgattttgccacctcaaggaatgttgccctgtctggtgatgtttttgttttgtacacgtgggtgagtgctactagcatctagtggatagaatccagggatgctgctgaacatcctgaaatgtacaagtcaacaccctcccaccacccccaacaaataattacctggcccaggtgtcaaaagcacacaggttgagaacccttgctgtagaatggcatattccaaactgcactccactgcatgcaaaggataataacacattttctgtgggttaaaaagaggggggggcttggggaagggaggttctaagatccaataaactgaggaagctctgtgtctaataaacagatttctttattatagaatgattctgagtacttaaaaacaaaaagcatttccaaaaacaattttctaagaaataactttgaagttacaagtgttccacaaaacacgggacaggaaacactgatctagtatttcatattaattagtttttgatagaatattactaattacctacttgaaaaagagtagacatatttgacattaaattgttaaaaataaacaaacagttaaacataaaacctagccatgcatatgaaaaaaatatgaaagcacacaaagattgcatactgacagagaatgcatcatccggatagtccaggcagtgatgaaaccaacggatgttccagtacatacttcccttctaccatctgtagcactaagaatgacaagagtctgatgtctcatcaatatgccgggatgctaatacaaccttttccttagtaggcactctatatttgaatttattgtagatacttaagtgattctccccacccctgtttgtaagtgagtagttatagcagatgctcacatcagattgctgtgtttgtaaaaggattctattcatttgcatgtttttctctgaaatattgcatttatttatttcagtgcatcttcttagaagatgtattcaatagggagcaagaataatatatactcgtggttgaatgcgagaccataatttaaatagaggtattggactgacatcagagatttgagtgaaagtggaagcccagaggaaggaaggggacaatttattattgtttacatattacactgcagctttagattcccttagttactacttgaatgtaaaatgtattactcagaagaggatctggaatgaactctatgcagaagacgaagttgggtgggtgttgtgctggaatgaaagctgcagtcgtctttgcagatgccagtgtactgggaaataggcatgtgtatttagcataataaagtcctgcattctcattgcccaatcacttaattttctaaaagaaaacttatatcctatctctcttttgatcctacttactacaatattaagggatttaacagccttaagaccttttgtccttcaatcattcattagtttgatgttatacctaatccccatttccatttgcagagaagtcagtgaatagaatcagctaccattattaaacaggttttaaaaaacgtaccacatcacttgaaaaaaaaaatgatgaggattttttggagtggtttaattttgtatctaatgcaactaaaaaccttacatattctttttttctattgctgtcataacagattaccaccaacagacgcttaagcgaacacacattgattatcctacggttctataggtaaaagatccgactggatttccactgggctaaaatcaaggtgttagttgggtttcgtctctttctggagcacatagcaaagattctttcttcgcttggattcctgcttcaagaggctgtttccattccttggttcatggccccttccttcatcttcaaagccagaagtgtagcctctctttgagcctgctttagttgtcacatttccctctgaccacagccaggaaaatttccccacttagaaggacatgtggatgagttcaaactcacttggataatccaaaatattctccccacctcagggctcttaaccttaatcacatctggaaagtcccttttgctatgtaaagtaacatattcccaagtcctaggcattaggacatagacattgttgggaattcatgattctgcccaccgtgctttatttccttccatttccaatgcgatttgacagaaattccaaatgattccccccaaaatcagaaaaacctatttcaaagtgttttataacacattagctgttacttctttagctttgaagtgaaattaacccagacgtgaaatcctcagctctgtttccttcccactcatgctgtagaaataaacctcccaaagatgctgagtaggctctgtcccagggccaatgatggctggtggaggttggtgggacatctcccctctccacttccagctataaatccccatgtgtcacccaaagcctgcatggctcacttagagaagctcaactgagtgacttctgcctcccctcaggcactgactcctacaagcagacaattactggtgtcagcaagcatgtgcctgtggctcgctgcatgattagccgttaatatttggttttgaactccatcagagataagctgttcttgcagcatatcaaaccaggcaatctaatgcaaaggatgctatggtcagaataaagagttgctcattttccaagagataagtaggtagatagattgatagatagataaatagatagatggatacatagatataggtagagatacagctatagatttagatacagatacagatatagatatatagaaatagagattttttaatagactagtttttagaattcacggattcttgttgagggtgaaaaagaaaaagggatacagatcatgacgtcaggagatcgagaccatcctggccaacatggtgaaaccccatctctactaaaaatacaaaaattagctgggcgtggaggtgcacgcctgtagtcccagctactaggcaggcagctgaggcaggataattgcttgaacccgggacaaggagactgcagtgagccgagattgcgccactgcactccagcctggccatagagtgagactctgtctcaaaaaacaaaacaaaacaaaacaaacaaaaaaaaacaacttttgagctaagttctcaaatatgtttctacttcaattttaggtctctttctcctaaatatcagaaaatgtctttgtccaatatgagtagtcacggagaaatgaggcagtttattggtagtgagagtgtgatgaggcaaccaactacaaaaaccctctttggagctagaatgatagtgttagatttctatatccctcaaggactttaacattataaccactatgtctgtcattaaatacacctgaggttgtgtattcagtgattataaccctattggcatgcttttaaaaaaattaaggctattttttagtctgtgcctgaaaaccacatttttaggtcccactgttggctaaggaaagagttaggagttcattctttgcccaaggtgctgggcttattttattaaaacatccttgcatggtgactttccttatattcaaagttcattccagacgcccagcctgatttggcccctgagtcctcatctagtgccactctctcccttgctcactcttgtgcagtcatgttgggctttttctgtttctggaatgtaccgaattctccagtctccccacccttgcacttgaggctaggtcttttcccggctcctccttcattcataagtgcattctcagcaaaaccgccagagggcgcctgacacgtgagctctgatctgtcttcaatggcctcccatttcactcgagatacaagccaaggctcttatatctagcaggaaggctgtccaccatttgaactcagtttcttctctgacctcctcttctgcctactttcttttggttgcacccctggacttcgctgtgtgcctcaaatatgctggatatgctcccacctcaagacctctgctgctgctgttccctgtcctaatagtcttcctcttagtgtacacaaggctccctccctctcttcctgcatcctactgcagtttcaggttctagaccaagcatgtagtaggtgctcaagtaaatatctattgaatgaatgaacgaaagcaggcattactgttcatggagccctttctgacaaccctttatttagcaaaatgggatttgcactctgctaaggaacgtgaatctaatgtaaaagatggtgtcccagaaggctgtgaactttagtgttcagacacactgaggtataaatatatgagttccacagcccttctgactttctgtgcagctgacagtacctgtttgatgagaattaagtttcctgggtactctgtaatttaaccaggacaattgttgcagtgagaccagagattgtttcttttgcttttgcccattcttgtcttatatatctcattgcatcttatatcagtacaatattggtaaatactagcacaaatagcaaactttctatgtagtacacccgttaggcctcagtgtgacttgccttcctctccaacagcagccttgtaaatggttttggaaaagacaatctgtggataaattactagttttttttttttttcccatgtacttactgtgtgactttgggcaagtttcttaatgtctctgaatctcttcatgtataaaacagggttttaaaaaattctacttcatgaagtcctcatgtattcatttaataaatatttcattgagcacttactatggttgaggcattatttaggtgctagggaaagagggatgtacaggacaaataagatgcccaactttcattctattgggtggagggaaggagggaagacagtagagtaggaaggagatgacgaattcagtaaggtatttttcatgagtgatgagtgttatcaaagaaataggcccagggaaatgaaatagaaagggaagagataggaacaccacttcaggttgagttatcagagaagacttcatttctttgtggctgagatctaaatgctgagaagaaaccaaacacacaaagatcctagggtataatgttccaggcaagggtaaaagtaaagttcaaagaccctgagacggacagtagcttgatggtttggggaacagaaggaagactgtcgagcccgcagtcgtagtgagagtggtattaagggagctcagagacataagcacaggctggattacggcaggtaagctctgcaaaaagtttctggcagaaatcatcttaccactcttcctggcacctcataattatctaataaatttaaatgtcctttcttttccaaatttcaattttctaattagaagaaggattatatttattctccattaaaataaagggtatgagcaaagttatgttcaaatagtttggtatgcttgtgctaatttacatttgtcaccaatcatgattttaattaaatacatgggaaatggattcttattaaaattcaataaattttttttttaccccaaatgtggtcaagtgttttcccctggatttatgtaagcataactcctatgatatggtgtaaaatgaatcacactttttttttaaagatgcttttgtttgagtatcttcaagaaaaatctgttgtgagaaagatcctaaacatatgtatgtatagatgcatatctttgaaagcctatgtgaataccaagggaatctgaactttttctttggagatgtttacataataaatctattttcatcaatctggcatatttttctcctagcactgacttactgaatgccgctgaccacgtgctgcctctcatgctaaatgcttacttaattcatcaccaaattctgtagactgtacaggctaaacacctctaatgcatttacttattttcatcctcactgtccatcacactccctccctccctgtttctgcaacagcttcccaattggatctttttaaatgcaaattggatcctgtgttctttactttaaaatatttgtatggctcgccagtgccctgagtggtttaggggttcttagcttttatcccttatttacttttctaagtgcatctgttaccacttcctacaggtcagggtcacgcttaagctcctcccatcctcaaagaagccttactctctcgctttgccttgtcccttttgcctgaaatccccttcctctactctactttagcccctccaccattaccagactaatctctactcatccattaaggcccgcttcagccctctcccaagggctgcactccacaaaccccgcccccacatgtctagttattagcacttcgctgtgcttacacaccttctagaggtatcagaattatcacaccccattgttaggactggctgcctagccatcccactagattgtcagatggtaggggcaggcatcatgactatggggttcctcttaaatcccagtgctgggcacgctgcacggcatagagcaagtactcaagaaatgtttcttgaatttaaaaggtgcctttaaatcaaatgcctctgaaaagggagttgataatgctcctcattacctgaagtttagcttcatgatctatggtcaaaaacatccagtttggtcctacctgtggaagcatattgactgcccttaactcaagcccttaactctctaatttcactgatttctataatagaaagaagtattattattacattgtttatcatggagctaaagtttagtttttgcatgtgaataggcgaggccccttctcacccctttccttaccttcctttttatttatttacttatttattatttttagagacagggtcttactctgtggccaggctagagtgcagtggcatgatcattgctcactgtagacttggcctcccaatctcaagcgatcttcctgcctcagcctgccaagtagctgggactacaggcatgcaccaccacacctagctaacttttttattttttgtagtgatggggtctcattatgttaaccaggctgatattgaactcctggcctcaaaggatcctcttgctttggcctcccaaaatgctgagattgtagacatgagccactatgctgggcccccttttcttattcttagcaggagcattccaaactctggaaatctatgcccaaaccgttgctttcattccacgagcttgctaatggccacagatgcctgcaacattcctcaactcccctagctttcagttttatcctgtaaaattgattgctttgaatttctattgttagtaattaattgaaagaataagtcttcatgataggtcaataaatatgttttatggatgaaatcccagcagtgcaaatgcaaaacttgtgtgttttaaattttaaatggttaccaaaatgaagcctccaactctactcaaactacagcttgcaaaatcagtaatgaatccattaatttctttttttttttttttttttttttgagatggagtcttgctctgttgcccaggctggagtgcagtggcgtgatcttggctcactgcaagctccatctcccgggttcatgccattctcctgcctcagcctcccgagttgctgggactacaggtgcccgccaccacgcccggctaattttgttttgtaattttagtagagacggggtttcaccgtgttagccaggatggtctcgatcccctgacctcgtgatcctcccgcctcagcctcccagggtgctgggattacaggcgtgagccaccgtgcccggccatccgttaatttcttgacattgtttttcacatgccttgtgtcagctcccctaggcatctactgagtcccacctaaaacaaagactactccatacatctgcaatttttcagctgaggtagagaaatggagaagcttactactgttgtaacgtagatatatttgttcatgttcaccttgatctacttttcgacatcactggccaaggtttaaatttagattcatctaacattttgtgtgcacacattgtgctaagaacactgctagatactttacatgtattttatctgtaaatattcaaactccaggaaaaagttatttatttactacagcaccattatgcagatgaagatattgaggcccagaaaggtttaaatgtttatttaatgccacacagctgttaagaattcaaatctaagttattgtaactccagtacaaactctttcctttatattgtgctaccaaataaatcccagggaccctttgcccttttgggataaatattaccattatttttctggtctttgtgtctcattgggaacttgctgtgagatcctgagagtgtcgcttagcttatgcaggtgtgacttacagcctgtgtcaacaatctggccccaagtaacatgccaggtaacagtttcaagcctgggttacttgaaaagaaggctgagtaggttggtgggaactgggaccagtcttatgatggaggaatatgctgttgctattcttgaaattcttttcctccaccccacttcatcccctaccccttgttgttggcaagatttatcttcaggtatccagggaagatgaactcaagctacctctcctccttcccttcattttgtctaggtcctcagtcctgcctacacacaagtattagataagtctccctaattttaaatggaatggctggccaggcatgatggctcacgcctgtaatcccagcactttgggcgtctgaggtgagaggatcccttgaggccaggaattcgagactggcctgagcaacattgggagacctcgtctctactaaaaaataaaaaataaaaaaaattaacggcatggtggtgcgtgcctatggtcccaactactcaggaggcaggaggattacttgagccccagaggtctaggctgcagtgagctatgattgcaccactgcactccagcctgggtgacagtgaaaccctgtcaaaataaataaataaatgaatgaatgaatgaatgaatgaatgaaatagaaagagtggctgagggagtatgtgtttcattctgtgttttatctacagctcgagaagcctggaactctgtggtcctgcacctccccctacaccccccaacaaaaattagcctccaatcagctcctggagacaatgttggtgggaaccacaagggttcctgggcatgcccaatctctggcactgaagaggagattcaatcaaaataaatgtatgctgtcgaggccaggctggccatatgttcctgccaggcagttgtcaggaggagatatttgttacattcaaatgtggacacaagctcctacgaaggcaaacacttgtcatttaaagggacatctgaatatggcagcatgtttccagtgataacccaatttcattttacagccttttccttccctttctcttgggctctgggcctccttaccaacacatcctgttggccagcctgctctatcacagcagtatagttgaaaacctaggcacagctttctacccataagtagctttgtaatattcctaggaggaacttcctttctcccttcctctcccacattgcctctttgtccagatgttaacgtggaagcatattgactgcctactttcaagcccttaactctctaatttcactgatttctgtaatagaaagagctattattattaagtttttatcacagagctaaagtttagtttttgcaagtgaatagaccactattctccttcctgtgttagtaactgctttttaaagctcttgtgttctattaaaataacaatataaaattatgtaaatgtgctaattgctttattgaaattaatacccttatttagcaagttaaaccttgcaaaatgaccatttttattaaaaattatggaagcatgctggctgtttaaaggctaatgtaattgggtgaactcagcaactgggaaatgtcaattaatgagagattgttaaatagtattgtttaaacaatcaattttctcttgcagtttggaaaatggtcctgataaagtaatagtgactatctaaggcctgaaggaaggtttgtgagtattttttcccatctggtttttagatctgttggattttcttctgggtgtgtcaaaattagatttgtttagtaatagaaatttgaacttggcagtttatagaaaatcaggatagttctcctctgtgaaggtcattttctagctggcaataaatggccacatgcaacctctgccaccagaccgtgagcacttgttgaaatagttggagacatctaattactttctcctgagatggtttgcctttttcttagaacaggattttgagactataaagagatctatctctctgctcttgatagttagaattattgcgtctccttgataagatattgagtatccttcttatgggtctgagtttttttagcttctctaccattggaaataacaataatgcttgccacgaaaccatctaaaaatccatcgtctttgcagtagccttcaaccggaactactgatagctgttcctgcagtgccgttgttctcattggagcatactacagaaacctatttatgaaaatatcttgtggtttccaaatagttgtaggaaagggaatttttggtcacttatgcaatttacagaattgaggtcagttgaggatgttgggatagttctgactggagctgtgaagacaaaggtatgagtaatactctagatctctaagctcatttccaattgtatattgtttgtgagtcattggctttgaaaaccagaggagaggcccacatttgagtttatctgtaaacacccgtttttggtgtcatccagcatttgaaagtaatagttgtaggtggtggatcatgtttaatttctagggctttttgtgaatagatgataaagtgctcctttattatatgataagacacagctctccactctccctcccactctactcccccgtcatcctggaactaaatcaccagagggtttaatctatttcaattttctttgttcacatcagagatgttttgggtttgttctgtggacttcttatgactaagagtattgattttattaatccaattgtttgtgaacaaaagctggctttttttattgctggaactgaaaattagtgacataaactctgatatcttaaaaggctaaactcacatttttccccagaggcatttaccaaactggctgttacatttatcctttcctctactaaatttatgcaacatgaactgcaggataataagcgtaccaatatacttaggttcctaagagtttcaacataatacttctcacagtgaaatcattggttcagttataagacactccatgcactattgaaatacgacctaggatgcacctagttttactctgatttctgtgtagatgtggatgcaaggattcttttgattgaaacatgtccttagtttccatgaacaaggcaacatacacctgatcattccacccttgaaagatgcaaataatctttcacgttttatattaaaacaccagataaaaaccccatgccagttgactaaaatgagtttctaccctccagacagttttttttttttttttagttctaaggaaaatagttcaattttagctgtatcaatagcgttttgagcgagatggaagatgttcgcctccgttacagagggaatttcaggcattgcattggagctgaaatttgctggcacctgctgagtgagatttttctggcctgtgctctgagaacatcttttatcaagtgcatgatcatttatccagctttttgagatctaaaccaggtcattctttgatctttatcttactctgaacttcctaatggttgaacccggtcagaagagggtgaatctcagtcctccagacccttcaggaagaaagtcatcctgttggtagtttagttttctttgtaacaaaagcattttttttttatttaacctattttatcacttgaaaatctactattttgtttctgccatcctagagtgtgtttggtctaattgaatctcttcatggactctgggtggtcactaaagcatcaatttctcagaggttttttttttttttttttgaaatatttaaggctatttgcttgcctccaaatggttccagactactgcatgtagtttttatgtctttctttggtagtatagccttctcatttgttgctttcatgctgttaccttgtcacaatgcctggcaaaaagtaggtgctcattaaatatttcttaaatgaatagatgatagtattttctcttccttttctaattgcctacttctaatttgttgatgttttggaaatcaagtaggcatacatgataatattgtgagcaaatcaagattaaacagtatataattgcgggctttaatcccttggaaagtaaaaagccaggacttattttgtgatactgatcttgtgacaactattttgactactaagaggtggcttttaaaacatgctttgtgctttggaactgagctctgaatccacaaaaactgaaatttttgaattccaattaggtgaggtatctttgtagttagttttccatccaatggtcattaccaacacctaagagtactcccagaagcaggctgtagaaaaatcactaggccattactgtgtttgtgcttattttaattagatttcttttagattttttaaagctgtccagggagaaaatgtgtcccttgtgaatgcaatgtccattatgtaaaacttaagtgcatcaggggctttggaaagtgtaaaatttatacttagggccctgtttagtcaatgtgatgagatttaagatcaattataggggaagaaaagaactggatacattattgtttttaagaaaacttaaaagatgataagtatgttttttgtctcactgccaaatggttgacagtttgcttttttgaattgcagtggagctttttgagatgttggtcagagccacttctgctactctcttattgtgttctggctagaagtgttgggaggacaagaaaatttctcattagtgacatgtagtgacacttcactttattgtgcacggatgattttctgacagagatagatgacatggttcaagtttccaagaaaatgttattccatcattgaatggggaagctctgaaccaatctttccgatttacaaacagaccatagatgtgccaaatatgacaaactgatactgaaatgtggagccttgaaattgaagatgtttccttgttcattgttgggtatataaggttacaggtaactgagtacattaaccatgccatgtgttcacttttcattaagtagtgacgtggatggtgcaaggtcgatagagaaaagtctccattagtctgaattttttgacactagatttttattttcctatcaggaaatatttttttctggagcagaaagggcaaaatagtttcctccattttctccaacaggagcatctcctcaataggattcctcagcttgactcgctggtgtcaaagagaaaggcatattcccaggcagtggcggagttgattggtcacctgctaccccttcccttctgtaacatccactaactcctcatctccttgccaatagtgcccactttctgtttgacatcaaggaactaaatatagttagttctgacagaatgtctagtcagtgctgtgtcagtaaatggttaataacaggcactgagggcctgagtgtggatctgcttgtaacatctgatgatttgatttccatggtgtaagtattctcactatgactaatttcaagccaccaaagtaacatcgaatgtgaaattaaaaagaaatactaacaactggctcccatgatcccataatactcaataccagcatactactacctctattccaaagctgctgttttacatacaagaaaactgtgatctaaaggagtgaagaggcttttctgagatcgcacaaacagggtaagacttgcgccagagtacctatccccaacttctgaagttagtttttaataagctgatgatctgatttacttatgtttacatatgtagctgctaactgaaacaaatttatttcttttaaacggaagggccccttaggttctttgcttaagaccagaaaactagccaatgtttcacaaagtcagtattttagactctgctgcccagtttctggacaagaatcccagtgtatcttaatggaagcggctatcatgtattgcgtatatatgtgccagtcactccatatgcatagtgccacagaacccacagggaaggcatcatctttctctccacattgcgtatgaggacactaaagttcagagatagaaacttacccaaggtcacgtctcatacgtactaaggagtgtagtgagatcttgaccccaggtttccttgacttcagataacactttgccttgcacttgctgcattgttctggagaggtcttatttccactatgtgctgatggactttggggattttctgtaatttaggaaatatttgtgggaaacaaattactgtaccaaatgaaaatgcagatggagcaagggtttgatgaacaggtaggtagctaatagtatccatggccctttggggttctgatcatagtttttagtattttccctgctacttcgtccctcatctcatctttgagatttggtaaagctaactgtgaggactcacctgagaggacccacatcttatctcaaaggtccttttaaaaaataatatgagaaatattcatccacttctagaactaacggtgaataaccagtagttaaaatctaaaaagcaggcaaaagggttgcatcttttaaataaatataaataactatattaattagatataatcatatataatatatgcaatatattatatataaataatatataataaatatattaatagttaatgacaacaaggctggttaaagcaaaggctgcttcgttttatccttcttgtgccaaacgaatggcattcctatatgattcccatagtttgccagtgtgttctatctacattatttggagtgagtctgcagctttcagtactgtggtctgcattaaagtgggatgattagcataatctatactgcacccttaagaatatgggggcaattaaacactgagcttgacctaccgccctcttttgcagggcagagatgatcctgcacagcagaggtgattataaatatcagttctattcattcttcctctcaactgcttcgtctcccttccttccttcatctctctttctccacgctctacacatgcaatttttaacctccaaaactggtgaaaaactgatggcatcaggctatcttgctggaaattgaaaatgccagtcaaacagggtctccaaatatccaagtatctggatgtttagggtggtgtagacaaattaaccagatgcatccattgtgaatctggctctttttggagacctgtggaaacaacaaatatctatatataaagagaaaaataatactaacaagcaaacaattgctttgaagttccattgcaattgtactgttatatgtctggcagccacatccagtgtctgaaaatcgtggtcgtatttgctataacaaatcattcccactgattcccatgttgaagtctgaaaatttacagatgaaaaaaactatgtcaagatatccaaggcaatttctgcatttttaaataaagaaatagaagtagtgacctgcttggtaaagactaactaaaatgtcaagttgcttctttgtgaaaatcagaaagtttgctttgtgttagtatgagaaaaactaatcagtcaatactaaataaatgtaatttggtaaacaaaacctgttacaactagaaatacttagcagattttttaagaataaaaagagggggctggacttgtgaaaactattgaccaggaagttctttgaccaggctgagtgcagtgtctcacactttgggaggccaaggcaggaggatcgcttaagccagaagttcaagaccagcctgggcaacatgtcaaaaccccatctctacaaaaaatacaaaaattagctgggcatgttggtgcacacctgtggtcctagctactcaggaggctgaggttggaggatcacttgagcctaggagatggaggttgcactgagccaagatcataccactgcactccagcctgggcgatagagtgagaccctgtctcacaaaaagaaaaaagagaaaaaagaaaagaaaagaaagttctatgaccggttcataccaatccagccatgattcactgtacacccaactaagtgccatacagcagtgaggtcaagattgtacttgtagcatatacaatctaggggggaaaataaagttttacacattcgatgaatgttaccaaagtgtattagtctgttctcacactgctaataaagacatacctaagactgagtaatttataaaggaaagaagtttaattgactcacagttcagcatggctgaggaggcctcaggaaacttacaatcatggtggaaggagaagcaaacacgtccttccttcacatggcagcagcgaggagaagtacagagtgaggggtggggagaaagccccttataaaagcatcagatctcatgagaactcactcactatcgcaagaacaggaggggataaactgcccctgtgattcaattatctccacctggtccctcccatgacacgtgaggattatgggaactacaattcaagatgagatttgggtggggacacagccaaatcatatcacaaagggacttagagatatctatctagaatttctgcttctaaccaaacagaatttgaacaggagagtcatttacctatagttagtgattttataggggtcaaaaatgcaacatcctcaaaattatccattttggcaaaccagtttacaaatcctatattgctcacttctttgggttaaggtatttaaggtctcagtaaaagataatgctgtaagacaacgatgtcaagccattatgaaaccttaaaaactcgactctaataaatgtgttggattagcagccagtcacctaggacctccacagaagccctggctcaggaaaaaaaaaaaaaaaaaatcctctgagggtctgaagagaggaatttggagaggaaggaatccccgaaatgcatacttccaggtgagggagccccggtgggaacttgagaagtcttgttcctatctgaagacccataggctgaaagagatattgaaaggaacatcctaacaaggggctgaagcagccacaccagacaattctgatggggaagtctgccttccctagccagtgaactagcctggtagaacacctgctagatctggctgcagaaaagcacaagtctccctactgaatggcagcaaaaatgaagcagagtttctgagatttgcccaaggccatagaagcagtccgcctcacacctgggattgggattcagatctttctgccttccagaaagacaactcctgtcgctcccgatcatgtcctatttttaagttcattagttaacctctgggtacttagccagttccaagagccagtacgtcaaagcgtttttaaatggacgagcctaaagtgatcattgtctggttggcccggctcaccccgtgagctcctgcaaatgttctgtggttcatacagaggctggctgctcatcaacaagtttctctgggaggtgggaagcatctttcttctgatcagaacatgcctgtcacagagcgccggcggctaccaagcagtgcctgctcgaaagagccactgccccagcctgggagtccaaaatctgtcttctggcagaggctttaactgtttggctgctgctttcgaaggtccatgctggtacctcccaggaagagagaacccagctgggaagctgccagttgcaggcaatcttctccttcatttcaacttaacaagtatttaatgtgtacccgctgagggtccagtcctttggggtatgcagccctctggaggtctacaatcatgctggggagtccagacacaagcaggaggcaaccagatgatacatcaaggctctacataattaagagctctgcagtcacggctacaggaattcagggatgttcagggctgttgatgtagcactgcctctgcaaaaggacaactagcagtatttagaaaggacccaaagacattgtttctgccctatcagggttctttgtctcacactaggacacaagtaaaaatatcaggcaaaatgagacctctgcttaaagggagagctcatgaaaatgaatggggctcccctgatgcacaagattcttctccagacagttctatagggcactgagctgatccctatcactctgaggtcaaagggaaggctaacttggcctcagctgtcatggctgtgttgttaatcaacccttccatgctaaactcccagctccaatttgcctcctttttcttgtgctgatacttgttttattttgtccttgcttttcagcatttgctgggcacccacagggttctggcactccagcaaatgcctgggtggcagtggagtcataactcagaagacaggatgctgtgcgtgactgcttgatatctagcaatgcagtagcacggtggaagtttctggctgtgttaaattctaattgtttatataataagagcgtagcattggggggctgttataacatggagtgatgtgttgagcttgagcttacatggtgttagatcagctttctcacacttctgatatcctctcacctcctggaagagtgacttcttgagctaggcaatttgcttttagaagatttattgttaagtctgattaagtaattattagtaaaataatttgttggatgtctgtcccccttgcaaaactgtaattcttatgcaggcactgacacaatgtggattcttcttcattgcagccctagtgtcttaaacagatttgtgatgaaataatcgataaatatttattaaagtgattatattatttttctagggataccataagaaaattccacaagctgagtggctcagacaacagaaatttatttcctgtcagttctggaggctggaagtccaagatcgaggtgtcagcaggtgtggtttttcctgagacctctctccttgacttgtagatggccacctcctcacagcatgctcacatggtctttctgtgtgcaccctcatccctggtgtttctctgtgtgtccaaatttcctcttcttataaggacaccagtcagattagattagggcccacctgaaagtccccgttttaacttaatcacctctttaaatgccctatctccacatatagtcccatactgaggcactgggggttagggctccaacatatgaatgggggacaccattctgtaacagggatgaatgatagaaacagaatgaagtatattgcagaaaactggatcatattaaagtggataaactagagaacaatatacataaatactacattaaaacgagttaaagttattccttgcaataggagccctctccctcatttgttcccttggctagaaaaggacagggtggctttgcagtctgcaggccaggaatggtgttctagccatgggtagggtgtagattagttctgtaatttgggaatagtctatttctatttctgggcttttgttctttattctacaaaataaagggaatcgggctcatgaagtcactcagtgatcctatgaaaagccaaaccagaatggaaatattccttatggcttctctgtttgactaagagtgataatctgcagtaattctctttcctccaaggctcatggagagaaagaagagacccaaagtctactttgtcttttccttagtgggattccagttacctgtaagccagacagtcagggaagcaaaagtctctaccctaggaagcaataagcaactccctaaatgggaaaaaagccagcaaatgctcctggttcccatcttgctggcagggagcaagtctgtgctgccttgtatctgtcttctcctgtcttggtgatgacggactttaggagatacagtgttcaaggaagcagtaaggaccatgaatccacaaaacaggaagtcaaaccctagttcccctgctgacttgctccaaagctcagaataccaaactggtgaaatcccaactaagaccacttttcacactattccactgatgtttcccattcttccccgtttggagtgcagagttgagacattaccttgagcactgaaatgacacaatatacacatggaatttcctccccatccccagtgcagttttccagcaatatgtgataactaattacttgtgaccctcgcttccccttgttatctcctggaaatagttgtttttctgtgtaagaacttgctacagatgctactaaaataaaatccctgggataattagcagatgcgggggtttctgcgatgtttcattagtgagtggtgctggtctaggagactgccagcttgcttactgcactcaaaaagcagggttgtagctgccattgtttggatttgcatatgttcttcccattttcacttaccgcccctttgcccaagaaatcacctctccaaatcgacaatgactttccaaatctatatgtctttgcttttccagttactgccttctcttcatttacccagtcacatcgggttatggaaacacaaatgcagaaacgtgcccaaatcactgtgatctcagaaattcagagccgtttgcatttcagcttaaggcagcagcttctgaactacactgaatagaacttgggaaacctcgtgcacccagaactgatagaatgcttctcttgtgtgtttttggattgtgcagtcaattgacattttgttgacactacttcccttcaatttccctttctatataatttcaattctccttcttctaggatttcccattgctatttccagtggctttatatcatggctcagccgatctttgagaaataatgccaggcctctctctgttcttttgtatcccgcgtgctacctgattcttatcttacctgtgcaaacacaaatggggtacggccaagaataagaataacactttagcctcagttactgggcctagggacccgtgagagggatctgatatagctcaatcagtagttggctgtcttctttattctgcaagactgatgatcaggacaatccttcctcttactgaaacaatatattcctaacctcattttcaaattccctcttggtgatccctaggccctccttgacttcatcagcacccactgcttcctcccgctactgggctccaaccacctcagtcttctgtcaaccctgcagacgtgccaagctcattccaacgtgagaaccttggcatgtcttctgtcaaccctgcagatgtgccgagctcattcccatctgagaaccttggcacttactgtttcctctttgttgtacactctttccctatagctgcgtcttgtccttctcctcaatctgagaagctcattcttatgctcagaagttacctccttgaaaaagccttccctgaagttaagtgattttgcccactccacccagtccctatcttttccactgtgaaattctttcttcttcttaaacttggtactgtcaagagtaagctccacagactttggcactttatgttgtggccactatttttttccagcatccttaactgtgcctgtcccagattagatgctcaacaagtatgtgttgaatggatagatttaggaaaatagggttaagaaaggatgagttagagaggaaaaataagattcatgatcttcaaaaaggaatcagtggagaaatggccttgttggttcaggttttagcacttaaagtgtgttgttctcttggattttccagttgtgggtcatctctgaaaaggggcaatgtctgcagcaagtctgccttggcttcacacacagtcttcagctattacctctacacaaattcctctcagatctacaggtccgggaatggaggcccctaatcacagcatctcccctgattttcagattctgctatcacctcagcttcaacatattgaaaaatcattgttacttctggttcagcgactcagtctaccttctcacttgccttgttaacataccaccatcttccgcctttcttctcaagaagaaaaaaatcagacctcactgacgcttcaccatcttcagcccctcattcccaatgtatctaaaaggagctgtgccactttttagaaaatcaaccctcatgcattcggcacctgttattatttctagaaactgtattaagcctgtggacaaacagggccctggttgtcatggaatttgaagccacccttttctgttttgattggatgcaggaacaatgagtacacaccacacccagagtccatcccttgtcatatcaagtccctctttcttcaaagacaacctcctacctgtatcttgcagattattgccaaaagaaatatcctaagtggcaattaattgctctactttatcttcatgaacctaaactaactctgtcataagcctagagttttcttatgctgagcttttgaaacttttcataatctgatattcactcttaactaattcccacattcccccaataattcccacttttccagccaagatatttggagctcactatccccttaacttttatttttatccccttaacttttgtttttattcctatagtgcttaccccagaatttaaatttgaatggaaccacacatattatttaacccaacctctacatagataaattaaaaaaaaaaaaaccctgaagttcacaggcttaaagtcagaaaactaattctaaaaatagtatttcctgatttttaaggttcttcacccaatatattgtcattttttcttgctgtgtatatgtccatgtggttagtatgttagcagctcctatcagaaaccaatcaacgttctcaaacaaaatggaattaagagagagcttttgttgagtaaactagggaagaggaaaaagggaaggaggcattgggctaaaagaactcatgtttgcagatttgagtatctgtgttccattcattcaaatttgccatctggatcattagaatataagatgcctaagctttggtaggctgaagcagaagtatcacttgaggccaggagtttgagaccagcctgggcaacctacctaccatctctaccaaaaaaaaaaaaagaaagaaagaaagacagaaaattggctgggcatggtagcatgtgcctatagtcccagctactcaggaggctaaggcagaagcacaacttgagcccaggggtttgatgctgcagtgagctatgatcatgccactgcattccagcctgggtgctgggtgacagagtgagaccttgtcttaaaaacaacaacaacaacaacaacaacaacaacaacaacaacaacaaaccacccattctgagccgccatatcgataatccaaatccttgacttcctctcaacaccgaacaaaacaacatacacacctacacatggttgtcttttgtcttttagtataagacctgggactacacttactggagagcagctgaggctagagtgtaaaagtccaatagttgttgactaatagtgcctcagtggtagttccaatatgccagttaatgcataatgtctccccgcatgaaacctgatcaaaaagctttaaagctgcttggcccctactgtttgcagagggaaaacatggggactgagggccttagaaggaggggcaatgtgagcgcattgagtgactgggcaagacatcattagaaagacaaaaagagacatcattctcaaaatgcactgcgttgcaaagaggccacgattcttaaatgatgtttagggtaactattcgaaccgacaaaaaggcttatcaaacaattaaataaataaataagtttttaaaaagcagtcttttctttttcttccctgtgtttgaaaaccttcccattaagagaacacaatatgcaatggcaaacacggctcagcctcatcaggaaaagagaaaattgtttgaaataaacctcaaagagaaagaaaaaagctgtcattttctttaaggacactattatgttcttattgacaagacaaaagagtaataaagttaaattatagcaactataagcttgatagttcgattggagagaaatagagaaacctttgctattaaaaagaaaaagaaagaagaaaaagtagatcttttaatcagcccctactgaagcgatgactactgaccttacccctcactgagagcattcttgaatctgttccaggggcaacattcctacctcattgatacaatccaggaattatgaaactagaagtgagcttgaataatcattatgctggagtctcttattttataattggagaaacccatgtctatagcagttaagtggcttgcctgtgctcacacagcttttgaatttcaaggttaaattctagaaaccagcagaagctaaaacttattttctccagacacagaatctgtttattcagccttattacaaaatcatcatgctaacaacaaattcatggtgattatcctgaaatctatctccaagcatatttggagattctgagtatacttactaagctcttacggattcagggtcccaaattcctcctccctgtctggactaggcatcaggcagttgaagaaaaagcgtcaggagatccccatccttcctcactgctgtatcttgatgacagtcaacatctcttacccacacagtctcttgttggaacaggaacagtgcctctctggcccctgttgtgaaaagaatgaagcaaaaagaccctcctagccatgactgagttatgggactcttcagaactgcagtgagagaggccagacaccttagaagtgacaagttctcccttgtaatatatagtaggagttcagaaaaaggaaaatgcaatgatttttaagtactttgggccattttcctctcttgcttctctcctggagaagtctggacacgtttttatttggaaaggtgcattgtgacattttatatcgttccttccacctattaatagctctggccgccccaggtgctcattttcaagacaccctcagagaagggggacttctggcagccactctgcagctgatagctttggggaaatggcaggttttaattgatgtattgtggacactgttctttctttctgtctgtctctctctaaaacaaaacaaacaaacaaacaaaacaaaacaaaacaaaacaaaaaaaccgtgatgggtttagtatcctcctaggacctaggacctatagattttaatatgtcaattattccccttttatgggaacttgtatgtttgtgactgactcatggtcttccaggtatctttttgtctccatgtgacactgagcaccaagtatcaacatcacctgtctctctttgaataaactttctagacaggcaacaaccaacagcccctatatagatgctcatcagaacagcacgtcatatgaattcttctcaaattggtggattgactgttaatcattacaatgagatggaattggaaagtagggctaaaacgcaggaatgtgaagtaccaaaatttcttatttaaaaatagtccaggtggctacccctgatggaggcaatgttgtccaggcccgcatttctgcggacattggctgctccaaccatcctctataattctggcttgttgcaagtgctgcgaagacagcaatgtatttcccaagagcctcagagaatgttggctctgccatctctgcccaaagaagccagtgtctccatgctggctatggtgtggagctccatcgtaagccttgagacactgttctcaatatgaaatgtagggagatttcttactgctgaagttcccctcggtattctcacacactttttaaaaaatagctttttgaagtataattcacataccataaaatccacacattagaagctatttttagctttccacaattttcagcaaatttatggagttgaacaaccaacaacatcctccacttttagaatattttcatcatccaaaaattccctactggccatttgctgttaatctactctacccccagtcctagccaatactgatctacttttcttgtctctataaaagtgaggtttctgggcattgcttatcaatgggcttatataatgtattacatgatggtttgtaggttcatctatgcatagcatgtatcagtagttcattctttttattgctgaatggtattctgctgatacaggtttaccacgttttctttatccagcagttgatggacatttggattgtttccaatttggggctcttatgatgccatggacattcacatgcatttccttctatggatgtatgctctaataagcttcttaaatgctacttcttacatgcccctgtgcccctaactatgctaatcactttaaacgtattatttccagcctttgcaaaaactgctgagataggaattttaaccaagaaaccaaagcttataaagaagcaactcacttgaaacaatgtttccagagccaaaattcaaccccgtacacttcggactatgccaagcagtctctattactccctaacaaaaaagcaggcatttccacgaagcttgcacacgaaacccaatggctcaccctacagccatactagggagtgttgccaccttaaatggattggaggtttgcaaatccaccctaggacttcatgtacaaatattctcttcgaaattacagcaacctcaatggtcacttcaaacccaattttgacatggatacatagatcgatgcaaatgtatcaattatctgctttatgcctagaaccaagttgggtaaagtgaggaaacaaaaggtgaatgacaaacagccatggccccttgaggtcagcataatgggatgaccagcctcatacacacatgtctgaattacgtggaaccaactgcacatataatgagagcttcaattatttaagaatctgtgccaagacttaagccactcacgacttgtgtgtcatctacctttttcctttttcagttatgtgggcactgtagagctaaattaccaacagagagagagagagagagagagagagagagagagagagagctggactctacacaattagtgagctactcagaagatattcagtggaaacattttggaaatgttattatttaaggcagctggataatctgcagatatgtgtgtgtgtgcgtctatgtgtgtgtgcgtgtgtgtgcatacacacataaaatcttcctggaagcttatagacattttgtttcatttatacatctcacaagtctttattaaacacctagttgcagacatagtgcaacgtgttagcatagtgcaaaatggtgttccctgcccttctgaagcttacagtttcatgtagaagatgtatattaaataaagagattagttattaaaattatgagaagtgctatgaagaaatagagtatgtcaagggaacatttgcatttacacatgtgtcaggagcagaaggtgatgagctgatatttagctttgcattaaaacaaaacgaaaaacccagagccaaacaagaataaagaacctttcaagccaatgtggggaggaagaattcccagtgggcaagtgatatatcctggtgacttagagtaggaggctggcaggagagatgaagagaaatagacatgtttataaatggaaagcccttccttctgggtcttcttaaaatattctgcaaatcttccataaagattggcaatttctctatcaaggctgggtaacctcatatatcaattctccatttccctgcccaagtttgtgataacatatcttccattaacctatgctgaaagagccatttctattctaagaatctatttatgttcccctacaactttctcaaagatatgcctctgggttgtaatacctcacgctgatactcagctcaaatgtgaatacttttgccacatttcggtaacattgatcgagacttttctgagtcatttgatcatggggatgtggggatgtcttctctttgtggggaagaaaatgacatccctttcatttgaagggactaaggactgaatttgctttttctgttacttgccataaatttggtcttcattgtcaacagtatcctatgactatttttccaattatttcatgaattaggacacaacaggtaatcttatttctgacatttatttgaataaataagtgtatcttcctattcttatctctgtttttattaccttaagtaacacactgaatttcatttcaagtccctctctctctattttctcaattctttgcacagtttcttatgaagcttctctggttaatttctgttactttccagttgtcagaaacctttaggtatgtgatcgtttttcctgaaagatctctaggataaaagtctagttttacctttcataatccccacatcctatcaaatctgctttttgaacatgtactttcctgtaccactttctactgaagaattagttaccctttttcctttcaattgcctgtagtcattaacagaaatattttccatctgtcactctcctatttgtctttatttctcttttttggtaagaagagcatatacaattgcttccaccctacattttggtcaaattattttgtggtacggattgaaaagtttttataattgcaccaagtttcattgacccatattaaaggtgtcagtgtgcaaaaaaatttctatctgtataagctactggttttccattaaaataagaatgattttttttagaggacaattttttaagagacaagatcttgttctatcacctaggctggagcgtagtagtgtaatcatagctggctgcagcctctacctccttggctcaaggaatcctctcacctcagcctcttcagtagttggaactacatgggactacaggcacatgccaccactcctggctctttttgtgtgtgtttattaatccattttcacattgctattaagatactacccaagactgggtaatttataaacaaaggaggtttaattgactcatagttccacatggctgggaggtctcaggaaacttacaatcatgacagaaggtggagcaggcatgtcttatatggtggcaggggagagaagtgcaagtaggggaaatgccaaacacttaaaaccatcagatcttgtgagaactcactcactatcatgagaacagcgcggcggaaaccacccccaggattcaatcacctcccaccggatccatccctcaacacatgaagactgtggggattacagttcaagatgagatttgggtggggacacagccaaatcatattggtggagttttgctatattgcctaggctggtctcaaatccttggtctcaagccattctctcccctcagcctcccaaagtgctaggattacaggtgtaagccaccatgtccagcctatttttgtatttgtatcttcatttttttaaaaaatgaaattagacatactggtttcattacatatttcttggaataattatcacttttaccataataatagagaaaccgaggaaaaacaaaaacaacaaaaaagtgttatttgagacaaagactatacaaggcattatactaagaacggatatgaacagagagattaaataagacattattcctgccttttaaagactgacacttcagtaattaagaaaaaaataaaagatgttcatatatccacaataagatgaacataagggaataaaaattcaaggaagctgggaacggtggctcatgcctataatttcagcactttgggaggccgaagcgggcagatcatgaggtcaggagttcaagaccagcctggccaacttgatgaaaccctgcctctactaaaaatacaaaaatcagccgggtgtggtggtgggcacctataatcccagctactcaggaggctgaggcaggagaatcgcttgaaaccggaaggcagaggttgcagtgagccaagatcatgccactgtactccagcctgggtgaaagagctaaaccccatctcaaaaaaaaaaaaaatcaatgggaagagagcaatatttataatgggctgagtagttttgcacattcaagactgattcctgggacccacatctttgagatcagcatgagaagaaggggaggcaaagttaaatcagtcaatgactgtgcactggcatttgaaacctatatttttaaatgagtgtctttgcttttcatcctaaatcttataaaccatgtatagtttatcaataaagagatctgcctttttctgagggagaagaattgaggagaaacttgggatctggaactggctcaatctctggctacattgcctattctgataaaatcctcttcaccatcatcatctccctttgctttgaccaggtgtattagactttgtcaaaagcaatggagatgattttttcaaggttagaaggcataccggggtgaactgcaggaatggttcattatcttcggggaatgttaatggcccacctcgaggattctaaagagggaaagaatgagccaaacgacgctttggattaaacgatgaactgagtgtaaagcccacagtagaggagctggcacacagtaggtgctcaatgaatagaatttccccatcacccttcccttgccctacgctgttacgggttgcagctgctgtccatataggcctgttacagagagagcagcaggtgtttgccaggcgttgacagggtagggagtctgattctcagagtttgcatgtttctccttgactcttgatatcctgagtaattcttgacaaaggcattgtcctcgtcatcctgtagtggtcctcttcttttgacctgcgcattttctggagttgtgagccatgttataaaggggatgagtccagatgggaagcatcagtgatgacctggcattttctgctggggtgattggtataccatagaagcagttaatcaaggacggccaaggggctcctagaacacacgatagtggtacacctacactttgatcctcactctagacctctgggagcctttttgaatattaaactcattaaccaaaggaaccagtctgccactgatgtacacattccagcctggggttttctttttttaataaaaatgatgtgggtagctgattcagcattacagtggtttctcccccaacctccagaagtatgtcaggactgttattttatagcataacatggctgtttagaaggtttctgaaaacctagagcttaacatttttctggtgccattatatcatattccaccagtgtatcaggaaatgtgctttgggaaggtcttgaagaaaatttatagaatagaatgacagcatgtaacatcaggaggacctgacttgcatatgatatcaggaaaggcttccttaaagaagtaaactgattagtagaaggtagccacagggagggagaggagtgtatgtgaactgggaggaaaaatgatgtattccaggagttgaaaggacagggttgccagggtggagagaggaagcaggggagaggagggaaatacatggtaggaactgggcaaggaccagaccttacaaggtttcatggatcaccttaaagaggttcttaaagaggtaagaaccctatggactctgccttaacaaaacaggaagccagtgacagatgtttaagaagggagtgtaatgaccagatttgtttttaaaagatcattttgcctgccatgtgaataaaggattataaagacagtaagagtgatattgagaggaccgataggaggttgtcacactgcaagatggcatgatggcagaggatagcatgataatttatccttgtcttttgggagtttacaatctagtaagggagtggacatgtgtacacagaattattacagtgttgcatgtgatagtgccatgagaattaagcaagataaagtgagaaagagagaggtcactttttgcagagaaaatcagggaaatagcttcttagatgacaaacaggatccaaggaatgtagtggcctgaggtttgttttgttttgttttgggcttgtttgctgttatttagatttttagatacaactgtttccagattaataaattgctttaaaagtagctttcccactgttttggttttttttaagcttcacatacacatacattttctgttccagttcacattatctttgtcaggcaagaagaaagcaggttttatggttatatatgtaattcccttttagactggagtaagtgaattcctctatttctcttccaggtcatctgtcagtccataaagccaggaagagttgagagacaagtctgtcttcttgaggacgcgtagtttctgtgaaaataatacacacacacacacacacacacatgcgcgcacacgattgtgcaaataaatatgggtatgatgctttcatcctaagaaattcagaatgaattgcttttagaaggacttacacaaagttctcatgcagctcttggggccccttctttccttcttttttttccagatggagtctcactctgtcacccaggctggagtacagtggtgcaatctcagctcactgcaacctccacctcctgggttcaagcaattctcctgcctcagcctcctgagtagctgggatttcaggtgcccgccaccatgcccagctaattttttttttttttttttttttttgtattttaagtagagatggggtttcgccatgttggccatgctggtctcaaactcctgacctcaggtgatctacccaccttggccttccaaagtgctgggattacttgtgtaagccaccgtacctggcctattggaacccccttcttgaaacacctgtgtgagcaccctgcttaccatctaccagtgaccacacccacatagggttctatttcagtgagactacagagccaacaaagtgcactagttagctgtgatggaaaacctaccaagctttactgatggatctctgctgaaaagaagtaggctaggttatactgaaaccatgagcaagaaaaatgttcagctggtcatgttgggagtcattgggaatattctagcccatgatttcattcacattggctgaactctcagctccacctatacgtgagcgtggctagtcacctaagctctctgagtttctttggaaaaataaagtggttaggctgactgatcccccagatgttctgcaaactcagtttcagatatagatttccatccaggagagctgtgaactgattttacaggtttagcctagcattgcaaggatttagttatatgggtctatacacaagagagtacttgaatgtgtccttcatactgatgccagaaaagtagagagaactccttaattcctctaagtatctagaaacacattttttagccaaggggatggttggctatttgaacgagaattttgactgtaccccgtggtttctacaattaaagaaatggcatatctggacttagaaagataatggtttcctaggagtttgcattcttagaccacacccagaaaattatgtttcgtttgagattatgcaatttaaggatgttgacaaatctgaatgcatgcaaagaaaaatggtaaggatgaagaaaaacccaggaagactgctatatacggaaaagttgctaaaaacttggaagggttggtctgaaggagatttagggatacattacagctgtctcaaatattgtggagtactgtcagaggaaaagaaatgagactatcctggctctgtatttcctaatagacctggggtaaatcgattgaaattgccaggagcttaatttgggctcagtgtggaggagaaatttctgacaacaatatgtagccaagaataggatgggatctgatttcccttgtgcaaagagtaattaggaagagactggatgttggtaatattgattgtgaaaagcagtgagttgtgtttttacatgtattaatgcaatcttcatgataacctgttgatgttgcttctgttattatttccatattacagatgaagaaactgaggcacagtgtgggtaagtcacttgcctaaaatcacacagttagtaggtgacaaagctgggatttgaactcatgaatgtcctatcgtcaatttgggaggcttaaacatgctgacatgttgccttcaggtggccatcacataggtggatagtatttctgccccgggtttccagaatggtctttgaagagctcactgatcatggtgtattccatggtgcataacagacagattctgtggtagtacctaatgcaggcagaggtgccttcctgcaggtgtgccagagtctttggtaatgagccattatgctccgtcagtcattctgctgtaaccatgcatagtcatcctgtttccttcctcacagtatatggagttgggatgcattgtttcttggtagaatttactttgtctgccatattgataatatccacttcagcagctacactatgacattcccttaaaaaaaagaaaattacaaaaatatccaaaagccctacttttgggatatgcagactgcaactatactttccttccagacatgatggatagttgtttccctataagatactgcaccttgtgtgagtgttggagagagatctctgctttattggccctttgcacgttaggaaacacaataaaagaggtaaagtgctttccagtacaggaaaggaaaaataatccctttcaaacttgatcagatctatctaaaggtaaccgaccaggaaggagaactgaccccatttcacatacaggtgctttaaaataatttcacaacaggtagttaaaatgtaactatgctgtgctgtcaatcacatctcgtccttctggattttaacgcttgttttacttgagggaagatgatatttgaacattctatagcatccgtcaacaggaatgcgcacatggtttcaaataagggttttcagccttctgaaaccaattacttctgcctaagtggaaatgccagagcagagatgtgtcagcaactaagagaataatttaaaaaaaaaaattaagtatacacagtgatgtcagaaaacaacagaaattgtgcattcctgcacacacatgtacacacatgcacatgaacaaacctttttaagagatatttcaaaaaaaaaaaaagtctgtgtcaaacaacgttaacccagaaagatgcagaaatgtcagagacattacatgggcaggacttgcggttggcatttggctggcagcgggggaggcgtcctccccaactaattcctcaggaacctcatgctgaggctgtctacagggaagggagcagaaagggaggagggagagagcagatattgcctattatgcttttccttcccagctggagaaggcctcagctgtgtcagactgggactgctggtgatttttctgtagttagagggaaacacaaaacgaagagcggcccactcccagcttacgccgatggtgagcccacctctcctgatcattagcgttgctggcacaattgaatgcaagccagatcatctcttatggagacccggcagtacctcacctcagtctgtgagttttctccatgggaaggttgtgatggagtctctgggtaaggatgatggatgtgcatgcagatggggttttgcaagcacctgtcctcactgacagggtagttggagtatttactttaacccttcagcggataccaagggagagatgggagacttgacggtgaaactatttgatttcgcaccgcagttgtcttaacagtagttgtgaattcttctcactgagtctaatttctaattcctatcaggttgttgatctgaattttttttttgctaccttcatgatatctgccaggtatttcaccagaaaaaaaaaatatgtgaaaataaatataaatataaaatggaatttattaactgtaaacatctgttaagtcaagcatcctgtgtctattgctgaaatactctttcaagtgactctgtctgcatctgtcacatttttttcaccctccagagacctatttgcggtagctctctgtgtactaatgaaaacgtgggattggctttaccctttattgtagcttggtgttaagacatttttaaaataggcaaaaggaagacaggggaaatgatccattctgttagctgaattttcttcaaaacatggattagtcttgctgcttgtatgtgatatttagcatgctgaacaggtttttgtgaaactcctggtgtcttctgctgcaggtggctgggtttgttgacaaatcttcaggtgtaccatttgccttcaaagagggtgctgctgtctcatcagtataaatggagtggtaataacccctcacttttctagggcaacgtatgttttacaaagtatcttcactgtattattgagttgctctcattttattaggacatcagccctgtgtggcaggtattccagttgttattagctccattttttaaacaaggaaactcaaggcaaaagactcatccagggccacaccgttagaactggacatgttggtatttcaacccacttcaattctcaagctttgttttcttatgtatatgaactgtgggtagtatagacacaaccaaacaaacctaagttgctgtttccatgttgtatgatatatatatatatgtaatcccacttcctttttgcttccttaagccacactaggcacagttatgatgcagaatgagtttaatttcagcatgccccacctctcttttccacaactcaaccccacaacacaagctcatacacagacttctgttgctcccttggtttaggaacgtgggttcctgagatgctgtgggtttctcctcatttaaggagaaaatcatcagtaaatctgatagggtttataatacctctcatgagtccagagaaaacaaagtgatggttccacagtggtgcaatttcatttacctcaatctgagtagaagagatatgaggctccaggaggaaatcccctcatcctttgaaaccccacacttcaattatctcagaagttaggaacaaggacatgtatccccagaagctagggaggacagatgccctcatggagactctgtgtcttctatttcaacaagcatagtgttctctcaagagtctgccaatgagaaaccttgagaactaggagcacctcaccaagcacctaggaacacattgtaggacaacttagataagccccacatgatccagggagacaaagtcacccctcccactcccacccccagctttcttccaaccaaggccgtattgccaaacatctgcattcagtgaccagttgcagttggccactggttctttgagagaacacagggtgggttttaaattgccctgacatagacccccatgaaatcatgtgagacatctctttttgggttttccaaatatgcttggcagtactttctcatataccttttctttcttttttctttttttattatatttttaaattttatattatattttttatttttttattatttttatatttttaaattttactttaagttctggggtgcatgtgcagaatgtgcagttttgttacataggtatatatgtgccatggtggtttgctgcatccatcaactcatcagctacattaggtatttctcctaatgctatccctccccttgcctcccaccccccaacaggccccactatgtggtgttcccctccctgtgtccatatgttctcattgttcaactcccacttatgagtgagaacatgcagtgtttggttttctgttcctgtgttagtttgctgagaatgatggtttccagctacatccatgtccctgcaagggacatgaactcattcttttttatgactgcataatattccatggtgtatatgtgccacattttctttatccagtctatcatcgatgggcatttgggttggttgcaagtctttgctattgtgaatagtgctgcaataaacatacgtgtgcatgtgtctttatagcagaatgatttataatcctttgggtatatgcccagtaatgggattgctgggtcaaatagtatttctggttctagatccttgagaaatcaccacactgtcttccacaatggttgaactaatttacactcccaccaacagtgtaaaagcgttcctgtttctccacatcctttccagcatctggtgtttcctgacattttaatgatcaccattctaagtggcatgagatggtatctcattgtggttttgatttgcatttctctaatctcatataccctttcttttgcttcagaaagagaacaaggggtttcacattagaagaattctttgttggaacaattttaatattctgaagtctttttcttagagcattcaagtatgccttggttaccctgtggcatggacaaatgcccttccacctcagccacagtttgccttcatgcatctgtcaatacataagtgcaaagtgatgtagaatctaccagagtttgcactgtggggttgtcttttatactttcctttttaaagtaatcctgaaaatctcttaggaaattgatggagggtgggttcataaaacctcacagtgtcagagttggaaggcagtctaaattgcatgtggtccctatagtgtcattatgatgaccaagaaatcagttcccagggaggctgagatttgtcccagtttaccatgatggtgactgtgctgcatattttctgtttgtccttcacattctttcattccatcaatatcttgctctctgccttggaagctgaccctatagactggatctgtgggtgctctatcctctagctgattggctcaatgggaagagatcgaagatcagaagatagaaggtggaagagagagaggcaggggcacttcctaccagcttggaagagagagaggcaggagcacttcctaccagcttcctccttgtcattgtgctatagcaggctgtttttctgtatctgagacagacattcccaggtagccctctccatacagtcttctctttctggattcttctaatcacttccacttttttttagctctagatcattgcatgttagcttttataagcacttgctggttgttaggactcacattctgtacatggaaacatttattaggactctggttctgtaagtgaaaaaattcgctgattttctcgagccatgcacactgacataacttctgatttccagaaaccttgaccacaactgtttaaatagtccccttattaaactctctcatattgccaggtttgggtgtcatctgctttcatgctaggaccttgattgatacagaaacagctaaagctaaaactatagcccagctagttctctgtctccttaaccctattctatttgcttttccaccatactgcttttactatggataccttgatactttgaataaataataattgtttcataaacacacaattttgatagtagataacagtagcatgcagtggttaaaaacatagactcaacatcttgggttcaaatcccagttctgacacatactagattacttaactagcaagttgcttagggttcaaatcccagttctgacacatactagattacttgggttcaaatcccagttctgacactagattacttaactagcaagttgcttaacttctctgtgtctcagtatcctctttcataacaataaggctattgtggagattaaatcatatcagttccttcaaagaacttagcacatatgagggtgttaaatgttcataagtgctcagcacatggtaagtgctccataaatgttagcttttatgagtgttggctgtttgttaggactcacattctgtacatggaaacatttatcaggactctgattttgtaagtggaaaaattttcagattttctcaagccttgcacgctgtcataaaatttcatgaggataaagtcatcagttcccaggaacactgaagagttacaggggaagtggggaggtgcaggtaagtgggggtatatatgagtcaccagagggacgtgaggagagatgggaaaggaatgtagacaacatcatgatggacaagcctggatgtgccaggaagctctaatccacctgggagggctgtgaatcagcccccttccagcagggtaggtgtccagtttctggctggttgacctgggaggaggccatggaagctgttgccccatcaatctattgttgagagatacagccatgagcctggatgttcctacaacaataattatgcaagagctagtttacaaaggtgctgacaaaccccacctggagacagtatttctttagctccgaagtgtgaaataaggtgtgattttttaaaaaaacatagattctgtttttcagatattgattctttcttttgcatatttgataaatattcagaaatgtgaaattgattatacttgagcatggtcttacttgagcttactagagcggtggctgtacttaagctctacatctctgggtagtcactgtaggtatttggagagaggagctaaatttctgaactgacttatttaagtggaatgctatgcccagctcttcactggttaaaactccgcatggtacattttatcctcaatggctttgctcctggtcttcctaagggtgcaataaattgtggcttctcttacctagaaccagtttcttctcttctatcattaaatagggcactgtcacatgcctttgaaagaaagagaaattaagtcatcccatcttttgttgttcaggatggtgacactttctgttattactttaggtcaggcaaggaaagaatttaatacactgttggaaggcattggacataggaggaagtgcatggtgctctgtggcctctgtgagttagacttaggccctaacatccaattgcaggcaatcgaggcttctcccacttgttccctttctccttgttttctcttttgcctttattagaatttttattgttggcctgattctgatcattggtaattgtccctagagtggacagccagtttgatttaggtggacttgtaaataggtaagtgtcaacaacaggttccacaagcagctgccttgttattgttgttgttgctgttgttgttttgagacagagtctcactctgccacccaggctagagtgcaatggcatgatctcggctcactgcaacctctgcctcccaagttcaagtgattctcctgcctcagcctcctgaggagcagggattacaggcgcgtgccacgatgcctggctaatttttgtatttttagtagagacgggtcaccatgttagtcaggctggtctcgaactcctgacctcaggtgatccgcccaccttggcctcccaaagtgctgggattacaggggtgagccaccgcacctggccttactgttctgttcatgtcctgctgcaatgtccatgtccttgcccaacaagtgacccactaaatgtctctgtggcggaaatgtccaggtctacgggtgactaagatagtgagtgaatgccttctcctatctaaactttctgcttttcctcttctgtcttttgtaaaaatgaatcctactctgagcaagctgtttaaaaataaagatcatcctctgtctcatccaccatcttcactgtcagtttcctctcccctgcttattttcttacttttacttttgttttttgttttgagtttctaacatgctatgtaattattgattatgtgattgtctgtttgcctctacccattaacatataagctcaaccagggcaggaaacgtgtttgtgttattcactgatctaccccatcaacccagaatgccgtctgatacatggtaggcagaataaacgaggaaacaagtgtcccaaagaggccactccaagaaattcttcaacctctaaaaaagacccaatattatatttctccacatggagaaatatggactgctattagaaaaaaaaaatcatcctaaaatcatgttctatcaaaataccaaatattaaaagggaaaatatcaaaagggaagttttgctttctaactggtcattgttttagttttgaattattaagttgaaagcataaaaagaaaaccatcaagtagcacttacacagacccacaaatggctctgcagaccatggattgaggaccacaggcctaatgagaagtcacagaattcatccccaggccctccaagggaactggaatttctcacttcactccccaagcttctgagcagctgtacagagctcttgtggccttgccattcctccttccatagacacattcagcaattatcatgtatctgctgagccagagatagaagcacagaggtagtgccagaagggccacttccagcaatatcgctgattgaaaaagtttcctcaactttgaatcatcaataagcttcaaccaacgagctaggagtgccattggaaccagcgcctcagctagaaagaattaagtacatgcagaagcgctgcctgacttggggctaggttgagaaacacatagttcttgattctcagatggctctttggaagaaaaatcaaagtgaagtgactaatttttagtctctttctctctcctctctctctctctcatgcatacatgcatataaacacacacgtgcacgtgcatggatacgcagctctaaggttttctacaagtgagctaagaatatccctggctccttaggaggacaaaagatcccctcctgcacatccccaaagacctttgtttcactcttaggtgtgggagaacttatttatgtctaatcttctgcttttcaactgcgtaaagcatcaaagcttctttatcaggtagactaaactacattaaggatcaaaaagaacacataatatttgtgatggccaatcatattctagagagatgcttccctcccttcctctcgttattttcgtctatttctcttgcccatgtgaaaacctgggtgatttaagcaggtgctccagtctgcagtgctctggttgtcagttggcaatggtgaggttaggcatgaaaagccaattttagatattctcctggtattgatctctgcttatcagaaaggcttttgctgtgccagttcacttctgtgcttaggcaaagtcttttacagatttaccaccacaacttactcaatctattataaagtagcatcagcatgcagggtgtttttcccctttctttgacccagttttaaaaacatccagctaaaaatgcttcattaagtttacatagaggttgcaaggcaatcaggattcctcctgcagttgtggctggaagaatttctacaagtcctctacatcttccgctccaaaagctgctgtctttggggctacagaacatctgccatgtgcaggaaatactttaccaaaattcaattgaactgtcagactttttttcccaccctttattccttttccattatcactgattacccagcttataaattcccagttcacactttctctttgacctgacttctccctgtagagcaattccggaaaccgggactgtggccctaatgcacacactattaaatattggcactcaaagtcacaagagtgtattccagctctcttgctgaaggcagctggtgcaaggctcactgcttagagaaaaatgtggtcaaagcaagtgaatgctttaaaagatcttttaagaagtaatatttgggataccttggttcatattccatcctgtctggtgtggtctttttatttcttacctatgtggaccatagagagcacaacttttaccaacaggcttttcccagttcacaagtctaagtcatttcattccttcacattagattctttatgctgagagtttcaaatggcagcctcaagctcccaagcaatcagcaaatgtcaaatgtccccaagcactgcaaccatctgagatactgagccactgcctgccgaatgaagattgtattattagtagtgtaatgtttctggtggggcggggaatagaaaagtcaaagaaaagaaaaaaagatgctgttcacagacacaagctcaattgtcttcaattgcccagcattgtctaagaaccaaagtcattctaacatcaaatctggggagagtttgctaacttcattaccacttatgtcttgaataaatgataaatggcagtgcgcgcttctaacttttcatgaatttgttttaatacctagaatttttcttctaggtaggctgaacttccctcactttaaattgtctgtttactttaattaagctttcctccggctctccaacttgttgagcttgacaagcattaatttacagtgagcattttttttttcctttttctttctttgattttttcaactttagccctctcatccttgcctggcaaagaacccaatgagtaactgacaagcaacttattactaatcccatctttcttcgtgggaaggtgtctcaatcaatacaagtcagaatttccaagccactcctgctgatagtgtgcattgcgtgtctctgtgttggcttcttagcgtaggcatctcagataggatctggcagacagggagatgctgaaaaattctcaacttaacattccagctgtgacaaagagaaaaaaaaatatattgttagggataaatttgggagactgctgagtcttccctccactgcttataccccaattttaagctacatgctgctatccattctttatgtcctagtccaatttgacttctgaaaaattttcagtgaccctccctttccccctaccacccacagttaagtaaggttcctcatccctgctctgagaacaccatctgttttttccatcatagtgcttcttatatcctatttaaattaacttagcaatttaatttaaattgactggattgtcagctctccaaggagcgagaaagcctgtcttattgtcatatctcacctggcaaatcatagcttctcaagaaggagacctctattgaatatgatttgtaagctctgtgatctggaagctagagagagttcccactcttgcctttgtgtttcagacagtgcattgagttacatgtggcaaatttttacctgcctctttagatctaaatagagcgcattcttaggtggaacaggggcacttggagacggtgggccggtgaggattgactctttactgtcccagtctatcacccgtatgcagagaagatcagggccaagttgcatatttatgatctctgaatgaatgtgccttccctacttgcccacggggagctctcccctgagtctcccctctgccagacacactcctgtgctttgatggatggagctgactgggcaaattgctatgctgatgaactgctcagctacctgagcaaatgttccagagagatctccagggatataccacattttagagaaggattcatcccagcctggggtgagccttttagcccttagcaagctgagtatggtggagtaaggaagatgaaaggactacagtctcagttctcacttttctgcaacccgagtgcctgtccttgggctggcgagaggccttattgcatttttcactcctcccagaaagttattcaaattgagacctacaggtctgggtgtcactatgctcactgaaagagcaaaatcaagaagctgaacagaaagcacttaaagggaggatgcattaccttaaaatatgcagatggaaaactgacattattgtcaatgtcagaagtcacctttctgagtaaacatttacctctgggcaaatgcagggatgtgtttctttccgtttacaaatgactgggtatgcaaatgcagggggttagagttgtgccccagaaggtgcagttgtcttctttcatctatccataacgaggaacatgcaggaatctgtcaaaaaaggcatcatgggcttgatttgtaccttctgaataaaggggatgtcagtgttaaatctgccagctggttttgtgcctaagtgttacatcagtctcttgtatgatcttgcatcctgtgtaaaatgcaatattttggcctaatgggcaggattagcacgagctgggaagccataaatgaaagtttcttgtttctagagagcaagttagagcttttatattatctgccgcggagctcggtgaatttaaatgtatctcttgggctttggtaatattcgtgttaatgtcaaaattgatcccattgttattgagatgtgtggttttttcaggccgaagatgcacagagcctgttgccagggctgatgaatatatgcaccggacacattctttctaaccgtttctcagaaccgagtgatgttgtcatgttatcatggtgcctgctaccatatactcttcacaggtctacatttttctgtaaatcgcttgtaaacttaattgatatgtattgaagacctactgtgtgcctggcattttgtttgactttggggatcaagcaaacactgttgcaacagtgggcaagatctgggctcttttgccataggatttatccctagaaacacagagagagagacaataaaataaatgaacaagcagaaatattataactgaatatttatgttagtgttatgtggacaaattgcaggaagagagaagaaatcacgaggaggggagccactggatcagctgatgaccaggtggtatttaagctcagagagggtgaggcaaagatcaccttgaaaatagagagggaaagagctttcatggcaaaggaattaatatgtgcgagtattctaagctggggaaaaattttacatatttagagcattaaatggagctaagcatatctagcacaaaacaaggggacacagtgggatgatacagaattaaagagattcccgcagttaacagatcacacagggcattgtagccatggcagagtttattattttatcaaaagtgcaattagaagccatcgaaggatgtttcttagttcaatttatgtctttacaaagtatatttttacatccattcaaatggctattacatccattcaaatggctattatcaaaagaatttaaaaataggaaataagtgtttacaaggatatggagaaagtagaacgcttggccaggcatgatggctcatgcctgtaatcccagcactttgggaggctgaggcgggcagatcacctgaggtcaggagttcgagaccagcctggccaacatggtgaaaccccatctctactaaaaatacaaaaaaattaactgggtgttgtgatgcattcctgtaattccagctactcgggaggctgaggcaggagaatcggttgaacctgggaggcgaaggttgcagtgagccaagatcgtgccactacactccagcctgggagacagagtgagactccatctcaaaaaaacaaaaacaaaaacaaaaacaaaaaacaaaaaacaaaaaaactagaaccctcaagcatagctggtgggaatataaaatgatatcattgctgtggaaaaaagtgtagtggttcctcaaaacattaaacgtacaattaccatatgatccaaatccacttttgtatgtatacttgtcaaaatgaaagagcaaagactcagacagatatttgtacacccatgttcatagcagctttattcacaatagccaaaagatggaagcaacccaagtgttggtcaacagatgacagaatacacaaatgtggcatacacataccacaaaatattattcaatcttaaaaaggaagggaattctgacacatactacaacatggatgaaccttgacgatattatgccaattgaaaaaaccagacatgaaatggcaaatattgtatgattctacttaaatgagacatcttagagtagtcagattcattgacatagaagatacaatggtggttaccaagtactagagaaatgatggactgcagggttattgtttaatgggtatggagttttggtttgaaaagacaaaagacctccggagatggatggtgatgatggctgcccaacagtgtgaatgtacttaatgccattgaattgtacacctaaatatgattagaaatataaatcttacatatacttcaacacaataaaagagaaccactatattttatgctagatagaaaggaagcaaaagaataatagggaaaagagaagaggctactgctgtagtttattattaagactatgatcacttagtggcaatagagaggcagagaatctcaggatttaaaacattttaaaggaagaggctgcaggacttacttgtggataacattccagttctttgtattttgaactctgatatacttgaagtctgtagaccacacttgtgggggtaaaagactggcaaaatccctttgactggcagatgtgtttaagcttgatgtcttggtgcatgacaaggagagctttatttttaaactcttcagtagtcttggatggagtatgggagctattgctgttgacatgtgaatatttgcctgaactgtcatacagcagtcatatgctcagtgtgaacgtggcttgtcttgagatttgcagtgataactagcatgtggctagagttgttcattctctcccttattagtaatgcgcgtcttccattagcatatgcaactaactactcccgttcccctgtgctgtgttgacattcattgtaatgatttattatccaagctaaataaccctcaatatgaaacaacaaacatgcctatgtttgtgttttccattggttttgttttccctttctggcttccacataagtagatagttctttatgtgatgattacatgctatagaaacaagcaatgggaaagcccactagaaaggttaagaatgttggtaaggtttatttttaaactattgaaaatccaccaaacttagtgacatcccccattagtgccttggaatttaaaaaaataatgtagattattaggaaaacgtttgttatgtgcaaacactccatataagacttaacgatctacgaaagggccacatttgggcttcctatggagcctccaaagcccttagaagctttattttatttatttgggatgtttccacgattatctcaaccatcaggagctcataatggttatgaagtggtagagagtggtggtggggatcccaagctctaaagttagactgcctgaatttatataccaacaaagccactgactgtgtgacctgggattatttacttaagttccctgagcctcagtgtccctcttctataaaatgggaacattagccatgcctttctcatgagattcttgtgatgattaagtaagataataaatgtaaagctcttgcaacaatgcctatcttagagtaagttctcaataaatgttagctgttattagaagttctcagcctctgttccctgtaacttgggagacgggatgtataggtaagaaggaggaagattctagagggtgcggctcatggtcactttcttccccacatctcctaaacagcagctctgtttttggtatcaaaaatctgaaatagtgttactttacagttaaatcaacagaaagttgttcagttgatgttgaaaactatggaatctcctttttaaaaaggtaactttcatgatccacctcttaatgctctcagtttttatactctgtttagtttttattgacatctctgtcatggggcagctcatctagacaagtttattgaaggcaaatgatagtgatgactatggtgctttgcacacagattgtcaataacaatctggttgtttggggagcacttagaaatgtggttcatgcatgtgtgaacctcgtcagtgtaagttttgtgccatttaactgataacatttcatcctcactcactctggtcattttattttttattgaatgtatgtagttacattttggtcaccatgataacatttaacatcattttggacactggggccttttcattggctaatgataatttctgtatgttaacatcacagaaaaccaattgcattagattttatccagttaaactaccttacctggcttactatggcagttttgttttcttgtttttctgtccagttgccacttaaaaactaaactggttattcttgccgcaggcttttccccagtagaaaattgttattggtgttttgtaagtatcgtattccattcaaaggtaaaaggctccttcaacttcccatttttcctgtgattttttttctatactatgtctgcaaatcaacactcctgggctcaattaaaatatgtatttagtcactggacttgcagagaaatgatcaaacttgaatagtaatacccaggctattgcctatgaatacaaggattgtgtccattgagggatggctttcaagacaatggccagtgaacccaggatgcctgtgggattattagagcttggtgtgggtctaaacctgaagtttgctagtttttttttccccagtaaagacagagtttgttgttcactaaattcacaattgtatggctagaatgttcacatgggaaattcaaagctactttctgtcttcccagtgtctagtgatcccatctgccagaagtttattttcccaacatgtgctccaaggacctaacacattgcatcaggatagcactaatatttgttgagttcttactatgtgtcaagctctccagtcctggctgtggaaagaatgatgaacaaaggtaggcacagcccctacctcatggagaatccattcaaaggattggaagagggagtgatgtagtcgtgggaatcaattgggcagaacagcaaaggcttagtgattaagaatgagtattccagacaaggaaagcaggatatacatgactctatggcaagttagacaggtggcaagttagacaagtggggaacaaggagaagttacggatggctgcagccaaggaaagcaaggtccaaagtgattctggagaagcgataagaaccagtccacctaagcaatgttaggagctttgtcttgactttttataccaaccttagtgcaataataggtactactgatattcgttttccaatgtttaagcaaaagtggtaaactaacttcattccttacttaggaagtggcagatgtgggatttgaaccagaacttgctcttgtaaccaccacgttgcacttcgtctgtaagatgcatgcctaaaatttttatggagttttgactcacagcattattatccagtgtcaatgtggtcttcctgtagggtctgttacgtaagtctgccattggtttgcttttcattaaaaagaaatctaacttctggaagagtaaacgggatacaacacagtaaacttctgaacagctttggttatctgtacactgaatcctgggtctctaagactcagaggggggcttaaaatgagggtttgagggctgttggtcccactggggaggaccatggctgagagaggatagtacagctttcttggcaggttccaagttgtaaagcccaaaattagaatttaaaggaggcaaaaattgtgtatcagaaaatgtttcaatgcactcaaggaataaaaataacctgagatttaatatgaagagaagaaagaagagaataaaagaagaaaggagaggggagagagaagagagaaaaagagagcaacatcactacattataaggctacttcaatcggtcactctctctctctctctctcaacttttagtctgaagctaaacacttgatagattagcccagcactaaagaaaatgccctcttttatgtgtaaaagcttggtaattgctgcagaaagatacttagtggatcctaatattcatataatcagattagttttgaatcctacctcagcagaggatgttggaataatccagttcatgcctgtttaccttgtctgtgtgttcactttttttctagtcattttatcttttccgttggactcagtaggtgctagcaacaaagctaccccagtatcttagagaacaagtcaagtaccaattcaaaaaggaaggaaaaatagtagatttaaatgtttgaagaagagtagggttttgtttgttattttgtttttgcttgtttgctcctttgcattcttggtaacaattgaaacaattctatggctctcatcctacgctactaaaattttgttgggcagttaacatctcaattcataggcaacagtctcatgaccaatcctctctgagctttgaacatatggctgcatctgatggcttcgctaatttcaccagggagagttttagaagatctctatttgagggggcagccattacacagatgagtgatacactgctggaattaattattgcttgccaagtttaaggattgattcattctaaactcagagccaaaaactcatcttaaagctgaaatgtttttgattcgctggttccagctccccttcacagaccctctaacctagcgccatgtgtgttttgctgttgagggtgaactacgtatctgaatgccctagtttgaaatgcgctttctaattatataaatatggtggccatacagtacctgggacttataattaaggatgatcttaccttgcaactccaggcttccttttcttctgtgaaagcttcctttcttcctgaaatgaaagtggcatttcagccatctgttgtgggctgctgtcaataaaagaatccaatcacattttacccacatgattctgcatgaatagtaaacttggtctttataaattaatatgtgttccctggaatttaggagtggtcttcagtatttctgaactttcctaagatgaataccacttgagaaaataatatatcaaaaatattataataattgctggaatttaatggagaaaagtggcagagattatgggtgaaagctacaggtcagttttggaaatctacctaaaagcatgtcagttgggtgagcttttttctctgaccaatgtatcactgtcaggacatcacacttatggcttgattagcttttttaggcagcatggctctctattcattgtggaagttatcccagtgggcattctcctaggtttccctggggaaagggtacaggccaacttctctcattttatgttaggactttgaagtctgacgttttcaattacataccaggcccgacattttctttgaataaaacacttaccaagtatcagacccacttttttttttttgcagtttataatacaaaaagcaccctattaatagtttgcttcatatagattgtcaccatgccaagtttaagcacctataatagccaggcttgcatgttaaatagaatcagtattctgttaaccagaagaacaaataaaaccattctcagttttccatatgtttaacctccttgaaactactgacaggtcttttattttggaagtatattttacacggaaggagacttcctaaatatgatttaattcttttctttcctccagagaaataggatttaaaactttgtacttgtaccctccagaaatggctcaaccaaacagagtcaaaatatcagagcagtgaaaaaagatgctatattgtttcagactcaagatctgtctcttgtgataaagagatttaaattctcactgctcaccaagcaagagccaatctgagccatggaatatattgaaatgatagaatgctttcaagtttagcatttgtgtgtgtgtgtgctccatggttgaaaattctgtttgagaaatatggttagactattttgacaatttttaacctgcttaaattggattttttaaagtgcacaaattgatgttctgcctacttggagaatgttttaaagatatcaagacttcaaagaaaaacagtgagagtaaatcagatgcaaacatccctgtatccatcctagcaaaattagtttagtatttcctagggcgatgctaaattagaatgatgctcaggcattagggcaagtaccactggtaatcatcgtttttgttatggggtgggaggtggctgagaaaagaaaatatattttcctatcttgtaggaatcaccaaatgacatcaacttcatagatattttctgaggttacaattgagaattcttagtgtccctgccactgtcatggataattgtgtcattttcaagtctcttggaatttggggtgttgggtggcctttcttacccttgttgttctttcctgtcctgctatttggtcatcagatatcattctctctcttattgcagggtaaattaggtcctgaaaatggcaaggagtattagacaagatttcggctccagaagctgaaagcattttttttttaaatgaagccagagagatggagtgatctgcttgataataaagcttagctttaatgccagctccatgctgttacagcatattactaaacagcaagaactgtggcacagatgttgtggcggccatattttacaccatgcaaaaggtcatgtcgcttgttattacattcagaatcaatattaagtgagcgttccaaatttcagctgtcagttgaatttattgctgcaaaccaaagctgaagggttctcgactgtgattcaagcaagctaacaaattaactaatataagggcatgcctagaagatgcaggtgacccacatgccaacagcaaaagcttggttcttacattgctgcaagaaagagctgctccagctgccaaccagaaacaattgtcatctcaataataaaagggagggagggagggagggaggaaggaaggaaggaaagaagggagggagggaaggaggaagggagggagggaggaaggaaggaaggaaggaaggaaggaaggaaggaaggaaaattaattctcaggtggagttaattcaggtggatgaaatatcctgaaggcagcttcttgagataaaatatgatgtatgcctatctatctgacaatgctcaagatcacagttaacaccccttagagtttacttgcattgccaaattagtccaaggatctggccacctacccttactccatggtcttctttagacctagacgtggatgcattgacccaggtgctaatcggactatccttttcatctcaccatgtatcatctcaacagctacattagggagagtctttcttatagtcagctctagaaaaggtacacaaatatctaatagatgaacatccatttaattcatacatggatacccctgggttgcctaagatggtttattaaatggaatttgagaattccaagttaatgagaagaaactataggtaatatccaatcactaggtcaagaggggatgacaaaagtctcagaaatgccataccagtggattctgtgcataatggtggatgagtaggaatttcgaggactgtcagcagcaagcctgagtccccatgcccatgggtttctctgaaataattctcaaaacatatccttaaaactgtctatgtccatgatagtttccccccagtgcatctgttaagacagtgagtgttgcccaatttgcaagttgtccaaggtatgcactggggcttatttgggtgtgagatttttttttatttttattgtttttgagatggagtttcactcttgttgcccaggctggagtgcaatggcgcaatctcggctcaccgcaacctccacctcccgagttcaagcagttctcctgactcagcctctcaagttgctggattacaggcgtgcaccaccacacccagctaattttgtatttttagtagagacggggtttctccatgttggccaggctggtctggaactcccaacctcaggtgatctgcccgcctcggcctcccaaagtgctgggattacaggcatgagccactgtgcctggccagggtgtgaggtcttacaagaccaccttgaaaccagtaagcaggaggaaaccaggttgtgtggcccttgtcggatggaatttctctcttaagaatttcccatcacagttggaaaaaaatatcatgagattttgtacagataaataagtctccaaactgctggtaatgcagaactaggtttaactggggccctcagcttcctgacaaaagcaggactcacttttgggtgttgactcttattctgccttctgtgacaaacaccagttataatttttaattgactttactagaagtgtttaggaaaaaaatctgtaattctagtaaataagtacttcagtcaaggactgttcattattcaagattcaataaacattttctgagtacctactctgggcacattctgtgttcagtgttctcggattaaaaaaaaaataaacaagacatggtccctattctcagagactgggagagaaacaggcatatacaagtgaatacaatgcagtgtagtcagatgtagtttaaaattctgttaccttagacccagcaggtttatttctaggaatttatccagagaaacagtgtgcaaaattatgtttaaatgaatgttaattgtatcatggtgactggcagctacataggtgctcagtgactgtttattgagtaaataaatattattttgaaccattttcaagagcagagatgggaaattctaaatgtaaaacaaagagggttggttaaatatgacatctacaattaaaataatttggaggaataaatatttgtgaagaatatttaatggcattaaaaagaattcctaaatatattgttaagtgaaagaagcttacaaaataatatatgaattatgattgtggtcctgtgaaaggaaaaaaaaatccacacacacacacacacacacacacacacagaagagaagcattcttatcctatatgactaaatcaagtgatggttggactaaaaaagtaaagcaaggagtcataaaattcagactatatatatcaaatgttttaacttaaatatagaaaaataggccaggcatggtggctcatgcctgtaatcccagcgctttgggaggccaaggcaggtggattgcttgagtccaggagttcgagaccagcctgggcagcaaggcgagaccccatctctacaaaaatacaaaaattagctgagcgtggtggcgtatgcctgtagtcccagctacttggggtctgaagtgggaagattgcttgggcctgggaggtcaaggctgcagttagccatggtcgcaccactgcactccagcttgggcagcagatgagaccctgtctgaaaaaaaaaaaaaaaaaaaaaaaaaaaaaaaaaccatatatatgtatctatatatatatatatatatatatttttcattaaccttatgctacactgatcttaaggggcagggccaacctttctctttgagtgtgggattgtttctttcttgcataaaccactcccattaggcagcatctatgattttctatttcggttctttaaaatagagcaagaaattaaaaggcttacaaagaagtctgaatcctgactccttctagatgtttacatgttccccatcatttttttccagttgtatccatacctaatttgacagcattgtttgtagcaatttgcatgcattgaatgtttttcaaaagactgaacttaagaaaacactttgtttttacactattttatgagttcatgctatatttaactgaattgtgaaattagattaaaacaaaactggcataaataagtttgagaataaacacaatttacaggagtagaagggggagggttattaaagactggcctacaagctgcatgctatgcatatgtttatatgttttacagaggagacagagagtgtgagctaatctaagtcaaccaaatgaaagtccactgaggcagctttgggtgtgtatattagcaaaggagagagaagacagtgatggaaagaatggaatctcaatgttgatagtgcttatctctggaaggggaaattatgatggatttgtattctttttctcttttcctatattatttaaattcatacaatgaataagtatactttcaaaagcaaattattcatttaattaatttattttttaataaataagtattagaaataaaagatgtaatgtgcctagcactgtgctatttgatccaatcagtgtttgggaggtggtacgacatatttgttagcaatgctctctttgtatttgggttccctggccttgaatctcagccctggcacgttttacatgtgtgattttgagaaagttcccttgaaattctctatagtgtccccgtttgtataactgcaaaatagagataacagtaacagtgcctaacagccagggttgttgtgaagatcaaataaagcacataaaaatcttagaagagcatgtgatatgttaagtgcttatatgttagctaggtcttgtttagtattatttttcttatgtcagaaaaggggcttaatttctaaacagtgagccaaagcttagctcttcatgtcattcacagaaaaaaaaatgcaagtaagtaaattattaagtaacagcatgtgtgtgcttgtccgaattctgtgggataggggttggaaaattatagtccatgagccatctaaccaccagttgcctgtttttgtaaataatgttttcttggaacatagccctgccattcatttcttggctggtcctggctgcttccttgctgccacagtggacagagttgagtagttgcaccacatggactgcaaagggtaaaatatttgctatctagccttttatagaaaaaatgtgctggcccctgctgcaagggatccatcaaggtagtctccttgtaggctacagtaaaaagagaaagcttggtgagctaaagaagatttgaagaggtgggaggaaagaaaaccctgagatatgaatccacatcatggatgcatggattctgctgaaaccaacaagagccatttatgtggaggagaagtgttctgaaagaagaaaaagtttggccaagtagggtaggaactaatatgaagacctttcttgacagcaacaaaagtattttaggtctagtgtgttgggcactgagccattacagagtgttgaacaggacaaatacagagcatggcttaaaggagattatctgacagtggtatgcacagggattgtaaacctgtaactggagagtaactcggtacctgctagagtcatatggttgtgagaaaatagggtttcagcaagagtgttagtgggaggggatagaaaattgaatttcatatagtcctttaatccttataagaatgatttcccacagtctcacgaagaaaacacttgggtttttttccctaggaataagcacaatagtatatagtcaacagcaaaatttatcattgttagcagtatagcacaatttttcctacaaaaggaattaaaatgataactacaaaatgggatacttaatctgggtgaaaatgtagaataggcttatgatgcctttctttgaaagtcatgtgtgtgtgtgtgactgcacaagatttagtttggggaagcaatctgaaaactatcttacttcatcaggatgccttctataatggtaagatcttaccttgccagttgtcaacgtctgatctgacttgctctctacttagcccttggctaatggtgtaagcagcattaacgcatatcaggctgtcacccagagttcagagtttctttagagtcctttattgtggtacagaacatcatgatggcaatgaggtggaaggaagaaacttttcattctaaacataaagtgaaaagaaaagtattctcagcacacaacctctaaaacaccaagcgggccagcagtggtgagcggtagctctgcctccttcctggagggtgttttgtgctgcatgttgtaagtagggactaatgtgaagacctttcccaacagccacaaaggtattttaggcctagtgtgttgggcaacagggacccatcacaggctgttcattactccagcctccattgacaaaaagtctttagcgactgcaaccaagaagcaaccaaacaacagagatagtattagaagatatatttattgtcctaccaaccaagaacctctctagatttcaatggggttaggtgagaggagtggtggaggatcctcagtcaccttgaccattcattgtgagatcccaaaatgcacttctatggtgtctaaaatttcacaaaattacgtggggtgagaaatgagaacatgttacttcatattgtcctatacacatgactttattagggtctgtccttcgtttgtagtcttggcactcactaacttagaatcacattatctaaggcaaaactacttaaataactgagttttaggatatgtatcagtcagtggctcccctcttcgtgtttgaatcaagtaacataccagaacaaacaagtctcagagagaaaggctttctgtaacattttagataagccctggcattgcaatcatctcctatggatactgctgacaaattctgtcctgttcccagcacaactttagagaaggctacaaccagctggagctgggtagtggggagggaggaaggaaacacagccactgttacatttggccacgaacagtgttgagccatttttcaatgtaccaaatgttctaataaggccacgatcaagttccagttgcctcatggcaaatcttaaatatcccaaatttgtagagagaagggagaagttcccaaagcatggaataaacaacactggtgacactccgggtgactctaggtggtttacacacttggcattaagaagcactgaatcacacagcacaaatgtttttcactgattacactctatcagctcttcttactttgtcaaggagaaagcctctatttgatcctagcatgtcttacttcataacagtcgatccttgtgattcttggatcccctacttgctaatttgccaactcacttaaatttatttgtaacctgaaatcaaaacccgcagtgctctcacagtcatttgcaggcatgcacagagcggtaaaaatcttgagttgcccaacgtgcacagtcccagctggagccaaacaaggcaacactctgccttattgtgtcagctctcatatcgtaaacaagtgtcctttcacggcctatttagtgccatttttcccacatttgtgtactttttgttggtgattttgctgtttaaaatggcccctgagcatattgcttgagtgctgtctggtgatcctaagcacaagaaagccatgatgtgccttacagaggaaatacatgtgttggatgagtttcgttcaggcctgagttgcagtgctgctggccatgagttcactgttaatgaatcagcattgcatattaaatatggtgtctttaaacagaagctcacatacaacaaagctatgtaataattaattgataaaaatgttgtgcccagagactcacaggcacctaactctgtgtttcctctaggagcaatgattcagtattctctaattcagtgttcacccttgctgacattgtaaaacataattactgcaaatactgagacccaactacacttacataacacactggcaatagtatttttgtaagaatttgtcaacacttttgtttccacttatttatttgtttttttgacatttttattatttgttcttgctgttaccttctatttatatcacaaatagcacttaaaatgtccctatgttacaggcctgctgcggtggctcacgcttgtaatccaagcactttggggggctgaggtgggaggatcatttaagctcaggagttcaagaccagtctgggcaacatggtgaaccaccatctttacaaaaaatgcacatgttagctgggtgtggtggcatgcacctgtagttacagctacttgggaggctgaggtaaaaggatggcttaagcctgggtggtcaaatttgcaggaagctatgattgcaacactgcactccagcctaggccctaagacatagagacaaggtcttgtaaattccatgttacaaaatagtgatgcaaaatttccaaatacctttattggagcaaaatgtgttaatacaaagaaaaaatattaagtaaataataataaaggtactacagtattaaagccaaaataatatgtgaaggaagtaggcaagaaataagcttatgatccctgggattggagagagcattcattcttctcctttcttacttactgcctccttagagtctagccctatagctgagagcgagtttaacagaggtaatgtgacttcgtttgctgagaaaagaaagaataaatgaaagtgatcaggtgagtatgtggccattctaaactcaggctataggcctcgtagagtttagaatttatgaaaatcacagaaaagattaggagtttcctgcattggccctaagtttccttagaattaaaagttgggctggtcgtggtggctcacacctataatcccagcactttgggaggccagatggcttgagtccaggagttcaagaccagtctggacaacatgacaaaaccctgtccctaccaaacatacaaaacttagctgggtgtgaaggggcacacctagctacttgggaggctgaggcaggtgaatcaattgagcatgggaggtcaaggtgcatgagccatgattgcatcgttgcactccagtctgggtgacagaatgagaccctgtgtccaaaataaataaaaaaataaaaataggctgggcacagtggctcacacctgtaatcccagcactttgggaggataaggcgggtgaatcacctgaggttgggagttcgagaccagcctgaccaacatggagaaacccagtctctacttaaaatataaaattagctgggcatggtagcgcatgcctgtaatcccagctactcgggaggctgaggcaggagaatcccttgaacccaggaggtagaggttgcggtgagccaagatcgtgccactgcactccagcctgggcaacaagagcaaaactctgtctcaaaaaaaaaaaaaaaaaaaaaaaaaattaaaaagaaaataaaagttggcttctgagttactgttaataatagagctcattgttcatcaaacttggcctctaaagcaaatcctgctttagatggcccaagcaagctggctccctcttgttttataaagatgccccatgtgcagccctgggaaggtgagatgggaagatgctctcaccatccctcagtcaagtcattgagatcatttccaagttcagctctttgcgtcacactgtccttcaaccggctttattgtaaatgcaagagaagggaggtttttggcacttggagcaaaagatgtaaaaacaaaaaaattacaagggagcagtcaaacagaaaagagagcaattaaagagacaaaaagtccccttagctgccttttgggtacttttttgatcttttcaccaaggaattagtagcttttaattttccccacctcagcttaaaagagtgctggcaggaaagaaatgaacattatgggaaggctgctttggattaaaaagcaaatgtaggtgagactatcaggcagctgtcagactccatgaacacaggcctgctcgcccagctcagcagccaggttattgctggacaacaaaagtccccaatctagaagcagtggctttcctcagccttatttctaataatcaggtgcatgcctccacttggcttgatattttctacaatcgtctggcaacttgctgcttctgccacttaaaagtggggaaggggttgcttaatttttaaagcacagtgcatctgaatttgagtgaaagctcaggtccttgttctcactgtggaagatgaaacattgattggcttcaactagaaacaggttttttttttttttctgtcttttgtttttgtttgtgtcttttttcctccttcccccaggagggttgtgttcagcagcacacaccgggttcagcccacctagcaagtccaaggagaaggggtcatgttcatctgggagatggtaagggccaggcctgggcagtgaggggcaggagtgagccgtgtttgtggatgatcactggatgctgcagggcagacccacatggcactggcggcagagctcaccattgggaaccagagtacaatatttcagaaggaagggtttctgaaccccagtttaacaagccctctacagcaccagttgcaatccccaggaaactcgttaatgcagttagatgccacggcagtgtgcacttaagacagggaagaagtacagctgctcttcagctccgcggatgccaaagcagctcctctgttcattagcccagcctcttcctctatactgaccttatggagatgctgctggccttctgagaactagtagaggcaagcttccaaatcattgtgttgtttttagcattacgaaaccatcagccagtatctgaagggttctttgcctaccagcaaatcgcttggtcctgctgaggaatcacacagatggtgtgggagccctgggctccctcccagggtgcgtgtctctccccaggggagcaccccaaggtggcaagaagtcccccggggggacttgaccagggccttggtcaagcttagaggtgcagtgtaccccaaatactaatctggaatatatggagtatcagtcaatgtttgtgactaaataagagggagattgagggatgcttggaagtcactgagccaagcaggaggcaaagctaaatggtccatctattgataaccttgtgaaattttttgcaatgaaattaggtttaatttaattgagaaaaatggacagggacccagcagtgtcatcgttgcagcaacagttgtaagcatgggtgctagagtcactgtctaattcaacttctgactttgtcattaatgagtttttagactttggaaaaattgcttaatctctgcagcttcagttttcacttttgtaaaatggggaaacaaatagtgatgccctgaaggggttttgttgttttggggggtaaagaaataaacagaacaatgtgtgtgaatatgattaacacagagcctagtccatagaatgtatgtagtgaaagctcaatgcttgctgctgcttctcctcttcctcctcttctgtgattaaattatttaaagcaggaataatggtttttatagaaatcatccccctttcattttaggctaagtagcatactacagtcatatgaaccttaattgtgatcacacatacaggcgtaagcggaaagataatatagttcctgccttctgggtgtttacattcctagtagtctctgctcacctgcttttaaccttctccaggataatgagttatgtgacttttgggtgccaggtatataaaaccatgttttcctgtcagccagccagtgactataagaattcacacatttgcatttgtcattgtaattcttttgttccaaaaagaggtgaaaaaaaggttaaaaggaatgtcatccattggaaagatatatcaaaatgtgtacccgtatctcatcagaacctcacacagaattaagagtttgtgttatttgggtttcaatttaaggtagagaatcaaaaataccagtgacaaatgatttgtgactcctacttaatttattcaactccaaatgatttcaataaatctgggaattcatctatatcctgttgaattaaggtttttttttttgaattattctctctaaatatgcttaatcttcattaatgcagccctgcatggcattctgagccaaagtgaactaagaggaaaattttttacatttctaattcttaaaatagacagaatttctttttttcctactacacagtctgccaaggcatgtatgtatagagatttgatgtacttgtagagtttttctctctcattcgcctatcctgttttatcctagcacactctcatttctggatatcacgtgatgtgatttaatgtggtcactgtattttctttatttcttccctttttcctcagtgccacaggaagatgaatcaatgatctattaatatgcatttcatttggggaagctgttttaaggaagtttctttcttcccttttttttcctccttgctcatgtagctaatgaaacaatatgcatttcaattccaaggctccctggattcagacctagagagtagctaacacacaattgatttctagtcctgcaggaaaaggggaagcagtagagaaatcagatggattgatcgctgagaaacaggacccatgggatgcttcactatcatccatgtcttgaatgtatgcacaatcccttcatcaatagagtaatccccaggataggaacttcatagggtccagatggtagttcaagtaggcaggtgtgttagcctgtagtttgtccctcttcaggtctgctctgccataataaactgccaaaataaatttacaaattcagactttagaaactggcaaatcagaggtagaatgttgagcagtggtgctgacatttcctaagagagcattagacaagggacagcaagctcaaatgtccacaagtaccatgtaggttggtgtgagacagtaagtgttaaataatttctgtccatccctcaggatagcacctgcctacttactttgtgttataaagcatgagtggggtgggggaaaaatagccaaatgaaacatatttatgggtcatctttatcctaaaacctgctatttgtggtccctgaattaatactactcatcattttacagaagaaactcaaaacatgagaaattaaacctccttacccaatgtgtcacactcagaatttcccaatcttttcacatttttttttctgtctctgacgccatgaccaaatgccatgcttagagttcaacttctagttttggaaaaccagcctctaatgcctcaggtaccaagcctctgcagaatgctattgtttacactattagacaggattctctctctcacaaatggcagaggctgaactccagctggctttggcaaaaattaaaggtgaattcattacctcatgactgagaagaataagacaattctagctaacagagtgactggacctatgttcatctcttagctcagttttctctctcggccttgttcttaagaagaccctccattgtaatgacaagataagttccagtatgcctagacttacatatgtacctgtttaaaaacccaaccaaattgtcctagagcttctctttcttaatggatacaaacaacacactcctaagattgaatctcattgaataacttaggtcatgtgccctttcctaaaccactggctgtggccaggagaaaggaataaactgaccaggctgtggaaactccccactgaacctcctggcctggaaataaggagaaaagattgagaccttggtccaaaaaaggggatgggaatcaggcagccaaaagcaataattaccagtcatgcttccacttcacactctgtttgttcagagcctgtctttaccacccaggagctttaacttagcacataggggtttggactttgttgggccacatctcagagctccccaaacctatcagaagacacacactgggaattaatacaactttctatgactcaaatgcaaaaagttaacccgttatagaattctaggtttctccacttttcttcactcttctttaacatatgttactaagcacttagtaaaatactagtcactttgctaggtattaagcacttaaataccagacacttgacaacatgctttattttattcatacaacaatcttgcaaagcagagatgattatccccagggggcaaataaggagcatctgctgctgttcaaggttctaaactgtgttccaaggagccatgagattccacactcaggagatggggggactgggagaatccaaagtgtagatcatgaggccaaggcctgatctccatcagagcacttcttttgttggtcttacatttttaagttttccatactaatttttctaaaggcattgatacttacattctttttgtgaaaatcacttagcaagtaatgaagttattttactgctcagtacttgtacaattgcaaatgaaagaattctgacttaacctcaaaaaaatgatagaaaggtccaggcctggctgaatccagagcttcatgaccggggcttccttctactcaaggaagtttacattctttgactccatgtagaaacaggatggatatctatcatgctttcccttctcactttgttcagggcctgcatttcccacctggaagctcctggcatccatcctatgttctatcaatctcagcagagaaaaggctttccttttccagtgattccaacaaacaccctgtcactgagtcttattagatctttttgacctagcctacatatcatggctgtccctgtcctctgtggccagagaagtaccatgctttgtttggccatggtggaatcaggtgttcacctgtgcaggtgggaatggagacaaccctcgggaaccacatgggttgggagtgtgagtgagttgccccgctaaaggaaaactagaggattgttggtgaaggtagaaggtggtagatgagagttcacttgcccaccaccgctgtggtagagctgagatcatagcatagatctttaatttcaaatgaatgctgtttctaatgcttcatgttacttctcttttgtccttgatatgcctttaaaaataacagctattaagtttttgcttaattctttttattttaccatggcaattagtggtggatgggtggcccaaggaattttctgttttccaagtgggtaggactgtttttatttactacactatttgagaagacacatgcatagctgttagaggccctacttttgacatcagaaaatgggttcagatcctgattgttattgaatgactttgtatgactttgggccaattgccttactccagtcccctccttcataggatttttttgaggattaattgaaagcatatgatacagaaaatggtctcagcacagttgctagctcctagtattgcttttctcttccttaacttgatttactcgcaaggattatttaaattacaaaattccttaaaacatgggatgcatagattaattgacagtaaaggaatctgtgaaaacatttcttcaattaaatctattgcataaagaaaaaaccacctgatttacaactcattattgtgatgaaagtgtcattagtaattgttggcagcatatacaagccacagtgaaatgccaaagaagatctcagaaataaggaaaatatttcagtcctctgagagtcaaagaggtaaaactcatcacataacgggtcttcaacaacacttttcttatagatcatgtattaattaaggcaatgcaagctgtggtaacagaaaaacttagatttccagtgacatagtgtctctcacgctcactatggtccaatggccaaaggtccagtcttctttcttattatttagggctcttccttagatcatcagcttcctctccattcagccatggcaaagtcacccttgtttctcgattactgagccaagaagtgacttacgtcactcctttccattaatggtcaagtagcccttcctagatgcaggtactaggaaagtgagtcctaatagcaactcttcaaaatgacaggtaggaattacaaaatctttgtgggtcaagctgatcatacctgctgcagctctaccccactagatctactacacgtcctgtgatctacgaatctacgggcatcttgagaagaaccactgtgtcttacttagcattgcctccaatgcacagcatagtacctggttcataaatgttttctaattgaacaaaggtatcaataaaaaaactaacagataatcaggctaggcctcgaaaataatttctagacaaaaatttgcaaccacttgaaatccatatttttcttttcctggtctctgtccaacttgtctgatatggaagtaaaagtagggtaatgtaaccctaatagcccctgaccagagaactcccaagtaagagctacccattgtgggaagccagaactagtcgtaggtcagtggctgcttcaccctcatcccaattgctggcctatttacaaagttaaactcacttcattcctcgacttgaatggatgaggagccagaggtaatcctggacaggtggaaggagtggattccaacatttcttctctggatcgcccagccaagtttggctgctcctggtccatgggtctgtcctcttccaggttggttggacactttgaatgtcctgtgcttaatgattattatagcatccacataaagtcatttgggttggttttctttgctgctgctttgatcgtgttgtttagattccagcccgctttctctcataaaccatcttagtatgtgctttcatttgtttattttcagagccaacaatattctttggtactaaaggtagtttagagaagtagttaagaatatgctgtctgcagtcagactgccttaattcaaatcctggctcagcttaccagcagaatgaaatgggactttaataagagctccttctctagcaggttattatttaaaaatagtactcagcacagtgctggagacataatatgtacttaataaatgttaaccagcatcgtttttattgtcattatacaattttcatactttaccattttaaacaggactagatcccattagagtttacagataaagaaatgacatcaagacagttgagtttcccattgcctggtttcttgatttaacctctatctcagttctttgagtgtactttttgttattaacagacaaaataaaaagcagacttttttttttaaagatatgatggagccatgccccggctttgattcctgcacagagcttccgttcgtgtcagtgcgatttctctgcatggattgatggcagaatacggtctgtttctaagactgtttaaagcagggcacaaaagaaatcacactggctgagtccacagctggcaaaatgggagagactaagctggtgaaagaagctgttaatacagaccagaaaatttttaagctaaaaaaaggaacatgcccactgaaagtctgaaagcaaaagttttatttgggtaaagcgatgttcgactctgcatgattcctacttagaaaatgcacacgcttgccttctccaactgccagaacatcattttttaacacagaggaacgaaaatagagagaggaataatgggctttcagatagtccatgccgaaaagcaaacctagaaacataaacgttgcagtgcctggacccttcagattataaaacagggaactgttctcgtcacccctcagtcccagaggtgcctccgccatcttgcaccatttctgtgggaaccaatattattagcaacatagattccaacagagacatgacgttgtggaaagaggaggcgctcagtttccaagtcactttttggcactcctttctctaaccttctccgcataggatccctgcaaagacctttgccctaagcccccaggtggcaatattcctatggggcaaacattctctgaaaacaaggcttctccatcaaatgctttctacattgaatacaaaatgtttctctatcactggcagagtaggcattcagtgaccacattgatttttccttatttgtaatccagtgaaaaatatttttgcctttcatttttcaccccaacccccagaatatgattcaaaaatctcatggccatgcatgtctctgccagaggtttctatttctctgtatctcaatagctgcccacaagaatgtatttggcttggattgtaaaccccaagtgtgtgagcctagagtcttggtaatattcttagaatttatctagcaaagcactatgccttcaataaaagatcttgagtgatattttagctattatatttcagttttttgtatacttttgatttctctcatacattgtaaactcctagaaacagaaactattttttatatgtatgcaggtgtgtatttttataatctgtgtatcttatgtataatgtaatacgggtacacattacatattgaaatatgtaaatattccacaggatggatagcaaagtgctttacatatagtaaattctcatagatatgaaatatataatatattatatatttatatataatatattatatagattatatatttataatttattatatatataatgtatatttttatatattataatatataaatatatataatgtatatttttatatattataatatataaatatatatatagaaatgaatgaggataatggttgtgtaatacacaggaaaaacaattggaaccctaagtatgatgatcccaaattcttcaattaagaatcaggaagagagatctagtcttgatttcagccctctctgatcatttaatgaatcaaacctgtcttgtatgaccgacatagtgcttaagaaagtttggaatgagtgagctagaattaaaaacaaaacacatctagatttccaattgctcttgaaacatcagacagcctgaccgctgggccacatccccatgtgtctcagagtcatgtggagtgcaaaggcagttgactcttcagatggaacatacattttccagggagccatcatccccactctccatactccatccactctctcatcatccctactcacctccagcagtgaggaagagtgtcacttaccatttacaagatcaaggttgaagtattgtttttcctgtggtaaagaggagagtaaactatttgttattcctatgcttctatcaaaagtggacaagtgaaaagcaggtcaagacagctgcaatttcacaaagctggccttgctcgtttatgggatcttcctaagccctctaggcaaataaatctgcaaaccatgccttaagtaaatcataacagccctgagccttcattacagcctcttcccagctcacaattttcctttgaggaaaaatatggttatggccatgatgttgtcattacaacctacacaggatcagccattgcctttggcttacaggtcattctgtgcagcctgggacagcctgaggatgaaggcagagactggtggcacattttgggaggagattctttctgctcagggcccatttccccattattgtttgtagcacaggtgcggaaagatatttggaacatatcccaaccagaagcgtgcatcaggagatgtgatcgtcacgtgtggctccagagggttgctcgagacttgaagacaacgtgttctgtccacctcactgactataatagctcctcgggagccacaaagagcagttgtgtacatccttaagtttaaggacttcctccagagctagtgtttcacacagtagaacataatggctccctgggaacggttaccagaggtcagataaatctgcatgggggtcttactgccttttttgaaaaatggaaaaaaaaaaaaaaaggtgactcatttttaccccaggaggtactgttctgttaacaggcatttacatgataatagcggtgtcagcatgtgcaatgttatgaaaagagttttgctctaggtccagtaacattttcacggtttctgcaggagcctgcccctctgaggtttcggtccctgactgagctttccaatttgtctcgttcttccttctgcccatcctgccacacacgaagtatgccagggaaggaaatcttttctttttgtacaaacacttcctggattccccaggaccattagtaaattatgagttccaactggcttttagaaataggctgggtgaaagagcctgtccttgctagtaaagccttgagagagctttgcccttcatagttaaattaaattctgatgaatattctcaccttcacttctgaggtagttagtgcaagctgggctttgagatcaagagaaaaccaagttcaaatctgaactccactacttcctactgtatgatcttgagcaaatgacttaacatctctgagcttctattttctcatctgtaaaaatgggttataataataatagcttcatgggatggaagaagagagtttttgaggtttaaaggagaaaataatgacaattattatatagccatacctagtagattatgctaaatacttaataaatatatagtaatattattatttttcaacttacctctttagccattctttcatctttttctccctttctttttgctaaaaccacatgtaaataatgtattatctctcgaaccatagtttatccttaagagacatcaagaggccaggtgcagtggctcatgcctgtaaccctagcattttgggaggccaaggtgggaggatcacttgagcccaggagttcgagaccagcctgggcaacatggtgaaaccccgtctccaccaaaaaatgcaaaaattagccaatcatggtggcacaggcctgtagtcccagctactcagaaggctgaggcaggaggatcacttgatcccaagaggtcaaggctgcagtgagccatggttgtgccactgcactccagcctgggtgcaaaaccctgtctaaaaaaaaaaaagaaaaaaaaagaagcactaagaagtaagcaagcatgaccaactagagtacaaagcattgtattgcagcatagcaaactttctattagtcttcactttcacttctgtatgcacctttctgcttgcttggagagaaatatcagaaaaatgttaataagccccaaatttgagaagtaagaatagaaaaatgatagacagtgaggaatatcgcttagggctcctttccccaacaattattattcctgaatatttaaattctatttctatccacctattcaattgaagaatatattacagtagctatgtcgcccaccagtccactcagaacccagataaaatccaaagctgcctctacaaacacacattacacaaatgctacaggtggtacacgtttgccaaataaaacacttgtttgagaaaaaataaacatttactttgggcatgacaaattacacgtgtttacttcaaagttgtggcttctgctggtgaacctgaaagggaaataaattgttttggtcctggcagcttaggcagaaaggtgataacagggtcacgtcatcagtagcaattcctctactaggaaaatgttagggaaaaattacatttgtgatggctcctttacaatatgcatttgctatcaacatgattggcaatgattcagtaggtgtttgctgattccttctgtgttccggttgctgaagttaatgtgggtgtatatgacaagggtcaaattcatgcaataaagagtaagatctggaagagtttgaaggaaggagaaagaagtaggcaactgtcttggggacatgtttcacatgaaaggtgagtaggagtcagattcttggcacaaagttagaaacactgtggaaaagaaaaagctgcaaggtccccttgaaagataattggtgcagggaagggacatttaggcaaagcaatgctaatgggaacttaaagcacgttactaatgcaatatggtttcctggattgcatcctgggacagaaaaacctgatgaaacctacaggttagttactagtaatgtgctgatattaatttctttcttttcacagatgtactgtggttaggtaagaggttaacattggggagactgggtgaaggtttctagtgaactcactggattatttttataacttttctatactctaacattattccaaaataaaattttattttacaaacaaaatcaggaatgagtgatactaagtagagcaattcattaagcttacctgaaatttgggtagatgagtgaaaattacagctgagattgagggaaggattggtgtcagatgagagagtgacctgaatgccagactggagaatcctcacccttagggaggtgtttttgttttgtttttaagcaaagtagtaatctcactgaagtatggttgtagaaagattaatgtggtcaaaatgtgcaggaaacacaggtaagaaatagagattggtacaggtggacaaatgaggaagctcttttgcaggaaagtgttttggggaaagataatatttatgcttgcttttccccctaacatcctgagaattcagtaatggtgatatgtaaaatcagatctattctatcatcccagtgatttgaggcttctaaatgggttttggaaaagatgttaagggagaaatccacattaaattaagttagattttgcaagggaatgaccagagaagacccatctaaggacctctctatggtagaaatctagagtgaggattgcaaaggggagaaaaaagtcttgaaggcaatggagaatgcaaggtggagaagccacaagaagcaccaggaaggtacattgctcccaaaagtaaaagaaagaaagaatttccaaaaaaaaatgatgtgaacaatattgttaaatgcaggaaaatagtatacattaaggcaaacagtagccacacatatataatcagggaggtaactaatgactgtcaagagaactgtgtcactgaagtgaggaagacaagccagattttcaaaacgttgagaagacttcgaggcaatgtgcataagaaattacttctttagaaataaggagagaaataagatgtcaaatggtggagatacctctatgagtaagaatgcattttgttcttcttcttgttactttattactatttttaaagacagagtaggtggttttggtgaaagcaaagggaaaagaagtaggagactatggatgctagagaaagtaatggaaaggaaacagtgacctccagaaactagagagatagaaacaagggcacttacaaaggggttggttttgtctccactgacaccaccatcttgtctcctcctctggcaccatggtggcctcctatctaatctagtcatatctactcttgatcctcttgatatattcttcacagttcaattagaatcttatcatgtgttatcctgcctctgacccaaaacaccttttatgcaattgttctttggatcaagaccaaaatcctacaaggggctgcatgatctactctgcagctttaactcaatcttctctccatgctctctggttccagatgcactgacttgctctctgtttctgcaaatcgctgtgggtctttgcacatattgcttactcttccttgctcttccttctgtaccttcatgtactcaactcgcagcaatgaactcagttaatattaatacctgagtgatgcctttcatgatatccttaagtcaattctcccatttatacactcttagcatcttttttactttcaaagcatttatcacagttcatttggggtgcgtgtgtgtgtgtgtgtgtgtgcgtgtgcagaattgtttgattaatgtttgtctctcctgtagagttgggagtggctcatggctgcagggatgccatatcttcttcgtaggagattgccttaacattcttcgtaggctggtaatagcaactagaatatgaaagtcgcacatcctttgggagttgctgttaacatgggctgtccatgttcaagtgtttttgtagcctctctggaattctctctagctggctttcaaagtcctgatgcagcgtgagtcaggcatgtcctccttgaggatagattttttttttttcttattctttcctccctcatactgtcaatatggcattgtcaatatcggagtcatagctctatgctctacaggagccaaacatggatccactctccagtttgttacaatcccctcttgaataccatccagataagttattaatggtaatacggaagtggaatctctgcttgttagtaatcttagcctaacattgacagtcatttgaccattttgctgaggtgaggacttagcaattgttgacatgcagaaatatgcactcaatgttgtcagatctgctgatttttgagccagatccatcccaaggcccttcagtctgacacctcagtgtgtgggaggtttcacatggtccttggagtcctgacctcctttttcttttggcatcccacttaaagcttccttgcattaactaggacccattctaaatggcatcccctttaatgagcggaaatatttgtcccctttaactgaacagctcttagaagcaattagcatttagggaacttcttgtttagaaataatgtcttcatcaaactacccattatggactaatttgaaactggaagatagatgctcattttcctatggtagcacctgcaagcgtttgtggcagtggggctaatagcagcactattgtaagtcattgtatttctttcgcaatgtgtgtggtgggtaaatagaaaccccttcaacatgtaagcatttctgaggacaaaaaaatatgttcctttcaaattgtactatttacctgtcattacagatctgaaggttgagaatgattctcatgttataattaattctctcattgcctttgagatcactgccttttggccactgtctaggaaatgaagagggatgctatgtgtgagaaatgagtactctgtcagaaaaggaaaggaaagaaaacttgttgctgactgacagctgcaggaaaaaaaaatcttttgaagtagtttaaggggaaaacatggatctaacacaatgtgtttatgactccaacagagttgcatgtgcttgaattaattcatcctgaccaatgggtggttctggcaccattttggtaatatggataataacaagaaattttagtaagtgattattaaattccagaaactatgcaaagtgcatttcataatctttttcaatgactcatcctgatagtcctctttaccgatgaaagaatgatgcttaagtttccatttattcaagtttactcagctagaaagtggaagagctgggattcacgtccaggcgcaagctaactgcaggccagagtcttgacacccctaccacacagatgtcagctttaccagcactgaaagtgaaggcctcctgctcccctgccccatcaccatcagctttctataatttaaagattctaagtgggtcactgctttggaaaagcccttgttaaacaacaaagaagctactgccagccccctattcaccactccaatcagcccacagcagagagcaagttcctggtgaattaggacaagaggaagaagacgagaacctccaactatgtagaggtaggcacagtatcaggcatttcacactgctctttagggaagaaggctggtggggccagggtagactgaagaggggctgtgcagttcgaggaaagccccttctgtgggtggcattgactgacgtagggctgaagcactcaaaggagtaagacagagcgggcgtagtattccaacagatcgcagactccgcacttttgcctagggccggccctgcttcaaagtgaaacttccacaggaaaactaaataaaggaaagaaaagccaaacagaacaaattcccatttagtcagcttttactgtcctcagaggctctgtgtttatgctagatcttaattatgctgcttgtcaaagacacactaaactccactgtggttgagggagctattttatctttttatctttacagtcagaaaaggacttagtatgctgaaccctacccttgatgagcttcaaacctggaataaaagaacagttctctctcttctgcccaattgtccccacctctgcactgccgtccatgaacacctaatcaggaggctttgatggggttaggaatagtcagcgcccaggtggcctgggacaaaactgtaacatccaaggggactgcatgggcttcccatgttcaagcccctatagtggccctcctgctccaggacccatgcatctggtctccaaccctccctctgcagggcttatgacccgatattctggagaggcactcagctgtatctcccagcagggtaaatggcagagccttcctctgggtatgtaaatgcaggggagggggtgtacttgagattttaaatgaacaataatgtgcattaaacaacttcaaatcgcatggtgaagaagttattccatttccaactctctttagtccttcagatgaaatcagggagaacatctctggttgagtgtttttgtaatcttgctttcttttcactgtatttattttggcctttgctttctatttatggcagatacttttacttttctggtgatgacataaatgtcttttaaaataagtgcatctacttaggggaaaatcaaatttgcttaaagaaaaactattacataaataataaaggtacatgataaaatgaaaactgtaagaaatacaaggactaacttttagaaaaagctctaattaagatgctttgtgttaaggttcactctgactaaacctgtgaactgatagatgttcatgcagctctccttgcagacatgcctgtgtttagagggtcttgaaactgtggcagatccttaagagtggtaagttaggtctaaaaaccatttcaggtccctaaaggcaagatcaaaagaaggatacttggtgttgggcatgtctatccccagtctaaatacattatctatgatgatcacagtttgatcatcagttatcagactcatgggagatgttggctttgtaccaaaattcagatacctggggcccatccccagaagttctgtttcagtaggcctggggtaggccctaggcatgtgtgttttgctaactatcccgtgtcatagctcagcatccccaactgacaatcactgatgggctttggtcagtgttaccacccagtgttgtatgtagatccacatgaggaaaggtatatgattacaccttgaaaatatgaggataacaaatctggctggacaatccactggaggtcctttttatctgcacaatgtgcatgcatttgtttctatgcacaaagtaatccctgaaaaactggctcttacagaatgccacagatgtcatctaggaattttcctggttcctgttagaggcaagtcttgagttgggttttatttaacagatgagaggaacatcttggatccctctagtagtagctccatagtccttctctttgacaagcttcatgatgtcgtttacttcaggtctctgagaaaacgaatggaagtctgtcgtggaacacccaagaccagatgtgataggattcatttctaatcacgcattatccaggtgacttgctcaagcctagcttacacagagttccctttcagcatagacgtttcctaactagcattaccctgccataccaaaagccttgtgaaaatattttcagcagttaacaagcagagcctgcagttataatatgctcattaggccgcatgttagttttcaagtcttgcagcatgcataatctgatgcttgatttccactgaatttcagttctgttgggcatcagcagacaagtgctggcagccccgtgggctttgccaagggctgctgtctttatgtgtgttttccacaaggccatgctgactgtaaaataacacacctaccctatttgaatctccagtttctctttgtctggatgtcccttcaattatcccagaacctttcttgattccctggcagagaaaccccttcaggaaccacactaattttagaagacaatgcaaaagatatagccagtagtcccagtagatgaataggctgatttctggaatttattagatcttcctttgttctagacttcacttctatgtttcaaaaccactgccttaaaaaaaagaacaacgctctcattccaaattatcagttttcgaataaaggtctttgaccataggagtacagtactttttccctatactttgaatgtatttgaaaagaaaaaaaaaaaaaaatatatatatatatatatatatatatatatatatatatatatatgtatatattccccagggtcaaagtgttccaatgctgtgcgagctgagaatattttggcaatttcatattagtaaacaaatgtttctggctgctgaaggtataatttatttttattacattttgaaaatttcttggtggctggttatgaggggcagcgtttatttattccttggtcaataagttggtgccagcatatgcctggcagagtgttaggccttgaaagtacagagatatatcatacctgttccatatcctaatggaactaacagtcagtggagaatgccaaccctctaaacagataaatacaatggacaagatgagtggtattattggagctatgaacagaaggctacaggatggagagaatggagctagtacaaagaattcacagataaacaaagtcccatgttggagaagacgcaagaagagttggaattgaattgaattcaatttggggacaggaaaccagagatccaaggaagcaagagtgaaggaaggcaggttagaaccaaacattggcaggggcaggggatatgcctcctgagagatggccaggaatgcagaatgcaggctcatatttgatttgtatgtatggactggtagagatatgacacttgggtacatcagcctggcttagagaactgggtggggccaataggcagagaatgggtaattcagttgtaagaccagagagatcacaggaagcgtcttagtccatttgtgttgctgtaacaaaacatgcacacacacagacacacacacacacacacacacacagggtaatttataagaacagaaatttattttctgagacttctggagactgaaagtccaagattagcgtgctggcaggtttagtatctgatgaaggctcattccccgtagatggcaccatatcaggtgtcctcacgtggtggaagacctgaagtgcaaaaggaacaaacagctctcttatatctcttttatgaagtcattaatccattcatgagggcagagccttcatggcctaatcacctcttaaaggccccacctctcaatactgtagcattgggaaataagtttcaacatgaattggggtggagacacaaacattcaaaatatagcagtaagtgagggacgcttcattgtttaaaacctttgaaccctcaatgtggagtgtggataaaaactaatcatattttcttcccacttaacacatttcttctatgtgttaagtgggaccctcccatgactcagccgtaatagtacatttccctattaccagttactagaagtgttaaatgagctgatgatgtacaataaccctgctaagagcctagaatgtgaaagaatttattttggtcacatttctaaataatgtggaatcattctaattccttaaaatgtgtgatcctcttagatgggaatgaatcgagcttgaaacctgaaaggaacatcttcctcctttaggcatgtcagaatattttgttgaggggtacccaaggtgttcctcacagcttgaggaaattaaaccagttacacactgggcagtgtacatatttctttgcagcttctactagtaggcttctttattgcatcttctgatggtttaaatgaattcttcctgattcttgtcatggtgataaagcactcatgttggcttgagtaagtgtaggtgcattgtagtgcaactaatgatgtctgaacaaggttcacacctgtcaaccttcattctttcactatgagactagcaggtatttcctaagatgccaaatcttaacttgtgtgagtcctagaaatgatggcatgttgaccctgtatattcaaagaaaatcaaatgagtatttgcaaagacggttgctgacttcaggtagataccagcagagacttgagtgcagaaaaacctaaatgcttgatgtaggaggcattaggaagagcctcaggcacacagagaaatgtagcaaatcaataattggccaatcacttctctgagtttatcaaattctttacctcttacacagtgaacaccaaatctgcctgcctgggccagatttctcttatatggccatttacacgggaggaaacagaggggtaaagaatgcccccactgcattcctaaaattccaccagtcaaggtttctccaagggagactgacattctaagcctatcagctctgtctatctctgctcctttgaacagatagaaatttgagagtaggttttggtaagtgggagatttcagagagggttagggcaccctggagaactgagccagggagaagagaggtcttcaatggagacaaaaatgaaccagtgacagctttcctagtctccatttttctttatttccgggagtgggtctgctttctgtgttgatgttggacagggagtcgggaagcaccaaacctgtagggctcctgtggagctccgtattttccattaccaggacacagatctgatacttcagggtttgtgggagtaatattactatgcagaacagaggcataaatactttgattcagaggatagacctcatgctcctttccctcctttctttcctccttccttcctctctttctttgtttattaacttttttatatatatagttgccagatctctttatggtggtctatttgcataccaaaatttcacttatggtaagtgtacagtttagtgatttttaatgcatgtatatagttgtgcaataatcccctaaattatgtttcaaagtgcttgccctagctcctgcccaatttatttctaattaacatacaaaaccccatttaaaattggctgatattggttgagcatcctgaatctgaaattttcaatttcaaaatacttcaaaatcctaaactttttgagcgccagcatgatgttcaaagaaaatgctccttgaagcattttggattttgggttttagaattggggatgtttaatgggtgtaatgcaaatactccaaattttaaaaatatgaaattcgaagcatttctagtcccaagcattttggataagagatacctaatccatagataacattcttctgcttgaacaccaagaaagcatgttttacagtctcttaggctaataatgtatttaaatttattttttctagtttctatgataataaaattgctatggcatgaaaagaaacagagaaatggaaaaaaagataaccctttcttgccgtaagccctgtttgcaagagctgatcctctttcccatactttgacattctatgctgagatctgagggcgtagagcatgttgtgggtggtagagaaggaggaatctgcttcttgggttacatatgtcctaaactagttattaagcctttagttgccagcaaattggaacaataatagtaataatctctgctctttgttgactatatattctgttttatttcctttacgtgcattatctcatttaagcctcaccatgggctatctccctttatatagattagaaaactgaggctcagatagatcgaataaagttttcaaagtcactccacagtagatgtcaaggccagggatcaaaccaagacctgtctcacagctcagcctctactttcaagagcacactttataacatctctaaacaaatgaatcacggcatggcgatcaagggacagcttaattgtcagaggtctgctcctattactaggaagaaaagttgaaaatacatggccctaggagaaaaaaaagtaagctaacatcatatttaacagctaccccaaaatggcaggaataaaaagcaatttaaggcaagaatgcttatggctttggaagttttgagacattttttaaccacaccagtatttgaggctgaatgagaggatgagacagtgcatggacacgctacagcttgtttcacctttggtgactctgcacctgggaatgaagttcaccaggcatctgtggtagaggctggggagacatcctgacttggctgcttgaataaacttggaataggtcatgattatgtagcaattgggagggcgtaagaggggcattgtctgaagtggtctctccctcagctaactccttggtgtagcactcgtgtcactgaacagataaacactgccttccattcaattgtttcatgtctatctgttttattagctgtccctatggttctcaaagttggtgaagtacaacaatcatgggggatacttattaaaagaataggtattggctctcctgagaaattttttatacaatcgtcctgagaaaaggttcagacgcctgtgtttttatgaagctttcctgtgattcttggaatgaaccaaatgtgggatttgttgctctttaaaactataagtccatgagggcactttgtttcctagcagctcacagagtgcttcacagggagagaaattcagtagatacttgttgactgaaggagggaataaatggctattgtagcttccctgaggtcaaccatgatgaaacttacctcccacagtggcagtaaatagtgatcaataactgtttactgatttattagttttaaacctatgttttattttttcttttcgcttagctctgagcaaatggctatgaattcccttgaagttttgtgttctaaaagacctgatgcctatttaatgaggtgaggtggtgggcatagcatccaggaactggttttgagtagtttcaggagtttatttatccaaagtctgagaagaaaaccagttcccatattttgcaagttcattttgctctagtacagtgaataattgtcctggggggactagatggcataggagaatattaatcttagattttcatttcctataaaataatttcccacttattacattcagtgagaatactttgggtttcaggaaatacgcatattttatcacagacagtccaaagtgtgctcccaaatgtatctgaaactcaggagttaagagggacaggtgcagaaatttaggtaagccaccggatgccacggtaggctgtgagaggactgaaggtagaggcaggacagagtcacctagtgtctccacaccttgcacagtgttgtcaaattttaggcttgagctttaaaagaaatttgtaaaaggaaaatattaaaaattaaatgacaacaataataattaatgacaagcatttttcaatctcctcactatgtataaggcaatatactaagccctttcacatatcatgtcatataactgattttttggagagcccaatgaggtagtatagtgtattatagatgagagcatctcaactaaggtcacatttaagaaaaaaaaagatttttactcttggaacagcagagaagtccagaatagcttcagacatgttagatttcagggactcaagtaatatcacagtacccttctctcccgtgttaccttctcttccctattgcctttcactacgtggtaatgaagatggcccccagcaactccaatttaatgttctctgaagatcaagtccaatggaaaagaagattcttttcctacagagtcagggaaatccacaatatcatgcttacttgtgacatcaactgcgaagttttggggtccctaagatcactctcattttttataattcaccaaaatggctcgcagatctcactgaaagcttacacttgcagttatggtttcttagggtgaaagaatacatattaaaatgagtcaatagaagatactcatggaacagagttcaggaaagttcccaaaacaaagttcccagttgtcctctcccagtgtaatcatggacagggctaacttttctgagtaacagtgtgtgacagtacacacagagcactgccaaccgtggtatctttcctgagtcttcaagtccagaattttaactgggggctcagtcacaaagacataattgactacccttgtggctgaccattagtctctagtccctctagaggtcaagctaatactgcatggtccaaagcccccatcataaatcatattattcgactgcacagtttggcccaaagcccctaggttaaaaaaaaaaaaaaaaaaaaaaaaaaaaaaaagaagaagaagaagtttttgtcagtcgggatattccaagggttttgctgtcacctcccagtagctgagggcaaaagacttttttggggggtaaggttaattctttactacacacttccccagtgttctaataaaagcctggcctccattgtgttcatggacccatccctaaagcaattgctctgacacagagatgaacatgctaataggctaagcctaaggatggggccattcaccttgcccactacatagcacgagatcaagtaggggtgattctccaagaaaactggacattgaccaagatatttcaggagtaaataaaatgagaagacactagtctatgttaactcatgggaaggctatgtagcaaaactaaaatactaaattccctttattttgatttgatgtgctatcattagcaagtccacaggaaaatgaactaaaagtgacttaataaatgcattttttttaaaaaaaaaaaaaaagagacagaacctcttaaaatatgacatgtgtgacttagggaagaggcagaataatagcaagttgatgaagaggctctatatgtgatcacttatgcaaatttcccaccaagaatgaatttgtctttttccgcagggcaacatgaaaactccctagagcagtggtttctaaatttgtagtgcattagaaatacctggggaacttttaaaatcctgatgcccaggtcacacccgtaccagtgaaatcagaatgtgtaggaatgggatccaggcaactgtgttttttaaagattcccagaagatttggaaactactgtagtagatactgaaacaacagcaaacactactaatctgaatgctaatttccaatatgaccaaccttacctaattaaatggacaccattcaatcactggcagaagaactcctcttgagtctcagcaggatgtagtatagaatctgagttggagaaatatgtgttcaaaccacggcttttaccatttactttttcattacacttacgttactagttgggcctcgaggaagcaacttaatcactttaaggttcagtttcctcatctgtgaaacaactgataatttatatgacatggaacttcttttttgtttgtctgtttgtttgtttgaggtagagtctcactctgtcacccaggctggagtgcagtggcacagtcttggcccactgaactctctgcctcctggattcaagcgattttcctgcctcagcctttcaagtagctgggattacaggcatgcaccaccacctccggctaatttttatatttttagtagagacggggttttgccatgttggccaggctggtctcaaactcctgacctcaggtgatcagcctacctcagtctcccaaaatgctagaattacaggcgtaagccaccttgccatgcctggaacttctgaaagaaaatacacagaaagtacctggcatagcaaatgtcaacttcattacttatactattacctttattgtaagagagatagaaaccccttgtctttttttcctgtctttcagcctttgttattttgggttgttttgttttgtttttaatatatccatgtaggattttaaaaagtgtatctttgtcaataatgcaaaacttataacttgtctttgtcattaaatacatttgttcccttaaatattgagaacttcaggaggaggtgtcctattcattcagtcatttatccacacaatatttgtaaagtgtctatgacaatatttcgtcaatactaaaatgcactcatttgcaagatgtatcattgttttatgtatgaataagagagggaaaaactcagccaattaaactgtgccgcaccctcagttacaaaagggattcttatttcagaagtcttaagttgaacaaagaaatgtataagataacatcagtgaaatgcagtcagtgtggaattaatcctccaggatgctaggcataagacacaaagttacacaagacgctgtctcagtgatgggggacagaaaagaaccaagatccacagttggcttcaaccctcttgctcccgagaagagagtcaactccagtttcatccagagaaaattctttttcatgccccttttacatcattaaatgtcatacactgatcactgtttcacctttgagaaatacagtgacctgtttaaatggtcccatttttgaatcacttttcttcaaacagggccagttttaaatggctgtatgtcatcccacccatggatgagagtgaaaatggctctcattatttcagcagatcacataagccatgctgcaggagagcaggaggtgagaaggtagagggaattcaatttgatgatcacatgatctttcttcccctgaacctccccattcaactgaagattttgtgttgtgatcccaaatgggtcaaaatacaagcttggaaaagttttctgaatagtctttctctattctatatatacttaatacagatatgccccatttctctttccttacattgaagcctgcttggccagaaatgtgcttgtgttggctaattttttttaagtagttggcaaaatatgtccttgagtggaggcaaagtgttaggggaagattttggggacaggtgtaccatcaatgattctgaatcagcccattgaaatgcgatctttatatgtagtttggggaattaaattttggtgatagaaaaacagaattccaaaaagagaaagagaaactaaaaataataggctcttcaaatccaaatgagaattctactaacagcatcttggtgcgccatgccaggtccttgctccagtcaatagagattttcttttgaaggtaagcaatttagagaatgaatttgctctgccgtctggttggaggatgggtgccaaggttagatctttaaggaaataatcttattagtccctcttattaaggaagcctctgcagtgagtagactttgaacctgcctgataaaaagtaggtcttgtcaaacagctcacagctcctagtgaaaaggttgaactttgttggtttagatcatccaatccaaatgcaaacatgtttctaagcttctgtttgcatactctgggagaaaaagaagacttcctttttttccttgactctgacactaatagtattctgaggcgatggcagctcccatggaaattactaaatcacggtgttagtggcgcatacagaaaggcagaagtttccagtgtaacttgaaatgtaaagcttccaattgtcactgtttgggtccttttatttctttaaatcttcattttttccccttaacggaacttggtctccccatttcgccaccattacatgtccatactaaccccatctggaagctgtaaggctgaaattttgacagctttgtcattttcatagctgtgaaggttgatgttgagcttacaggattattgctctccaggaatacttcactacataatcaagcggaaggtcaagagaggtggagagagaggaaaaaaaaaaagaaaactctaattaaatcaggaagggctgacttgtgccctaagaaatgtgtgcaacttcagggagagccatgcttgtatccaagtgcaacaattggccccagtcagaggccacacttgtcacaatggacaacaaagaaattgccattaaagcaagcagctccttgaagaactggcttcactctttgctttcaccctgctattaaggcccttctcaaatcagattaaggaaaggcactgtaacacatagtttcattagagtaatggaaagaggagagcaagctcttttcttacgtcttctcctttggttcctgagatttgtggcttctggatatcaccctggtacataatgcaaccagacaatagtggccacacagaatgaaagacacgtctgagacttatgctactgagaacagaattgagaagaatcttactccaaatttttgcatgatatatcgctgcaaggaggaagtagacactgtgtagaatccccagagtgtagaattctcaggtaggatttgcacaaactgtgcattttagttcagcaaatcctacctgaaacctactgatacagtttggatatgtgtcccctctaaatctcatgttaaattgcaatcttcattgttggaggtggggtcagatgggaggtgtttggtttatggggatggatccctcatggcttggtgctgtccttgcaatagtgagttctcatgagatctggttgtttaagtgtgtggcatgcacactccctccactctctctcttgctcctgaccccaccatgtgaggtgcaagcttctgcttcaccttctgccataagtaaaagctccctgaggcctccccagaagccaagcagaggcaggtgccacgcttcttgtacagcctgcagaacgatctgccacttaaacctctttttttaataaattacccagtctcaggaatttctttatggaaatgcaagaatgacctaatacacctactgtgtgccaaatatttgtcaagatgttaatggttcaaataagtcatggatagagttctgtgtttaacccatttatgctggaggttgcagtttttttgtgtgaaaaatcagacctcagcgatgaccttgagcagcaggatatgaatagctcccaccagcttggcgttccagtaatggaatactaggcatatatgggttaataggggtttaagagagatgagcaaatactacatatataaggtaggataatcacaactgtaaaaattattgagcagctactatgtgcagctcactggtttaagtgctttgcagagaacaaattatttaatataaaggtcagactattatgcctagagcacatacacaaggacgtcatttcagctggggaaggtagaggacatggaaagttccctgcaaaagggatttaaatgcatcttgaaggatggataagaattatacccaatgtttaaaaaataagggagtggaagataaaacctttctaaatttagtaaacttcataaataaagacttaaagtgctacataagatgagatcatccaataaaatgtagtattcctgcagcacaaagtaaaaggcaggtgatagagaaggggctgaagatgatggaatgtaatgaaggctttgtctggagccgagggagaatttttaagtagggctgaggttcagatttccattttggaaagatcatcctagggcattgcttctgtccctgctgaagtgataattgtgcaagtttgcctcgtagacctggcttgaagacaatccactctctgagtgcaggcactgcccttggagggggcatctgtgtagaaccctcaggatcaggcatcccagcattttatttgttgacttaaatgggaagaatgaagctttttatttctttaatttattggtgaatgctgctcgtggacatttaatgcttctgtatcaaatcaaatgtaccaggatttcttagagttgcattctttaagcgccagcctgagtgtgtatcctgctgatatccttttatgtctatggaaaagaccctccctggacagttggctgcagcagacagtaactccttcttctccaggcttgcgcctgaggatatttgtgtcttatactcacaagccaaggagaaccatctttctgagcaatgcctatctttgatggccaggtgatatgaccaagggacaaagcaaatgagaaaggcagtgagagtggagagggacagaagagaagcaataatatgttgtgaaccacagtcagggacccgatgccacacagactggtgaccgcatccctggtattcattccactgagacttagcactgcaaaaaaggcaggctacagggcataagaaatatgaaataatttatcaggccagaaagttatactcatttcctttctaactattttgctgcaggttaaacattccttcgtgcttctgtagggcagctgctggaaatacaaaggtttgtatccagcactggaaagtacccgactttcctggccacctttgctgggggtggaagctctgtttcttcatgagcagtggctgggcctctgcattctgagggagatgtgtgcatcccagttagtagagatgggatgaggttgtaagattgtatgagtctccaaaatgtttccagcagtgaaataaagaagtgaagccaatccagatgaatgatttgggaggctttcagaggaaggggaaatattacgtgtctgcccagggttctggaaaagggtccttttgctgaagagcttacaagttctgcacacacacacacacacacacacacacacacagtggaactaaggtcagcactggaaaccactgagctatggcagaaagagtgttgcagtgttggaggagcagggagatgcatgtctgttgaaaacttggggtttgcttctgggcttgcaactgtggcagcattttttttcctctctctattccgcataccatgccatgatacaaagcaaacattgcattgacagtatgttgacaaattgaagccttcaaccactggcccagtcagcagcctgagcaatcacagttccaacctccccctccctctcactgcatcccctactccccagatttcttgggaacaggctatgcccccagttgatcatttcagttgtgtagccttcgtaagtcctaaccacaaatcagctttctaaattgagaaggtgatgaatttttaaatccttgaacctgtgctataatcatctttccaccatcctacatattacaatgcaggaaggcaacagatgtgttttcttatggctctggtaacatgaaatattgatagggacgggagcatgggcatcgtgttgaggttcatctacaatgaaggtagcagttctcatcccagcttctcatcgtccacctttcttttctgacacttaggacgtgaagaaagccccatacctgtgatgctcaaggctagttcaatgaaagctcttaaaaagccgtgcaatgaaatctgtctaaaaaggtctttgtcagtctccaggggccaattgctaatgcagctaatacacgtttgatctatacagatgatttttcctttgtcctcaagggaatctctacaaacactttgggtttacatggtgccaagcccaagtcgtctgtcggaaaataaatagcattttaacacattcaagcatcagtccccaggatgaaaagtagcacgtaggctcttctctgagttttctagctgggctataggacataatgaaaacctcatttttagaacatttcttttcctggtgacgtttcactcagaggcactgcattctgaagggggaaaggcacaaagtagacactccgattcaaaaaaaaaaaaaaaagaaaaagaaaagaaaaagaaagaaaagcaataagcaaaaaaggataaaattttatctaggacagtatttccaaatgcatatatgggtgccatgtaccaatctgtgtggtgtaagtatgcaagatatccttaagaggcacatggttgaagtattttatttaaaaaaaaaagttttaatatttatttattgtaatatattttaggaaatatatattacatacatatatatagatatctatataaatgtagttatgtacagctagcacatccaagctgtgattttatggatattattaactaagatgaaacgaaagtcagaaacaataagtcaagttgcagaaaaaaagtaaaggaaagaattgaagactagatgaaactgcagctccagcagctccaatcaggaagggttggctagaacaaatacccagaatgtgtgaggaaacggctaatgtgggaaatgccgatggagagaaattcctcatgtgttaatagaggaggcagagccagctctgccttggtcagtggggatgagtgtgaatctacttttcctggaatgtctgtctccctacagagacgtcaaccacagcagaattcctgtggctctgacacacagttctctgttgtgtgaagttttgttttctttgtggttttaagcagaaaatcacacatgttcatgctgcctcaatctgacatgtcgtattaacccttttcatgtgactttcataaggcaggatattgcaggccattcaggagatgtgcctttcagagaaggattcacctcaaaagagtggacgctgcactggacttaagtgaaaggggagagtttgtaacgatcccataatatatctgagcccatgggagaaagatgatagcagctcctagctaccaagtcttcagtatcttccaggcatgacatattaaatctaacccccagatgagctaagtgaaccaagcaccattattctcatcattgtatcgttgtatttatggggaggctaaaatgggagacttacacagctaggaagagattcaaatacaattgtgtctgaccaagaggttggatttcttcacaagttacaataagaggccatgctttggctgtgaacacttctggggaatggcttctcctatagttttggttctatccacaacagaacctatgtaaatcctacaaagccttccttagaataatgcccacagtgactgtcctccctagcaataggacatcacagaacaagaaaacattgactgtgatcttttttcttggaaaagggtgggagagtcagggggatggttcatgtgggagaatgagagggaaaataaaataatggatccatatagatgagagggatgctaatgtatacactgggattctcttcccaggtccatagtgagcccctacatgacactgagaagatctcttctttcccctgacctttttttgttccctccatagtatgaggggtttgacctaaaggatcacttaagtcccattatgatcctttgtgtgtgtgtgtgtgtgtgtgtgtgtgtgtgtgtgtgtttctcctctgatgtagaataactcagaaagagagagttgccctggagagtggttgctaaaacaacagggaaacaatagagaaaccttaccttcactggtgactcagtcaagaaaaaacaatagagccacattatcaatcatgaaggatcccaagaagtatgcagaagacacctgtttccggaacagaagggaggggaaggtgtggggaacatggagccacattctactcccttcctgtattccctttgatctctctacctgcttctttcttggccaaccacaacttagaatcaaccaagtttttgaattagcttgtatagacaagaaacatgctatgagccctccttctaaagaccttacctttaacttcaggaaacaagatgactgctttctcttgcttcatttacaaaagttattcagatgaggattatacagtttctgaatcttctctgccactttaattttctaagccaccaatttaaagatagccttaaacaactgttctgcccctgtggaaacaggaagtggatgcctcaggcagttcctcgggttgctgtgttggaaggagtgatagtttctcaattctgccgccagtgagacacaacttcacctcagcagtgtgtatttagagacattcatcattagaaattgagtgagaacttccatatggaaaaaaaaatcctagaatttaaagaccaccacaagtgcctacgtattatttagagacaaagaaagacctgtgttttataacaagcattcttaaccccacacattgtaaaagtacaaatggcccagcaaagtcagaatgacccgggtgaagtacaccttgtaaggcaagaaatgttcaacttattgctggctctaccattagtatgtaccatggaagtacatactaaataagggaaaaataagagaaatgctaacttaatgaagcacaatcatgactcgtattagaaagtgattagctgagatctgtgcagtgaataaaacagggccttgttacaacttgatttggttgatgtgtttcagaaggactcgtaattcatgttccaactggagaaatagcttcagcgaatgatgcaacatatcatatttttgttcaggtgttttgacaggaagcaaacgatagagttgtttggaactctaattgagaaaaggatcttaatgatgttcactcagtccagcatcaggatatagtgtgctgatatttcttagaggagaaaatgttgtagaatctgcttcttctgaagacttataattttgataagcctttgtttatgtaagcaagaagtgtgattagtacttcaaataactgcatgttcaagatatcttttatttgtttatacagaaaagggtgcaattatctatttaactatatcattagagaaaaatatatggaaaaaacttctgtattcttcaaagatattaataacttatatgtgtgatgccatcttatgaaaagacagcctttataaaatatgaagagtttgaagtattgcttttcttactcaaaagatttagaagtggccatcaaaaccattagatagttagatggcttaacaaactgtgaaaagtagaaccttttctctacaaagtaggaccttaaaatcaaaatttaaagcaatcactatctgaaaaaaaaatatgttcagtaaaaagttaaatatgggtcatgtaagctcagtattaacgtagagaggctggattgaactgaaaccaatttgtcggatagtgagatgaaacgctggctatgagttccactggttttaccttcagccttgtgggggaatggtggggacatttgataggaagtcagtcttgtgtgttccagcccagctctgctgggggcatgaatttgagcaaagtcccttcatttgtcctgtcacctttgccctccttcaggaaatgccagttttgcattagattggaagttctcagcctctcttccctgtaacttgggagacgggatgtatagataagaaggatgaagattctagagggtgcggctcatggtcactttcttccccccatctcctaaacagcagccctgttttgggtatcaaaaatctgaaatagtgttactttacagttaaatcaacagaaaggtgttcagttgatgttgaaaactatggaatctcctttttaaaaaggtaactttcatgatcctcctcttaatgttctcagtttttatactcttgtttagtttttattgacatctctgtcatggggcagctcatctagacaagtttattgaaggcaaatgacagtgatgactacggtgctttgcacacagattgtcaataacaatctggttgtttggggagcacttagagatgtggttcatgcatgtgtgaacctcgtcagtgtaagttttgtgccatttaactgataacattttgaaaatttataatagctgagggttgttataagctcataagatgctaagcacagagctaactaagtactttacatttcttactgaatcctcgaaaataatatgatctcattacccatagtttccagatgaggaaactgagtctcaaggaggatgaacaactttcccaaggccacggggtcagcatatgactggcagacccttaggccttcccacatcacagcactcagggcagtgagggtgtcccaagggatctttgctgagacttttagcctgaggtcagcttctgagttgattatgacttagttattggaaaaagatataattttcttcaataatctgcatcccaaggaacagtctctgttctcatcgctccagttagttgcttttaaaccctattcaaaaaattacaacgcgggttgaattccttagtggggaggatgagaggaaccgcttcaagctgagagcacagttgtttccagatgtggccagggcctccttaaaggttagtgggctggataacccagcattctgggcctagggaaccaacacactcacgtgacatcatcccacagggcaatctgtatcctttactttttgccattcatccagtttttgggtagctgggttgtatcattgtgtggtgtgtgactgtgtgtgtgtgtgtgtgtgtgtgtgcgtgcgcgttctctaatgctactcttcattcatttattgctgagggaagtcctgcttcttcctgcactgaagcccaattcccattgcttttctaatgtgtgcactggagagtgggacttcccctgtccgggctcttttctactgacctgcactgtgttctctatccattgcttccatctcagacagcgcttttcctcccaagatatctaagttgggttggacaaagtcattggaagtgacagtcacttaaaaaagaaaaagaaaggaaactggcaaaacacagggatgcatgttcaggagaagctgttgagagaagcaggtggctcttgcctccttgtgttcttggatgagacaattgactttccccaagctgacttcttgcttagatgaactgacttaactgtgaggtcctgccaaaggttgtttcactaagcggtgcctggggctttcacaaagtgaagtcacctctgcctgccaagcagggactctctagctagacactgggggaatttcatagccttctgattactcctccaaaagaggaagttcctgtcatcatcttacctttaccgtgccagggtgcagttcattctgcctgtggctaacatgcccagctcataatgtgctgttgagctatagagaagggaaatggcggactgcaacttggagaactgttcattttgctgaagaggagacttgaggacagaatcattgctctacttggctaaatctgtggtcttcctgtctagggctgtggcttcaatggggcaccaaggagcatttgtggagtgagcgtgattgctctccatccagctaggaaggttagtcatgtcaccaaatattccttacttcccttaacagcccattctaaatcaatcttccatgaattcatcaaaatgttttttgtattgcctcaactttgctgcttccatgtcaatttcctaaacccagggaggtcacgtgaagggcatttcccaaactgttatctgaaccttcctccctggagtgtcttctgctcactccagggaaagagtccttttccctgggctcatttgctgtggtggccatattttaattccctcttggcttctaatagatgagttgggacacgcctcaaagtgtttttgttccctctgaaagaggttgaatcagggaagagagggggagaaatatatgtgggaacagtttaattgtatccatgaggattcttagtaatcaggatgccagtgtgtgttttccagagcctagagctgacataaataatgtagcgtacctcgctttgtgcaggcttgctgaggaatgctgatggagaaaaagccaaactgggatctgaagctcccggctcccggcacagcctttgaaatccttttattgagtggtacttttgaaactgcagccaggaccttggcaggttggatgtgccagggagaagccaacagaggaggaactccagaggaaggtgcctcacttggcttttggagaatgagaatctggtgtggcctggatggctccggctaagattggttaatttcattttgcgttcctaatcccacaaggaataggatatctccgtcaaggccctgagagccgggtaagtgtatgcagctgttgctaacaagatatgactggcccctcaaacatagtgaaaagcatcttgctagccttttagagcctcttgccttaatgggaagagccaaatgagctttgcgggacaactaaccccaaatgaagtcctgcagcttaagctcatttaaaggcaaagtgtgcattgggagagggagagggaccacaaacgccacagttcttttgcaggaaggaaacaatgtgtcttcacgtgggattttcacaggaggtctgccaagccaaatatccaactgaaacatcttccagattttgatttacagtgcaacttaagcctagtcttggccataaatgatagaagtgaaggaaaaggtggggagtggggtaaggaataattctctattgtagaggatcttcagggacaggctctgggcatttagtgaaagggacagcgattcctttgcctatactctggtggtttagaaaaggacctcagggaacatttgttttgttttgttttgttttccttttgattaaggcatttggggtctagaaaagaagattcaagcaggatccatttaatttatttagtttgcctcacagacatgaagcttcagaatggtaagtgtcaattacattcctaccgatttgggtaaactagctgggagagggttctcgcagagcaaggatctgttcaaatctgggctgttttacagtttttggccagtgataggagctgctgtgtaaacacagaaaaagcatagatgacaagtttgattgggaaggaaggctttgtgtgacttgtccttttgggggatggttctctgttgttgttggtttgacaattatgggatgtcctttagaaaccatctatatagcacactaaaatttacttgacaaatgtaaacatgatccgatagttccatcgtgggaaaagagtatatattttcctcttatttggctacagatttgttgttttcttctttctccatttaaaatatggagtgttttataacatagtttttggaaattttttttgttatgtgatgtattgctataaatgtattattactaagaactctacaagtcccttttgatgatttcattgaactggtaaggaaaggagtacgttcttgtctgagtttcattccatcctctctcattagggtctgtgctttgcttatctactgctttaagtggtttcaccagaactttcattcagtagtctcaaaagccccgcgtacttctctctgcttggacaaatgccttcccaaattagtgctgtggttttgtcttgtgaaggaaaagttttatcttcatggataaaggcgaaacagggtttttgtttgtttgttttttcattttgttttgttttgttttgttttgttttattggggcaggcaagatttagtctttagtctgaggaatctgtttggacacttttccagcaaaccttccactctttgggaaagagcatgcccatctgtgaaatgggcttgggatttgattaaaaatgtaacacccacgccctctcggtcacattgtgaatgtttgaaaggaaaaaaaaatgattatagagggttagctgaggggttgtcaataagctggtctccgtaggactgagtttaaacctgttttaaacatgcaaaaactgggtcgcttgttagtttctatttataagtgcgttagaagaaagtacatcttaagtgcagggaaatgcaatacttctattaaacaaaacttagtttttataacctaagaagtgacctgaaggaatgtgaggaattgttagaagcctgtggttcttgggcgcagagtcacagcttcatgtttaatttaacaaaacattaaacatttcatgtttaatttaatgaaacattagagcactaggatttgtcaccttcatgacagaatgtcagaactgtgggatagtttcagaatatatgttctttctacagaattcacatgtcacactggagatgtttcacatgcaaaggcctttacttttttccaggggtcttttttttcctctctaataaaagaaggagaagcaaagaagcaagtagaacaacaaaaacaacaacacattaggcatgcactactagtctagctaattgtaggggggctattagcaggcatttaggcaaatcgattaacatttagcatcagtaccaatgcaattgcatttctactttttgtgcttctgacaaaataagcacacagatcttcaggacaagaaaagaacggacgttggaaccatttgttaggtgataaacgttttattaaacccatttggattttttaatgaactatttgagaaagtggggtgagatctttggaaaaaaataggtaaatgtatccgtttgataaaggttgttaccagtgtgagagaggcaaccctttgtactgcatcgcttgccagatttttttcttagtctggaaaatgtggtcggagattgatagtgctagtttgcctttggcctgtgatgggaaatttcccttttttttgtatttcaaagtgctgaaatagagatatgccctacctctctgtccatattttgcagattggtggagctctattttcatcagatgcttagaatgcttagctcttttccatgaaaaacaaaaattgatgtttgggcagtgaaggtaattaccgatccataaagcatgcatgtgtgtgtgcatatatgtaattatacatgtgtacccacccacacactcacacacacgcacacacagacacacacaatgtacaagtctacaaacccttcccctcacccccctgccaccaaattctccttctattcatttgaattgcctcctgcaccatttctggaatgctgtataaaacacaatggagatttatgcaagggcagtattttcttttgtgatgacaggagtgcgaatggctctcctgttattatatactcagcctgaatgtgctgcttccttgggtaccttgaagtggctgagaccagatgcttcagagagaaatgtcatattcatgcaattcagaggagcatatggcaagagaaaaatcgttgtgacagttgctgacctgtggagcaagtcacttttttaacccttaaaaaatagttttaaccctatcctaaatagccacagatacattatttagttgaagaattttctaattctcctgtatgttgcattctggaaaaagcctgcaatgggggctggggaagtagagaagctgccctggccatggtaggttggacggcctctcctactcacaccctactctcagggctacatccacacttctctcagcctctgggtccaaaggctgaaattcagaacggtgtgacccaccttacctaattcaggtttgtgatggctcccctgccttctccccggggaactgaggaggacccagcaaagctcagccctgcgtactgtcctggaggccagaggcatcgcctgctgcctttgtcgtccttcatgaccaccatcctaacccacagatagcacagaggtagcagaagttgccaaggaggtcccttcacttcataaggcctcttttaatccctgcctatgtgcctgacactctgacagaccccgggaaggaaagcaagtgtgatatgcctcaccctgccaccaccaccaaggatctcctagtgtcatgtagaagatctgtgaacaaaaatggaacaaagcattgtcttcagtgccatgagggctgagagaggaaagccttgtatggccacaggtattatgtgggtgcaggggagagagctggcaaccctcagagctcagagaggtcagaacaagcttcatagatgcagtttttttaagagaactggcctggcagattctcctggaagccaaggggcaggggtctccacacccagaacatggcagatgcttagcaaatcaaggaacttcaagtactgagttcagtaaagctggcacccaaggcatgaggaaggcaaaagattgtactagaaagataagcagagccctgtggtgaatggctttccatatcatcaagtctaagtcttctctaatctgccacatcctcataaatctgagacagacagccagctcatagccgtaaggaaagtgagggttgagcatatcaaaacaacagtatggtttatgtgaacacacctaagttttacaatgtccacaactaattcaacgtttcaaaaaatgctggctacccctgtgtgagccaaactaacgccatgtgcatgtttcagatggagtctgggggctaccagtttgcaacctctgcaaatagtcaacaggcgcctgcaaagggaactcaccctaccactaacttgcttcttatctgaaaagattttggagaagagctttgacaaatacagaaagagtgtgtttggagacaaattttcaagcgtccccacttggaaatctggttgggagggaggcaaatatatatgttcatattcctatctggatttatatttttacatatttgtgtaatggtgggtgtgttctgcttccttcgtatagtcaaagcttctggaggtggaatccaaaaggaaggtcaaaattctgactctgtagatagacacataatccagcagatcacagctaatgagtacctctttgcatagtgcgtgtagtacatgggtttctgcaggggggtggggttcttggtggggtttttttatgttttaatttcctcatcagccatttaactttatgccatatggtgatggcagagctgtccccacttctgtgagaagaccctagtggttccatgaacatcttttgagaaagcagacccactgagcgtttgcttagaagagcagaagggaggctggggaggatgcagtagccatctccttttcatcttcatctcctagaccttaactcatctgctaccatttgactggcattgtcatctagctcctctggcgtgcacacacacatgcataggcagtgtcagtctgttggcagcacctcccaggacagacttgcgatcccacgggctctgcagtcccaaattgctagggctctcttttgagttaagtgtcaggctggccatggaaacctgggattgggccctggctgccttagtggctttgagtaagagggccgggcatttaatatttgttgaagtgactgagctctcagtgcgctcatttatctgtctgaatagtggatagtaatacttctcagctccatggagataatggtaatgataattaaaaaaaaaaaaaaacaactgtgacccaggtatcagctcaaacccatctccacagaccattcccacattctgggtgttccctgagctcctgtgctcaagctcatgtttgttcatttttcagcacttactccttcccgcagcccaacacgtcgtgtacctgtacctttctctccaccccaagctgctccagttgtagaatttggcctcttacccctagcatgtgcaaaaaaacaaacaaactagcaaacaaaatctcaggcagacaaaatcatccacccaaaaccttgtgtggaacagactttactgaaagtttggagaaaatgaagaattgagagtttcatatgccagcaataaaaagaagtttaaatagaatattcaacacctctcttcttcaagagtgcttgggtcagttctgactaactggggctccagctccctgccaggttccctgctgcatttctatttcttccgattggccagaaattcaaatggatttcactatatttttgcagagcagctcagcactctccacctgcacccaaaaagccagcactttcttccttcttcatagaccccttgatagactctgcaaaaggaaaactatagcatagagatttatttccccaaagatgttaatagcaccatttcctgtcactaaccttcaagccaagaaaggaaaagttgttacatttttgttttcaaaaacactttttctgacacataatactttactatgtatttccttacatttttaatatccttcccacctgattgattaattaattgattgattaagggatcaattaaaaaggcagtgtggccaaaggttaagagcacagactcaggagctctgctgcttactagtgactctgagcaagttacttaagttctctgagctttggtaaaggcggatagtcaaggtacctccctgatatcccagccatgtggttaaatgagatcatgcacattgaggtgctgatttcagaacctggcacgtgcaatggttatttcctttgtctacagtcaatggcagcatttcattttcatccaaattttataatagaatgttttctctatttccaaaatgatttcaggttaaatgggtagtgtgctgggattctggcacaagccagattgcaccttgccccaccaagtagaaactgactgtatccatcctccatcctcaagacagaagccagatggcctcctgtcctcccctaagtagtcttcagtttcatgtatgtttctctgtagtggccttcccactgctgctgttttaaccagataacgaaaaaatccaaggtggttcggaataaccggcattggctgaacttttttccaaccaatgttactagaaacataattgctcagaattaacactctcatcttcagtggaacagaatgcaattgtttgctcttggtttgagtcctcagagtggggctggtagggggcaaggaacaattattgcaactaaattttaatcaacagtttcagtaacaatattgaattaaaaaggtactagctactagttagagcatggcttaacttgtacacaggcaaatcagtcattctgtggtgattaacatctattcagaacagagaatgtattctgggtactaaattaccataggaattaatgcagtatttttaaagggcttaaaatatgttaataaatacagtattgtagcacctgcagctgaaggaaccaaagtcattaaagatggatataattatatttattatggcaaggagctaggtgggcgggggggggggaacagtttaatgagcgtgaatgaaatagaggttctttatttaaaacttcttacctgaggaaactgttccctttgaggagttgagttattgcctgaaatcactgaatgaaagaactatacaaaaagttaatcagggataattttccaacctctggacaatgaacttcagaggtctactggggtcatagcaaaactctccacctttttccctttgaacttaccatggaatccctcttcccctgctgtgccctgtaggatccctgtgatgtctgccactttaccaacttcagtttccactgccttcccacacctgccccacccaaatgccacacccaccttgcagttgctcaaacaatcccttatccaacctcagggcctcagcacatacttttgcctctacatgacatttattttgcaaccacttcaatagcacttggccaggctttgtcctagacaaatgttaaatactatctaatttaatcctcaggaaagccttacagattagatcccattatcatcaccgttttacagatgaggaaaagaagtcagtgaagggctaaggggcttgccataggtcctgctgacttgaagttctcttcaccaccaaagttctgctgcatctttgtaggaccggctactctcatccctcagatctcagctccgatgctgtccctgacccctttatctaaactctcctttcccccaaccccatccccagttgctctgtttcaggatccagtttgttctttgcagcacctgtcacaccattttaagcgatagtctgcatgtgtatttttagttataattttccttctcttgcactaggatcatgcccataaaggcagcaactgtttttgtttgatgctgcgtcctcagccctgttgaagtaactgacacttaatatatcctgaataaatatttgtttaatgagtccttgaactcatgtgttcactatttgctgtctgtagccaataataaatgatattcttaatctatttacctacatagacagatagacgaaaaaatatatttatttttcaaattatctgatgactaaaatataattttattaggaagggtaatcctctttaggaattaaaaattttcttagctgattgatataaaaatggcagtctaaaataaccatttctataagaaatctgggcccttttacatagaaggttgggaattgatgattaaagataacttctatttgacaaataagaaataggagaacatgagaggaagaaccacaggctcaaggtgtggagctggttaagacagggttctctggctcttggtttcacattgtttctgcccatctgccttgcctcttgtcgcctatgttgatagcatctggagaagcccatcagaaacagaggagctttttccggactggctcttgctgctactgagagtgttgtgcttggcaggtcaggagcagtggattgaagctctcttattttcttaaatcttgggggtgttcaaggtgaaaattaactgtctgcctatcctcgtggtgaaatgcatttgaaatgctatttcctcttatgaagaagaagaaaagtaaacaaacacacatcgtgtggaattaaaaatggaggtcccagagctgcatatcacacctacagtgagacaccagccttaaagaaactgcctcatgttcctggcttgccagcttgttgaggatacagtctggctactaaaacccctagcaccacaatcctttacaatataggagacatgaaccacacactgagcatctgattaaagttgggggttctatgcccagagaaaaacaacatgtgtaaacatgaagcaatttgcacattgtttcagggaacccacagacattcttttgtcaatttcgtggatctctagaggcccatgaattccagtttaagaagccctggtagcatagaacacctagtaatgttaattataataggtaatatttattaggcaattataatgtggcagatatctgacatatatataataattatacatttttttcatttagctttcagatgtaacatttgtttccattatgcagatgagaaaactgaggcacagaaaagctaaataagccagaaagtgttggagcctggattagaatccagttggtctgatactagaacctctgacaaaggcaggcacagaaagtttacctaaagcagactttcattagctggcatgtgacaccatgaggaatcccatggtgggaaagagaggctatgcagaacaccttcagagcgtcagtgaaggccacaaagggctgatgaatccatattgcaggtccttcagctcctcatggagaggcaatcaagatggtcccaggatacctcctcttgccaagaattgccttctatcctcctacatattgggggactggaaaaatgcatttccatgtgacttcacatccttaatccactaggctggagctaagagttcttggcattttattgagccaagtattcagaatactttcaatttaagaatgtctatcatcagatgggcagatgggtgctatctgactgtgaaactctctcaggaatatttagaatggactggattgtcagcctattttatgagaggctattagagtgagatgtgtttaattatttctttcatttcttaagagtatacatagtatcctttagaagttgcttgataatgtttttttatcattttttctgctttcttttttaaagagagcaggctcatttttacttaggaatgggtataatctaacaagttagaactaataactaatgaagttaaatacctctctggatgtttcttttctattgattgagctatatttagtatcttgtaattaatatcctaagcacctgcttggttctaggcccctggcataatgaagtgaatcagagacagcctgtggcctcaaggagtttacagtctagtaggagagcaggacgtggaaacaaatcaatgttgtgtactatagtgtgtggcagaggaggcaaacgaaagagagagtggtcagctcaggctcaaaagtttatgactggctgcaaagacagtcctagagaagcagttaagaaaactatgatctctagaacaggagttctcaaacttgagagcacgtctgagtgcctcagagggcttattaaaacacacattgatgggccccaacctcagtttctcactcactgtatccagagtgggtctctgaatttgcatttctaacaagctctcagaggatgatgctgctgcttgtccaaggaaaacactttgagaaccactgttctagcttctcagaggaaagaatatagaaaatgcttgtgttgtttccagctttttatctcctaaattttgaaatatctcatttcacctctgtctgtcttgctctgtgttgtgagtttccttgtcaatatgtgtacttctgttctctctatgggaagtacagctccgtgttcttctgcaggctgtcttcctctttttcttcttcttctccttctctcttccttctcctccttcttcttcttgtacctaactatgacctctgattagtaggaatggcttatataaattttgaattgtatacattcttgtggatgcaggtctgtgagtatgagtttattctgaaaccagcactgtggtcagcattattcctcacaattgatcatgtctcacaaaacactttggactctgggtagacaattaaataaagtagccaaatggaagacccactcatgcatatcttcaggtcctctgaggtcttatagggcccatgttatattcctagtggttgcagagcatgccaggaaagaagacgaccaccaagcaagcctaaatcagctgcaaaagagttcagcactttttttttttttttttttttaagaatactgcagcctttcataaacagagtcacgttttggccccaatgcaataaaaagtataaactcatgtcagaaaacaataccaagttcccacattaatgaatctttctcctttcttttattcttttggtccattttgcacaggaaataagaaccttgcggacagaaagatcatcatttgtcaatccttttgcagcaattttcccaacagttctttcaggtctaaatgcttttaagcatctgtcagtgtcatataatagccttaatgggaggaaacaacaacaacaacaacaatttgctgcataaggatgaaatgagtgagtggctctcttcttcctggactgcagtgaaaatgatggtcctgtccatatgtagatttccacatgcagccgtgcagttattgtttgcactcagaccttaagttgtctgtaatttttatgtgtgtaggaatgatgccaattgagagagaatggacgaaaaaaaaaaaaaatatttagcatccctgagatgatataagtcaataaacagcttgattactaattcattcaggaacaaaaataatggctttctaaactgaaacgaccaaatccaataactaactgtttgtcagggcagtaataatggtatttgtatctcttttaattggctttaacctttcccttcatgtgtgcagtattaaaaaattaaagaggaaagtatttagaggcaaagatttacggcactgcgtggattacatgcttttaatgaggtcaggacaataaaccatctgagcagaagctgctgcccaatgatgaattattcccttttacaatagatagactacagcaagcgtgtgtgcacacacgcatgctcacaggcccacacgcttgtctgtgtagaccatgtgaaagacccccagctttgctgttgagctaccacaaggtgtttccagttacaaggagtgttcagaaagtatcaaaatacagagctgcaatacattatgtaaaaaacagaaagttgcagagcaaactgcacgatgtttatgtaagatgttaattcattatgtctgtgcatgttagcatatatgtgcaagtgtggatggatggatggaggcagggatggatggatagagggatggaagaatgtcagtaaggatggggagaggaaaacaggaaagaagaagaaaagtaaaagaggaaataaaaggagagagagggaaaggagggatggaggaaggaagaagaaagaaatatatgtagagagaaatattgataatttggaagcatacacacaggagtgcactggagccagcttgtactagcttgtaaaggcccattgtgcaatacgtcttctcaattctgtcatattcttaacttacaattgtagatagtgacagtatttgctgcacagaaatcagcaaatgctacagatcagggcttttttttcctgcagagccaatttctaagcctttatcagcacatcactggacacccacaaaatcattcagagtggttctatctagaaagagggtttagtacagaactaaaaagggtacatggtaccgtttttagaactagaaggatacccttttagtagaaaggtatgtgaagccattatgttgggaatgggaaacaagacatttttcctctttattttatacatttatttattatttgtaatttttattaagcatttattattattaagcatccatcaattttataatgaaatattttattttattaaaatgtatccacaaacgttattaaaacttgtttagtaataatagaattaatcactttactttaggagtcagttacaaatccttcatacaaggaaacaaatttcagacaaacaataggatcaaatgaccaaaggacttcagactcaaccagaagtgtgtcctttgatggtgaaaatatcctcaatcttccagagcaaaaggaacattcaaaaagtgttaacatagattggtccagaagagtagagtgttcaaagtcagatcccatctgatgacaaattctagtgaagaaagtcacatggctcctccaaagcttatctcctcatgctcattggttgacccgaaccttatcgcagtctttgcgtaatcagcggcctagatttagcagtgtgaaacatctctaacaaagagaaaggcaccacattccagacactagagctgcagtcccattggaaacgcaccatccttgtgggccagccagtctgtcactaactgaaaaaaatgttgacgcttcctttttgccactttgacatggtgtgatctctaatcagcctcagtaagcaacagagtaaagaaggttctctgtttccccttccttcccaaatctttcccaattccagatgatattctacttatgacctcattgctctcatttcctacagactcctgtaaatgaaagtccctgactagaagcccatacctgaactgttaaggaaaatagatgcctcattttacaaacacaaactcattcattcaacaaatggttctagatgcctggctgtgggttagatatggggatacagtggcaaacttgtcaggcaaggaccttgcttttatggagctgacattctagaaggtgagacaaacataaacaggtaaaccaatgaaaaatatcagagaatgagtaatatttgaaaaacgagaaatagggggatgtgatagagagtaacaggtactttacctcctctgctttagagtggctagaaggagtcacatttctgaggaggtaaattttgaactgagatgtcagtggcaggaagaagccagccatgtatagatcttactacaaaaagtaggtcctggctccttttatggggatttttcctacactcactgaggccttttaagacacaagtccaatgaatggtagactgtagatgccttctttatttcctggtgactatttcaaagcaagcttaggaagtcttcactgctgtaagtacctttgaaaaatgtgcaaaattgggatccattgtgtatttgaagctgatttcatgtgcttaaatatcttgaaggttgtttactggttagtgctgtgagtagcattgtttccatgaaagaaagaaagacaaggcaatcataagttcaactgccataaactgggccatctcacagttgtgtctgtacaatttctttttttttttttttttttttctttttgagacggagtctcgctctgtagcccaggctggaatgcagtggcgcgatctcggctcactgcaagctccgcctcccaggttcatgccattctcctgcctcagcctcccgagtagcttgggctacaggcgcccgccaccacgcccagctaatttttttgtatttttagtagagactgggtttcaccgtgttagccaggatggtctcgatctcctgacctcgtgatccgcccgcctcggcctcccaaagtgctgggattacaggcatgagccactgcgcccggcctttgtgtctgtacaatttcaactaagggacaaagtgttggagagaaagatgttataggctttgaatcaagaaatatctgggttcaaatcctcgcactgcccctgagcatggtattgaccctctctgagcatgtagtactctcaactttaaggtgaggttataaaaatgcccacatcatagggtcatggtgaaaatgaaataaggttatgtttatataaagtgcctggctctgagtagcctgaagcatctacttagagaaggttctagaaatgttgctgaacggtgtgattcaccagagtgagactatcatcccatggggacagggagaattcatttatctttgcttcagtctttctgttgaatgcagagctgcaatttgggacttgatgttgcagcaaagatttcctgattgggcaagaaaattgagaaggcagctgtcattcttttagtatgatccataacaaaagaaaaaagagattgggtactcagccagagataaacccattcctttaatcctttacttattcaagagttgccctctgcccctcctctgcctgaatcttttcccctcttcttttagtcctttttagttcttcctggagaaccagaaataaagcttagaaccaactggacagagtccttgaattacatcacatgagcagtgcaatttatgcagcaaacttcattgcctgagagtagaattgtaaggacatgcatgaatgctgactatattcctaggggtaatggaagctgcatatgaatatagtaactaaaaaaaaaaatcaaaaaccttggaagacaaataaacatggcagaagcagcaagacaatgtttttatgttttcacttttaattgactaaaaatatcaatacaacatattccttggacagtcaccccaacacccctcccctttttaatggaaactaggaggtggttgggaggaagaacactcaattgataaaacaacagttacccctgggaagtgcaagtagaggactggaaaggactgtatttttttaaaatacacatccacattgtttgatttttgttttgaaccagcctgcactacattttaaaattaagaatataccttttttaaaactggtgggggagaaggaagaaagagttactttctacacaagatagcaacgttgtttttaagtaagttttattaacaagtgacaattacttttttatgatacatttaagatagtgaattatgaatgactgaaaatcccctccagcctaactgagaaccattatgtctggtaattgccactgatttctgcaaacagtcatttttctctggcctgttaacataatttaaatttttaattgcccttcataattgtctattggagttaacaaacagtcccattcacctaagggtttccgaccaggccctacctccaggaactcacactggaaacatctaagaccacttgagaatgccattaggagtttgtggatggtccaattgaggtggcagcctctgtgacaaattgtgacatctttttaaggacccatccaactatggaataatatatttttggatttctgtatcaagtttgctcacttttgctttgtagctacctgacaaaaaaataataaatagagaaaaaatgtcacacttgtaaccatgttcaccaggactttcatcacattgccttatctgttgcactgggataagtgtgaacattctgggagaaggacaggtgccaagtgttcatgtactataggactcacaggttaattaaatcagtgacatcagagaggggggcagaattaacagtaaagatacatatttatctcaatatatgtgtgtatatacccaactcagaaaaaaatgatcataaagtgctttagtagttttgtagttacataaactacaaaccggctatctcagccggttctttgactactttgcatactttgatcatgctcggttttctgagaggaggcactggaaaatctgcttttttcatatagttatataaactactagtagtatataaactactgtcattttcctgagttgggtaaattcaaaaaagtagaaagaaaaatgcaaagaaaatttcctataattccatttatagtatatatgtatgcctaagtacacacacacacacacacacacacacacacagagatatatctggatagtgttttataatatatttctcacatgatttactattcttgtaaaattttatttgtaaggactacatgtgattcaatatgtagtttcgccattggttatttaagcattccacccctgttggatattaaatttcttggtttctaccattacaaaaagctgaaagagtgagccaccctgcatattttgtatacatcactgataattacctcaagaaaacatcctacaaggtgagtgattcaggagtatgaacctactgctgaatcaccctccaaaaaggttgtagatcaaaatacgctctctcatcagtatatgagagggatgacttcccatatttttcccagcactagatgttaacatttattaaaatgttggtttcattactagtctaaaacatagcattcattcatttctaaaggttacattaatttgaccaaaagatgctgacaaacatttttatgtattaaggagagcataggtatacattgtgaatggcatgttcaccccacctcatccactttctattaagatatccatattcttatttgcacagttaaaactttaaattctctgtgctttttaaaaatctcttaagattgctctgactcaagactaccaagtaggtgttcagtgccaaagaacaatagactccaaccacacaactagttcccatgctacctgaaaaagggcttggttttttttttttctgccaccttcacgctcttacgcatttgcagtaggtgcatcttagtgcatctacttagcgcagcatatgaaaccacaaacaaaactgtcccagggaccttgaagtctgtcttccacttcccagggccccttcatcctccttttggttcccctcagaatgtccaagtgaatccctttgtgcatccccacctggtttagtattgaggcaaatgggaaatgcccagaagaaataccgacttgaaccactagtgtgaaatactaactcacagcaattcactccacacaagttggcaacttctgacataaagcaatggctgataagtataatgacgaggaatctgatgcttggtgatacaacagtagccacagaaatggtcggcagtgaatatctgattacctggctcaaatctatttccaatgttgggatctccagggtccatttaagtatcttcaaacaaatgttccagccgagatatttatgggattctctacaggcagctgactggctgctgtgggaggaagtccaaagctgagatatttgtcctagcttgaaaactgtcagtactatttgtatgaatgcgttcaaagtggccatgtttcttcataactttttggactagttcaacagggacatgaaagaaggacactaaactgattcctacatggaagcttccattgcttactgtctgcttggaactctgagggtgacatttattataaaaatagcaacagttagttataattgctgacacattccatgctttcaaattgaaactaataatctcattactcttatttccctcacctcctcctaaaaactcatatgatagcacatttttctgtgattcctatctcagccgattctttgcctactttgcatactttgatcaagctcggttttctgagaggaggcactggaaaatctgcttttttcatcacctatacaggaaaaaagaggattctataagtctaaagcaaaattatagatcggggtttcaaccgtgaacttgggtttgttctttttaaagcttaaataatgaatgaggacttctttgaggaagtgtggctttctttggggaaatttataagcacctgatggctgagaccgcagggcgtggagtcagaaattggttcaaattctgggcttgctgctttctagtttagggtgttattttgagtgaaataggaatagggaaatgggttgttgtgagaatcaaatgaaatgacacaggtacacaaagcacactcaatgagtgttgataagtattgtcattgttatgattaaaacttgacaaaaatcctttcgtttaacactcaggacatctgtgagtcgggtgtttactggttcctctgcttctcaatgacacccacattcccagttgattcttacaggcccagtcctgcttttcatgagaatagaaaggaaaaaatatgggatgacttaagagatgccagatgaatctttgccccgaaggcaactgtttattcagctcattcaacgaacaaataatttcactgatgatttattgttttcctcagtgaaattttccttcatacatccataattaaaaagggtgcagaacagtaaatcggtgaacctgtcatatgacatttgttagcatcgaaaaccaaggcatcatagcttttagaaaagaaaaaacgaagaggttagataggccctgatgtatggatttttttaactggctgtcatttcagaaatgaaaaagtgtgaggtgtctgtgtgtgtgtgtgtgtgtgtatgtatgtatgtgtttaaagaatggagaccaaaatgtaaagtgaatgtaatgccctgtcttccaatataatgacctaatttctattgatattgaaaatataccccttattagcaatgagcacatgcagtgtttgcagtttctctaaggaaggaataccagtttttgcttatttgttttattttttagtgacagaaaattttccaatgttaggaaaaaaattaaattacctatctaattcacaagctttcctctcttttttgagatggaattttgctttttttgtacaggctggagtgcagtggcacggtcttggctcactgcaacctccgcctcccgggttcaagcaattctcctgcttcagcctcccaagtagctgggattacaggcatgcgccaccacgccctgctaaatttttttgtatttttagtagagacggagtttcaccgtgttagccaggctggtctcaaacttctgacttcaggtgatccacccgcctcggcctcccaaagtgctgggattacaggcgtgagccaccacacccaacccaaactttccttattcaaggccaacccagcaaatgctttgcccataaggaagggctaaaagtggcagcaagtaatcatttgatctgagggtctgattatagagaaataaaattttaactttgacagagacttcagagccaaaaaagcagagcttggcccctgactttaatgctaagcaaacaaatggctttgggatccaactctacagtgtgacacatggatctaataatgatacttgtaaaaaatatcatgagagagaaatgatgggagaaattcaaggaacacatgtatttctcccatacagatcctgttataactgaatgtcactctttggcaaattctgcagacataaaaatgaacccgatgcaaactgaattcgctaagttcatcctggagcacctaaccgcgtctcccctccttcctcccccagccccccacaatgttaactgagaacctgataaatcagcaaaccgtctagaagcctcattaaacctccaagcagtgcctagtctcacaagagagtagcattttgaaggagacagggagcaacaacagacataatcatgaggaagaaaaacaccagaataaaagaaacatcaataaaatataccatgcaccattaaggaccacctcgagataagatactcagcgtggcagtaaagatcacaaatgaattaatgtcaaaaaaacaatgtgtggtctataataatatgtcagactgggttgaaaatcacagctgcctagggaactgtgcagcactcccagccctccgtttgtggggtaattgtgccagtgactcttaatgctgctgacagagaccttgcaacatcactttttttcacacaacacacccaatttgtcggagcaaccacatgccatctaggcaggctgtccattcattggaagaataggtcatttttatgtaaaaattgtcatcctcattttttttttttgagatgggagtctcgctctgtcaacccggatggagtacagtggcatgatctcagctcactgcaacctccatctcccaggttcaagtgattctcctgcctcaatctcccaagtagctgggattacaggcgcccaccaccatgcccagctaattttttgtatttttagtagtgatggggtttcaccatgttggagcaggctgatctcgaacctgacctcaggtgatctgcccgccttggcttcccaaagtattgggattacaggcatgagctaccacaccctgccgtcattctcatttttgtaactttaacattttgatataatttcaaaattacataaatggtggaaaaaacacccttatgccttttacccagatttaccccttgtgtatatatatgtgccactttgccatttgcagtatcattctctcccagcttccccacacaagcgtgtatattattttttaactaattaagggtgagatccccatgcacatcgtgcctctttacctccagacaactcagtgtgtctttcctaagaagaaggacattctgttacataacccagtaaaattaccaaaaccaagaaatttagcgctgatatcctatattgtctagtccttggtctatattcaacttttatcagttgccccaatagtagccttcatagacctttttttctagtccagggttcatttcaggatcacatattgcatttagttatcttttccctttcgtcccctttatctgaaacagttcctttacctgcacttctgtttttgcctttgtcttttttgattgttacatttttaaaactttttattaatatgttttatatatgtatattcatatatgtatatatgtatgtatatttatatgtttttgtctctctctatatatacacacacatacatgcagttaacttgtattttacacattgtatagccaaaagaaccgtgaattctttttgaccaaattcaaccctgtgatcctagcacatctcataaccatagccctaaggctcactgctcttactgcccagacatcttgctgccatctcagaccaagaagctggcgtcattgccatctgtagtactctaaaagaagcattcggcctcatggacactagatagtgggatgatattgtttgtctcctcagagcagagctttacaagctgcctgtgattaaaaacaaaaacaaaaacaaaaaaacaaaacaaaacaaaaaaaactttaggccaggtgcagtggctcatgcctgtaatcccagcactttgggaggctgaggcggttggatcacctgaggtcaggagttcaagaccagcctggccaacttggtgaaagactatctctactaaaaatacaaaaattagctaggcatggtggcacatgcttgtgatcccagctacttgggaagctgaggcaggagaattgcttgagcctggaaggtggaggatgcagtcagccgagatcatgccattgaactgggaaatggaccagactccatgtcaaaaaaaaaaaaaaaaaaaaaaaaaaaaagaacccttttatcccccagttcctcagagaccatttatatatggctcttctgcacaaacccaggtagagtttgcaccccatgtgactccccattcaaggttgccattataccactcaaggagctgagtctactgagcaagtgctttgcttccttgtggcagtgtcaagctactatagaagtgtctaacccttagctctaatctcctttatttatctcatcaaacgctgattggatgaggccagtggcgcacacttagccgtgctgggctaacacagttggctcctatcagttagaattcaactgaaggcttgcatccccatggagcatttctcattcaccagcctgttttaggacacgatgaaatgcctcctacatagcacttacctcaattcgcaacaacactttgatttttgagatgattgtattggtatctagtaccatgacccaactctagggtccgtgaaactcccacaattttgcctgccattgtgtcctcaatgcccagtgcacagtagacactcaatacataactgtttaatggaagagtgactgcatcagtagtgacttctgacaaatgatgaaacacaataagaccatgggctaactcgaaatacgtttaagcccaataaaattacatttggcataagaagatagggatcatgcttgctctgagaatttgaggacgtttttgtttgcttgtgtgtttgttttagatttaaatgagggaaatcgcacttttgaaagcaccaaactgtgtcttacatatacatagtagacacttgaaaagcatccatttcgaattaatcattttgagagcttagcacaaccttagcagttaaactgtctgttactattttcaagaaagtctatacttgtccaactgtatttgtttatttgagagtcacatttaaccaggacttatttcactctgtattcttaatatttgtagggttggtgggggagggggtacaaaataatattttcctaaacaaatagagcctgatttattcaggaaaatagagattatagatggtttgcaggaaaaagaaggtttgaaaacaaaacctgtgagcagattgttttcaagtactttaataggctcagctgcttcctctcctccacttttcttttccatgaatataataataatgatgataaaggtttatgctggacccattataacaatagggactatcaccaaagtattctaaaactctctttcaactataggagatgatcttcagagaaaacacttgaaattgctactttgtgttatcaagctctgatgatttggggtatattgtttcttctgtgtggccctacttcaaattaaggctggataatggtaggcaaaacagtcagaagcatgctttcactggtgaggcatctcttttggctgagttaatctttatagtgaagatatacattgaaagtatatgtttccttactgcctgtacagcttagtttgctcagtgtccaggtggctttagttatgacttatgactcaaggatagcattttaggagaaccagtgggaaaaaaaagtagtataaatgtaaatgtaaaagatacagctcattctgtctttgaaatcgttgatgtgaaaagagctcaacagtgttttatttaaacaaggtcggcttcgaccttgattgacttgcagtaaattgcctggtacaagaggcaaaaggaaatggagagaaaaatggcaatcagcaccaaatgtttcacatattgattgacaagcaccagagatgtgctagagtaagacaaattggccaacagggcccatcttgacagctcttgagatgggaaaattgttcttgttaatttgctgcaggaaccttgtcatttatggaatgtgcacgtgagtgtctcctaattgtgcaaacaaagttcagtttcctacacagccttgttgtgttattgggtttggtaattctttggtctgaatcaccaggatgcatttgtaaatggcttttaaattgggggacaaaaggggaagtggtgcacctgctataagatggcattttcaactgaaatatagcaaattacttggtggacattttccgtttaacaatagatttcagacaaactcatgtgcataagctctccttccatctgtctgccatgattctcttctgccgtactggatctaattgcctttatctcaatgcaggtttgagtttgggggttttcaggtatgtaaattttattttaggagtttggtagtggccaaaaaaaaaaaaaaaatccttcgtagacttttctatcttcgccccttcagtatttctatctttctcttttagtcttctcctaacacttctctaatatcctcctccctctctccctctatgctgaattagtgaatgtctgttatcacccaggtacctctttacacctctctctgtaagatgcactgtattatggaccagactgccaaggagacccatccagaagccaacgttcagtcttgtttgtcattttttccaaattaggtaaaaatgcattttcatttagggtataatttaaattaaagcattgtcacagacgtttttgttttaatgttttacaagtagaagccctcaccatcattattaccccttcccccgagtccccccctcccgcgccacacacacacacacacacacacacacacacacacacacacaacacggccccactctctctctctgaatttttcaggccattactgcagtcttgcttgggcaggaatggaaaggtctttattttcatttaaatgggctgtatgaaaaataaatcttaacttccaagacctgttcttaatcaccttcattaatgtcgcagctcagaacaatgcatcactttcctactgtctaagaggaagatccagactcaaaaatattcatgatttccatattactttgtacagacccctttaacattaacttgttccagtgttgggcaggtcacatagatgcttaaaacagctggcatatggaataaaatatgggaatagtggggggaatatgtaccccactgaaggcattcagtgtcataactacagacagacaaatagacagaatattgtggaagctttagagctgtagggtttgtgatccctagcctagacttaccattcttaacctgttttcaaaaacactcttcgctgattatctcattttgtcttcaaaatagccctggaaagtaggtgcatgagactccattttccccatttcacattgaaaacagaagcatcagaaagtcaactaaacttgttagatggaggcagggaaaggaacctggacagctggcccgactgctcctacagtgacctttccacttagcattctctcatccatttgatgtcactcaacagctgcttccagcctcatccttcaccccatcttcttcgcaatgcccaactctaaaatcaccttctctctccagttgtcattgacctcaccttccccaggcagagttcactgcaccctcttctgggttgcaatgtccctgaaagcaggtccctttcatagtagctaccaggttgacaatgcagccacctatttacatgtctatctccctcactgaagtgtggattcctcaaggacacagactgtgtctggttccatgtcactttccttgtgtctggcactgcttctgccacgtagtcagcccccagtgaatattggttgaatgaatttgaagtgttagtaaacacacactacaacacaacttagaaaagtgctcagtccagagttcccatcctaaatttcttctccatctgcatgaattcactgtgcctgaatggcaagtcatttcatttcggaattatcctgaatcagaaaagagaaggcaagagaagctctggccatcagcagcatgcggattgctagaaaatgtttatccccaggaagcctagaagtgctggggagtcttttttagaatgctcaggtgttgtttctgtgatgccaagaatcttccaaaagattgagatgaagccacagagaaaaatgcttcaatgtttcaataacattaaaaatttaaatgctagaatattttaggtttctttgatttacaaattaatacccccaaatatgtatataaacattcccaaggctgaggttcaccaaggaccaatttattgaacaagaaagcctctttggattctccttaagtggcaccttttggttcacataaataaacttgtcttcccctcttctacctcctctgaaagaaggttgtgtgaattgaaactgcagaatcatattccaaagatcgttgtgcgttatcctgaggacaggaagggcacagcatcagagaatcttccttttggattggaccacagaagtcatttcaattgattgattgattgattgattggaaatgggatctcattctgtcacacaggctggagtgtagtggtgtgatcaaggctcactgcagtctcaacctcctgggctcaagccatcctcccacctcagcttcccaagtggctacgagtatgcaccaccatgcctggctactttttaaagatgttttgtagagatagagtctcactatgttgcccaagttgatcttgaactcctgggcttaagcgatcctcttgccttagactcccaaagtgctgggattacaggcatgagccgccatgcccagcctcaccctatctttatcccacataaatgtcttttctaacatcctctctaagggccatctaacatctgcttaaatgcctccacccacagtgaactcacttccacacaagaaagcccatttcatttgtgtactgatcaaatcactagaaaatctactattctattaacccaaactcattttttctatcacttctattccttggtctctgttatgccctctgcaaataaacaaatcaaatgccaacctccttgcacaggactggactgcatagcctgagttgaaccttcccctgtacacacaagaccctgtctgtccaagtctccagttctcctgagaatcctagattccttcataccttcacctcactgaaagttagcgcatctccaccatttgcccatttacttctgaacaccttcaatacagatgttcattttgaaatgtttctgtatctatgagtatgttctgactaaatctcagagcaaaactggaagaagtacagcttcttttcattagaactttgacttctattcgtggtttatttgggccaaacatattaatctgtgtctcatgcagagattatactgatataaaactccaaagcctttttttatatttgcttccgttcagtcatattttcccatctactactaacagttttatttttcttttaacctaagtgcaacactttacacttaccctttagatttcagtttgggtaatttggacatatttggatctttattattttccagaatatatgttcattcttctagctttatgttccctacagataagatgaccgtttctctccttatgtgtttctcaacatacctgctgagcatgcccaataacagagccctgtggtacatcattaggaacatgtagagaaatagacttcagtggactacaatgaatggctgagtaggtcatgagagctgagtggatcgtgagaactgaataggtcatgagagttcttcaaagtgttaaatagtgaatgcataatagagttgccatagatcttacccttcaattgaaaacccaagtgtccataatgatcagctaggcaatatgaatgaatgaaataagagggcatggtggggtttgtggtaaagtggagagtgcatatgtaaatcaaagccactaaaattcaattaaaagaaaaaaacactgttttactgctttggcaaatatatatatataaaacatattatatattttgtatgtatatatcttcatatatacacacacatatatctatatgccaaatgaggccagtgggctgccacagggccaactctgctccagagagcagcattagaaccaaggaatagacttgtatgtttctactatgtagagccatcctcttaatgatttctcggacagtcattgctaaaaagctactgctctaagcactttttctccttgggtagttgttgagacattggttcactctctggtgacttttttccagagctgacagtatcaatgttatttccatttatggttgatttaaaaactgtcagagaggttggtttccttgatgaaaaatttgggaggctaaacgtcttccccacttctacccctttcccaaccccctgctacgggtgatcctgacactagattagatggaccacttaaagcaggctagttttttgtttgctttttgttttttgggtttttttggccacattgtatattgtgttagtttcctattgctggtgtaacagattaccacagacttggtggtttaagacaatgaaaatggatgatctatcttacagttctctaagtgagaagtctaaaagcagtctcaatggaataaaatcaaggtgtcaacatgacagcatttcttctggggacaccatgggagaatctacttccttgccttttccagcttttataagctgcctgcattctttggttcatagccccttcctcacatcagtccaacatctgcttctgtggtcatatctcctagaccgctaaccctcctgccccctcttatctccttatctcaagatctttaacttattacagctgcaaattcctttttaccatgtgcaccaactaccagagacaggaaaaaaaattgtttttccccactctcacacttctgacactttattctgatgaaaaaataaaatccaatcattttttctctctccactcacactcaacacacagaacacttcacttctggttaccatcatgttcaagggtttctgcccaccagcaaccaatcagttctccagtggacaccagctgggtgtccactacttcaattcaattctgacactatctacctggaggtagcatcagatcccacaggttaagggcccagtccctcaagactgctcccacttcagatgttaatcacaagtcccatgttgtgacttgtgcttctaaatgacctggtataaatcagaggacccatgaccccttccttgggttctattaatttgctagagggattcacagaactcaaggaaatattttacctacatttttacctacatttatccatttattataaagaattttacaaaggacacagatgaacagccagatagaagagatgcatacggcaagtaagattgaaggggtgtggagcttccatgcctctccaagtatgccaccctccaggaacttccacagattgagctatccagaagctccccaaatcctattcgttttgttttttatggaggcctcagtgcaaaggcaggattgattgcatcattgtccgtgggtgatcaactcaaccttcaactcctctctcctcgctggaggatgggctgaaagtcccaacactctaatcatgccttggtcttctggtgaccagcccccacatcccaaagctatcaagatgaccccagccaccagtcgtctcatgagaagacaaaagactttagaagacaaaagacattcatatctccagagataccaaggattttaggaattgtatgccaggaaccaggatatttcacaatatcacagtaacatgttcacagggtccaggaattagaacctggatgatttggggaccattactgtgcacaccacatactttctgagctaccacaaggccaggttgagagaggaagctctccactctgtaaccttcattctaacaggccctgtgaggctgtggcagagtggagttaggggattcattaaggaaggggattccactaggacttaggtgtactagaacagactcgggactgtactagaatataaggcagagagagaagacattgttcaaaatttaaatcctcccgagttcaaaatttaaaatgagaaatttttaaatgagaaaattcctttctttctcccacatttaccccagagatgatgtagcccagcttctgagagtaagcaaagcaataaatatgaaacaggaaacgctggtaaataacttcctggggactactctggaggatgggggctgcaaagctaatactttcttgatattttaagggaagctcctctccaaaccacctgggctgtgacaagaaggaaagaaacctggaccctcaaccagtatccaagggctggcttcattttttccccaattagcttgcaacgagttaatagtagctctgtagtgctggattcagggatttgtgtgacatagataaggtttggcattaaaaatgctaaatcattacaactctgaattttctcatgttcattcacgaagctgtaatctttcccacctagtactatcactcttagggtgcatgaatcactaattattgccctaatcccaggagataaatttctccaaggaacccagcagcaaagagcaaagccttgaaacctacttatgaagaaatgtgtcagccgtcttggagatttttacttcccaacttggaaattatgttgattggagtaagtggaagcttaactggggggttgttgatgtgtgttatcatctgggggtggtggcagaggggataaactgtgagagagagccaattttatctcagtttgtcctctgactcatgaattctgagtcctgcaatggagttttttgccttgcaagaaaagctagattaatgcttgtgtgcatagtcattgactttataaaaaatcagattacaaggaataattttagtgtatatttatatatccaaatttatcataatcaccaaggattttaagcaagatttttcacggtttcatgcactattgaaatatttggtaaggggagaaagagctgttatccatatcctttctagatgttattcatcttcttgttttaaggtataaaaattttccctgaaagcctctggtttgggccttggatgtagcaataccagagcccgagggtagacttttgactataaagaataaaaaagttccagggcttaagctttgattgaggacattcctgtctttgtgggaaacagcaacagaaaaaagaagtcctgtagccaagacttgcttgggtttttctgctgaggaccgccagagattcccgcagctctcttgtttgggaggaagatggggaggaagaaaaggaaataggaatgctgtgttccttcgtcttcccttcatttctcccatgtaaaaaataaagtagccaaggaattattgtctcttttaggaatgcctcagactgttagagttatatcaattgatactgtcttaatttatcctataatttttttaaaggaagaaagataatatcagctctttattgcctatgtctgtactatagatgaaatgtgtcacactccttaattctctcccacattatcatatctttgataaactcaatagagaaccagtagcagaggatgcttgaaatggtttttaaattatttcagaaaggcttccaattaagctattgggaaatatgtgtgtatatatatttgttaaaattgtaggcagttgacttgcttttcaacgtttgtaaggttttccaagcttgaaccacttaagtcaaaagtagaactaataaaagcacaattgaacttaatatattatgtcaagatttacagtaatcgattattgtttttcagctatgaagatatcattaagcatatgccaagcaatcagcgcatgactgtaataggttcatgaaggaaaggctttttctaatcgttttcagtggtgtttttcccaagacagcaacagcttttataaaatgatggttatatctcctcattatggaatctaatctccccaaaagacattcagcagctgcaaaacggtagcatcttttagctgtaaattgttttttattatttatccctatttaactaaagaagaaacggccatcagatgatttaacaagacaagaatttagtagttttaacatttgacagcacccaattgttagcccatgcattgatctctttagatcttggcttaatggtaattggtgtatttttgctttcgtgtctctatgtactgtataagctgagtatgagtcttctaggaaccaaatctgcatgatcggctcttttatatttctctttaacatgggatttgaagttgtgtgtactcgtagaattcaagaaattgcagaattagacaaaaaggaatacagccatcctaatgtgagtccaattttaatagtgggtgtcattatgagctgaatttgttacccacaaagtgatagaagaaagtcggaagatggaaacctctgtttattggtattatgatttactggtgtgcatcccatcacaaaggaggctcttcagtgggacacaattttttgttcttaagaaagtgatcgggctctgccaggcgcggtggctcactcctgtaatcccagcactttgggaggccgaggcgggcgcatcaggaggacaggagatcgagaccatcctggctaacacggtgaaaccccgtctctactaaaaaaatacaaaaaaaattagccgggcgtggtggcgggcgcctgtagttccagctactcaggaggctgaggcaggagaatggcgtgaacccgggaggtggagcttgcagtgagccgagatcgccccactgcactccagcctgggagacagagcgagactccgtctcaaaaaaaaaaaaaaaaaaaaaaagaaagtgatcgggctctatttgagaatgttctgtggaatttaaaaataacatggcactaatgagttttcaaatcgctccatgggtagaactctcgtgagacaaccagctaatttaaataaataaggttctgtgaccccgtgggagcttacaggggtgagacatccattttaatcgaggctcagtttgagaagaggaaatttcactcataacatactttcaagtggattggctgcaatgtgattttctggcgatgtttcctttgttgctattttaaggcaaatgtttatgtttctttacaagacttggcatattttactggaaaggttgaagtaatttctccacccttaatatggcatgcctttctagaatggtcactcggaaccaattaagcaacaatttcattccatagactattgcaatttgcttttcacttattctgtgcagactgaagttgtatattcatggacatttcccatgtaagttttagattttccactttgtagatgcaaatacttcttccagttttgtgataaaataactcaacaacagcaaaattcaaataagaccacaaaaaaagtcttattaagctttacataaatagctgcttccctatcatgaaaacaactgggaacattgtactgttgtgaatctacatttctacttattcagtaattgtacccctagtgctgtttaccatttcatttgtattatttatatatcaaccaaagggtatgaacaccaaaaaataatttcacatcacctatcttccatttctttttattttaaaagccctgaagatatagttctcctataaataatgataaaaagatgctgtattaatatttcagcaaagatctccatctactcacatactcacaaataacatattctgtaatatatacacttacccctccctaaattaactgtgcctggggcttgcaagaaaatcaggtcaagctaaaggagaaatcagagaacaagaccaaaattaatttactactctgtaccacatgtgaatatgagtttgtagggggaaaaaaaggcttattttttggaccatctctatccctgtatatgttgagcacttttaactctgaaatatgtgctgcgtcttcttgcctggatgaaggtgaaagttcaaccctctctgcttagatttttattaaatctcattaagtcagctaaaaggagctgcctaccttgtcagttctgttccaaaacatctaaaagccctttttgtacctctttattgctggaggtaaaattgtgaacacaaccataatttgcctatctgtctgagaagagttttctaagcaacaattggcatcattttcaaatatttggaatggttttcaacccagttatgtcgtatatcttatgctatgtgttaaagcaagcacattgcatatatatgtaaatgcggtaggaaggatgcccctttaaatatgtatattcatgaaccattttgggttcctttctctcaaacccacattaacccatcagtcaaacatattgccattaccttcaaaatgcatccagattctgatctttgtcacttttgtcactatcaccctcatccaagactcacccccactcatccctgacctggatggattattcttatgggtctccctgcttctgcatcccttgggtttgttcttaacacaataacaaaagtggctttgctaaaccatatgtagtatcttgtcactcctccctcagaaccttctatcagctttccgtctcacccagagtaaaagtcaaagaccttgcagtggcttctgaggcctccctcttctccatctctcattccactccaggtgcactcacctgcttgctgttcctagaatataccaaatgtgcagccagctcagagcctgtgttggtgctatttcttgtgcttcccctagacatcagcatggctccctctctcacttccaccaggtcccgttcaaatgttatcttaactgggaggtcttccctgatgaccttatattaaatggcacccacctcttgacctctactctgccattccctactctccttacctttctctacttttcccttgaaaacacacacacatatgttgtgtttacatatgcttatatgcatacatatatatatgttcgtatacatgtgtctgtaaatatatttatttatgtttaatttgctgttgtttttgccgttatttatgtgttgattgccccttctctaccctccagaatataagctcccagaaggaaaggactgtttgctttttacttcataaccccagtttatataatagagcctgatatgtactagacactcgaagaatatgtgtcaaaaatatggaaggaggaaggaagaaagagaggaaggaaggaaggaaggagggagggtgggagggaagggaaggagaaaggaaagaagggagggagggagggaagaaggaaagaaggaaggaagggagggagggaatgagggaaggaggaaggaagggaggaaaggagggagggaagaaggaaggaagggagggagagagggagggagggaaggaatgagggagggaggaaggaagggaggaaggaagggaaggagggagggagggagggaatgagggagggaggaaggaagggaggaaagaaagaagggatggaggaaggagggaagggagggaagaagggagggattgttcaagaatctcttttcatggctggtctaggaactctgatggaaattccctgttagtccttttatcttccacacagtcacttatttcgacttcacttaggctgggtacaaactattttagtttggtacacatatgccacctctttgcttaaacaaacaatgtgacccgttttctgggatcataggagaaataagtgggaacacagaggccaccattcccgtctctgcttggacattgaccagtcacccctcctgcccccactttgccaaatgagctgaggaaatgcatccttacctcccaagcaaacattaattactgtttgcaccacgctttgagatccacagatgaaagcagttgtaaaagcaaaatgggttattatgttgggaatggttatagactcatttagctctggaaacccatcaagcaggaatgttgaatcatgaaactagggttggccaaatattacacttgttataattaatttgagcttaagcttcaacacagtgacatgtttcctttaaataaagttaagtcctctaaggatgcatgaatctatatggatctcgattttcagctgggaactgaaatttttcagatatgcagaatgcagaaaagcaaatgtgtctctgacttctggtggggcagggtgaatatctgggcagactgcttatttttgagacataaataatcttctgtctccttttccccacggggctgtgagagcagtgttcacaaaattatggggatttaggactggaactgaatttaaagggcctacaatcctacttcccactgaatgccaaaacattgtctacagccttgctgacaagagccgctcaggactgctgaaataatttctgggatgaggagcttgttactttgcaagggtgctgattctgatgttgttcaacaactgttgttagaaagctctttacatgtttatccatttttgtcaacaaatatttattaatcactttctgtgcacatgtactttgttaggagctttgggatatggaaagattaaaacagtgcagattccgcaaccacctagagcaatgccctggcctaggagagaacctgaaaggtggtagttattcaatacatatgtgttcattgaatgaactacagagtggattacattctagcaagaatgatacagcacatgccaaagaagccatgataccaagtggaacatgtataaaggagaggtatagatacatgcaagatttatcaagctgaatgtggctctttttcgtagccaaattcagcttgaatttcgctctttttccaaaccagcttataaatgtccattctgtttttcataggacatggctaaattatttgagaattgctacaacgtcctttacctctcttccagggttaagaactgcagggcctcgagtgtattaaattatttctagtacacacatcaatctgaatttcttcccctaggcagctcagtgcctcaactaggctcttaagaggtcagcctagaatggaatacaccaaccaattcagacgtgttcatacaggcctacagtacattgggtctctctttcctatgatctggacatgcttcccataccatctcatactgcatatactatttgttcatggaacccttgtttcctgggacatgttttatcttgagaaaacccaatatttcaaagaccatagtttggaagataagagtctaatgtcatatgtgggttggttttattaggggggaggggagcagagtaattattttacacatactgcattaaaattatagatttatagtccatttatatcattttctatgaaggcagattttcttcatccttatttgaattttgggttttctgctcatccccaaacttaagtactggagaggagtgttatctaataaatagagccttagactcaggtcactaacttactgtgtggtccagaaaaagctgcattctctttctgaattacatttttttcatcagcaaagtgaagtggttgatcagggatattatctaaggttccctctaaagctaacattcaatggactttctccgtagctttctttgacttcatctagatcattctatgacttttgctaatctcagggacagagctatcaactagaaagcagttctaaacagaagcatagcaaaagcaagacacagcaggtcaacctgagccccatcttctaaggcttatttagcatgtcagaactgcagagactgggaagaaaatgtgagctaagagccacaacagcctttgttctgcatctgtaccatgtcttcataagacgaggaagtctgcaagtcttcataagaagaggaagaagctgggcatttttgcatgtgcaaaccaatgctgacatttctgtcacatcacttctaccatgatgggttttacaagttgcccacatgaacatgtttgttcatgtctgaaatggcacatcattgtatcacctcacatgcaaactcctcactcactttaagtctttcagcatttctaccctggttggtagtggcttctttcctggcaactatgattatttgaaaacaacgtcaagagaaggctcgaaggcgccgcgggctggggtcggtggcttagggagcccgtccggccatggtggccgcgggtggtggttggcgcggctgcgctgcggcccggggcagtgcggagccgggacagtcgcggcgctgacgcccgcgggcaccagctgcagatatgaagcagagccgctgccgcgaccgaccgcagccgccgccgcccgaccgccgggaggatggagttcagcgggcagcggagctgtctcagtctttgccgccgcgccggcgagcgccgcccgggaggcagcggctggaggagcggacgggccccgcggggcccgagggcaaggagcagctgcctgccttggcctcccaaagtgccgagattgcagcctctgcccggctgccaccccgtctgggaagtgaggagtgtctctgcctggccgcccatcgtctgggatgtgaggagcccctctgcctggctgcccagtctggaaagtgaggagcgtctccgcccggccgccatcacatctaggaagtgaggagcgtctctgcccggccgcccatcgtctgagatgtggggagcgcctctgccccgccgccccatctgggatgtgaggagcgcctctgcccggccgagaccccgtctgggaggtgaggagcgtctctgcccggccgccccgtctgagaagtgaggagaccctctgcctggcaaccaccccgtctgagaagtgaggagcccctccgcccggcagctgccccgtctgagaagtgaggagcctctccgcccggcagccaccccatctgggaagtgaggagcgtctccgcccggcagccaccccgtccgggagggaggtggggggggtcagccccccgcccggccagccgccccgtccgggaggtgaggggcgcctctgcccggccgcccctactgggaagtgaggagcccctcagcctggccagccaccccgtccgggagggagatgggggggtcagcccccccacccggccagccgccccgtccgggagggaggtgggggggtcagccccccgcctggccagccgccccgtccgggagggaggtgggggggtcagccctccgcccggccagccgccccgtctgggaggtgaggggtgcctctgcccagccgcccctactgggaagtgaggagcccctctgcccggccagccgccccgtccgggagggaggtggggggatcagccccccgcccggccagccgccctgtccgggagggaggtgggggggtcagccctccgcccggccagccgccccgtctgggaggtgaggggcgcctctgcccggccgcccctactgggaagtgaggagcccctctgcccggccagccgccccgtccgggagggaggtgggggggtcggccccccgcccggccagtcgccccgtccgggagggaggtgggggggtcggccccccgcccggccagccgccccgtccgggagggaggtggggggggtcggcccccctgcccggccagccgccccgtccgggagggaggtgggggggggtcagcccccctgcccggccagccgccccgtccgggaggtgaggggcgcctctgcctggccgcccctactgggaagtgaggagcccctctgcccggccagccgccccgtccgggagggaggtgggggggtcagccccccgcccggccagccgccccgtccgggagggaggtgggggggggtcagcccccccgcccggccagccgccccgtccgggaggtgaggggcgcctctgcccggccgcccctactgggaagtgaggagcccctctgcccggccagccgccccgtccgggagggaggttggggggtcagccccccgcccggccagccgccccgtccgggagggaggtgggggggggtcagcccccctgcccggccagccgccccgtccgggaggtgaggggcgcctctgcccggccgcccctactgggaagtgaggagcccctctgcccggccaccaccccttctgggaggtgtgcccaacagctcattgagaacgggccaggatgacaatggcggctttgtggaatagaaaggcgggaaaggtggggaaaagattgagaaatcggatggttgccgtgtctgtgtagaaagaagtagacatgggagacttttcattttgttctgcactaagaaaaattcctctgccttgggatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccaatccctaatctcaagtaatcagggacacaaacactgcggaaggccgcagggtcctctgcctaggaaaaccagagacctttgttcacttgtttatctgctgaccttccctccactattgtcccatgaccctgccaaatccccctctgtgagaaacacccaagaattatcaataaaaaaaaaaattaaaaaaaaaaaaaaaagaaaacaacgtcaaaataaatcctttctcattttcacccctagcaatcgctcacttggctatgtctatttcagggtgtctgcccacatctctctttatttactccttctctcctttctctctcttctccatagattttctcatctaatgcaaaatgtcctcaagaaggtgggcaaaggcctctcagggttgtagggggtggaaggagaaagaaccaaccatttcctagtgcacgataatgtttcagtaccacggagagcggtgccgggcgtggagaccagggaaaaatctgtcagccttgcgggtggttttcaggcaccatttggagccccacaggtagtggaaatgacaaacgtctacaaagaagctttgcagtaagaaccactctccccagagcctaagagccaagccttacatcgtcacatgcgaagaacagattgcatctgggcccgggtgcccgtcctaatgtcagcctgcttggcatttaccttcctttcccaggctgacctatgaagatggggcaggctctgggggcattgttctagccatgcaaacgctgtggccattgtgtcagcatggaagagctgccggttcctttccagctcaacactgtaattttatcaactctggctcagagaaacctatatttataatgctaattagaagggcacacatttaatttgagtggaagactatttgtatctcgctgagcctgatagcacagggctcaagcgacagcagtcagaagcaaagcaggcctttctgccttctccaagtatttgaaacagggcttactcttgccaaacaatttctctgttggattaaaaagagagagcaagggagagtgctgaatatgctggagctcagaaaactttgtgtttatctcctgcctgcataatatatttctctgtgcactgagaaaacatgcctcttatgttatctaattgtttcctgacacatttagcaacatttcacactctttaaagtgacattaacattgctgacagtggaggtattttcattagatgggctttgaattttaggcaggatgcactgcaggtcttcaaataggcttgtaaaaagtgaggaaggcattatttatgaaaatagagacttggccaacagtgccctgtggatgtgtattaattttgctgactctagtcaatttagagtatgtgtgtgtgtgtgtgtgtgtgtgtgtgcatatgtacatgcatttgtgcacacacacacatataacagcaacttgttgggagccgaactaaaacatcttcattatccagcataccactaggctccgtgagtatcatggaaactcccaaaacatctctccatccacatctttttagccataactaagcaatgtgctatttcagacaaaaatcagtcactttgcacccaatcctgaggatgagtagccatgtggctcatgtatataggcagcatgattatcactctcccagtgtaaagttaaatcctcctccttgttttctcccttcatgcttctttgtgccccaaggccatttttcttatgtcttcagctgtctgccttgatgcatagttttccccggagagtgtcctaagtgagccttcagagaagagtaccttgaaagcacctgcctctgcggggcctgaagagagacatttggaggttcattctgaccttgacgaagaaagtaagccaggcttggagaaggtgaggaagatgcaattcgggttgtgaatttctgctagggcacaacctcacatggaatctcgacccaattgttgatctccatacttgtcatgagaatagaataatatttagacattcaaagctgaagaagagagctcgctgcagactgtctagtcatcttgacactactaccatttccagtcagccctcctgccctaccctagttaaaattactcttctctgtttgcatctccaacattgcaatgactctatgtagccatacaatgcttaattagagagctctgagttcatatcttggctttgcgcattacttactgtataacctttgtcaagtcccgtgatctcttcaagacggtttgctcatctgtaaaatagggagaataatagtaactgctagatggtattgttggaaggatttcgtaaattacaaaccatgacgtgctaaacatactgcctaaaacatttgtgagtgctccagaaatgttagtaaatattagtctcttccatggcaatatgggccctcttgtgactgagacaatgtcatcacatttctttaaagtactgatgctggccaggcacagtggctcacacctgtaatcccagcactctgggaggctgaggcaggagaattgcctggggtcgggagtttgagaccagtctggccaacatggtgaaatcctgtctctactaaaaatacacacacacacacacacacacacacacacacaaaattagccaggcgtggtggcatgtgcctgtaatcccagctaattgggaggctgaggcaggggaattgcttgaacctgggaggtggaggttgcagtgagctgagattgtgccactgtactccagcctgggtgacagagtgagactctgtgtctcaataaataaataaatattaaaaaatactggtgctgttatgtcatagtacaataagatggatggcatgtgttgactgaggcctacagaatgtaagaagtttgttgtgacaagaagctagcagctaggtagccacaataaagaaccctgatctcctaactcctagcccagtactcttcctaactgtacgctagtggagatttttcagatacaaggcaatgatgttcgaacaattgttcagggagggtataaatcaatgcatatgttatccatgtcctaacatcttcctaacaacctagacctagtcctactctcatttacattttcaattctaatttcacaatatttataggtctttgagggggagcttttcatgctttatattggctactggtgggtagactcccaaggcatataatctttagcatcttatcaaggaccattcaatgaggaacgggtggggtactgtgagcgtgggcagcatagagataaaacagtttgagcatctgctgcctagagtgcatgttttatctttgtggtccctaaagcacatagcaaaacacagatttacagttgagaactgtttgctatctgcagacaaagcctttgaaaaggaaagcttccaataatgagaatgaaaacaattaccatttgcagagtacttcaccatttgcaatgcactttcatctatgttattatttaatcctcagaaagtcctgtaaggggaatagaacacctatctcttaccttttttatgcatgataataacacataccatttaattcataaagtttacagaattgtctcatttagtacatttaaaactagtgaagtacgtttccacacatttcacttacctagtagttgaacacagaaaagttagatgacttgcccaaggtctcccagagaatcagtggcagaatcaatatttgacattcaatctgtttcaatgccaatcacattgttacatcagcacttggtactttgttattataaaacctaattaaattctctgtgcactgtggcatgaggtctaaaatcagaaaacctcggttccaactcttcttcccaacgaacttatcccctctgcagttcactttcttcatgtttaaaatgggaaaaagattgtacaacctactcccaaagggtttgtgtcagattaaatacaataatatatgtaaagggcttggaaataatacctggtacctcataagagctcagtcagtctgagcaattggcaatattattgtttctatataccaggaaccgcaagaagtgaacataaaaatgagtaagatgaattcctttgcatcgtggaacatatgttctctaagggagccttttgaaaattgtttcggcatcggcatacagttccttttaatctttctctagcagttttccccccaactaagctcttacaaaatagattctaggacggcaagaaaacagctcaatgtatcttctgcatattactcagcacagacagacaactcagtaagtgacagcattgcccacatagtttaacgccttcatctgaaattgttggattgtcttgggttacatttccccagtagctcctgaaggtgagaagctttcataattagagtcaagagtggaattgaatttctctctctctcttttatttatttatttttttgtagagtgttgctctgcagtccaggccagagtggcacattcagggctcactgcagcctcgacctcctgggctcaagcagtcttcccacctcagccccccaagtaattgggagcacaggcgcacaccaccgagcctggctaatttttgcattttttatagagatgggattttgccatgttgcccaggccagtttcaaactcctagactcaagtgatcctcctgccttggcctcccaaagtgctgggattacagtcgtgagccagcatgcccagcctggaatcaaattttatacaacggttgcgttctaaagtctgaaaattaaccaaaaaaatgtggtcgcgctaccatgcctgaaaatcccttgcttctcttggagactgacatgttgtcacttaataaatctaacagccagtttttcctccaaggagcaccaagtgaagtagtggcttaatattctaggccacttggttaaggaaaaaaacatacatttaaattcagaatcaactcttcttagcaagatacttacacactgagagagacacccaaaacctaagacaacagccatagcagccaacagtgaagtgaatgccatgagtagttgatatacatccatacatgttggtggagtaaattgttataatcaaccaatcatggtgctatttattatgtacaggctctgtactgggtgctaggatacaaagatgtgtatagtgtataacctgtacccaaagtcactcatagtctcaagaatcagccagacatttaggcaagtacataggctaacatgtaacaaaagcaatgatgaaagtatgtcctgggtaccagtgagtgtggtgatcagaaaagacttctaaggaaggttgttcttgagatgagtctttagagtgtcttccaaaggtctctagaaggtgtttgccagctgggcgtggtggctcacgcctgtaatcccaggactttgggagaccgaggcaggcggctcacctgaggtcaggagttcgagaccagcctggccaacatagtgaaacttcatctctactaaaatacaaaaattatctgaatgtggtggtgcatgcctataatcctagctactcaggaggctgaggcaggagagtctcttgaactcatgaagcagaggctgcagtgagccaagatggcaccactgcactccagcctgggtgacacagtgagactccatctcaaaaaaaaaaaaaaaaaaagtatttgccaacaaagagagagcaccttccatgcacggagagagatatgaggagagaatgattcatattcaaaaggacagttgtttcggcgtgtttagagcatagggaaggagggagtctggcacaagataacatagagtttaaactatactataggcaatggaaagccttgggaaagttgagagaaggaacatgacctgagcaaatgtgtgcattcagaaagatgttagcttttgtatgaagggaaggaacacagtgaaggaaaccagtaaagggaaaggtagaacaatagtctaggctatgctgtccaacatggtagccactagccggatgtggctatctaaatgtcactaaaacttaatacaattaaaaattcagtttttcagttgtgctagccacatctcaagtgtccaatagccacatgtcttaaacactagggatgtagaacacgcccatcatcacaataagttctgctggacagcgtcaatctggacaactacacatgaccaacataatgtttttccctttgagaggatctgggaggtgtaattaagctgcatgtgtcaagcaattagaactttctggtgagaaggtatttgaggatccattgccttttggaaaacaggtgtgtcactgcaggtaaggtgggtttgtgtctttgcaagaggaagctgcaaagaagcactgcatttcacctcatgaagatgaaagggctagcattagaaaattacagaaattattttaaaaacagaccctactctccatctatagcctcatctatatttgacaccttctgaagtgcaatgctgccagggagatgtgatatataaatatgcatgttgttggtgagatatagaaacgacacccaaatgcatagggtctcaaactgtgaagatagttcatgcttgagctcctcctgcaagaggccctttaactggggccggtccaacagcatgccacccttccaataaattatgcataagagcttgttcacaattgggatagttttgccagggccatctgaaaacgatttgttttcaagaaaatgcttaactgggctttcgtgggttcagtgaagtgtgagtgaagagggcaattaggtcttccacagtaaaaataaaaacttaaagcgagatgatgtggaatagaacaaacccagtcaggctgatatcgtctcattgagaagacataagaggtcataatgaaaattcctcaggtgaggttgaataacctaaaactgaggtggaacattctctgaatctcctgcctccataaaggccacccaaccctctcttgtcaaacagatctctctcgcctctggggaaaagcatgctgaaacttcccccagtgacaattagacttgctttgaggaaattttgcctctttctgacttaaattccccaatggtaggttaagtttgttttcttgctgttttcttgggtaggggaagaaggctgactgaatcaaatgttttacttctaatatctgcccaatgcttataaactggaaaaaagagcaacttaaaaattgatcacgtaacataaagtatacttatctaaagccatcacacgtagtaatacaggatttctcaacctcaatactatcgatatttggggctgaataattctgtgttgtgggaagttgtcctgtgcattataggatgtttagcagcacccctgtccctacccaccagaagccagtagcaccccaaccaaaaagttcccacacattgccaaatctcccctagggagcaggattgccccagtggagaatgactgagctagtctgacattagcactaaatatagcctgctatcagaaatatagaaggtaggttaatagctttatataaatacataatatgatataaatacaaaatataaatattagaagtaaaatataaatacataatatatatctgtatttaaattttaagatgctgaccgggtgcagtggctcacgcctgtaatcccagcactttgagaggctgaggtgggcggatcacctgaggtcaggagttctagaccagcctgcaacatggtgaaaccccgtctctactaaaaatccaaatattagcctggcgtgatggtgcgtgcctgtaatcccagctactcaggaggctgaggcatgagaatcacttgaacctacgaggcagaggttgcagtagccaagactgtaccactgtactccagcctgagtgacagatagtgagattctgtctaaaaaaaaaaaaaaaaaaaaaatcagatgctttatttgttaggggtcattttgcattctgcaataatgattgatactacagtctccctacctatggtacagtcatgtatacacagcaggtgcttgtgaaccagctggaaccagtaagctgaaagtctcattatttccatctgggtcccttgtccctactgtctgtcaaacactgttctatgggctctacatataacatctccactcttcacaacaacatgtagagtagctgttaatatcatcagagaggctcagagaggtgaactgagttgctcaaactcccaaatagtagagtaagtggaagggctcagtctgctggactctgaattctgtgttctctccattcctcccttgggctttggaggaagataaaactggatgagttacaaagttggggatgaattacacagcacagagatagaaataaggcaggtatgaaggaagaaataaacatttgtaaaagacaattacgtattacatctgttggagcccagggttttatttggagcagggtagaaaatgagaatgggttgggtttccttaatgaaaccaactcataggtgaatttgagtgtaaggcgactctaggttgaggaatagcccattgaagtttatggcaatatgcaaacctgagttcaaatcttgattcttacctttgggtatgttattcacgtcccagagtctctatacttgttgaacaactgacagtgtgggtgataagtgtggaaggggtataagcaaaatcactgaggctggtgttcagcacatcaaataggctaaacagatagatatgctttggcttaacccacttttccagtggtggtgaatgcgatgagatggagacagagagtctagctggcattgttatcagggcacctcgcagcttctgcactagcaggcctggctgccatgacccagtgctccctcaaagcccgtggtgaaggcttgatgaagaatatcttgtcacacagccctctaaaagctgcacatgcagaactacacagaccttgaaaaacccgatgcactttcctgcaaaatattcttatggtcttaatggcaaggagaaccacgttaaaaaaaaaaatcattaaatgcaaacaaaaggagagcaatatcccaggtattgaaaatatttttatttgcatagaaataatgtaaatttttctcactttttgaccccttcaaaaataggggcttcacaaaccccaaagatttagagaaaagtagatactttagtcaagcatctgaataaatagcaggtattaggaaacatcattaggacaactgtttaaatcctcttgcttaaatgtaagtccttttgcaatacttaactttaacacaaaagccatgtttttattaagttcttgaagtcacataggattttaaagttttgactcaagttcttttttctctccttacaaattatttttttctgtgtgagtggggcaccatggttatttccaggaagaaccttgtttctgcccaggattaattacctcctctgggatgacttctattgtgcattccagaaaaggactcatgagtttgggattcacatcttattcatttgttagcacttttgtctaatgtggaacatagtaaaatgaaatactcaaggcttgggctttggagtcagatgacttgggttcaaatcccagctgtgctccctgctaacagcatgatgttaggaaagtcagttcaactaagcctcagtttccttacctgtaaatggggaagacagtcttactaagttcagagaaaagtactgaatgttaaaagaatgtgtatacatatatatatatatatgtgtgtgtatatatatatgtatatatatgtgtatatatgtatatatatgtatatatatacacacacacatatatagtaatatatatattactagaatacttagtacttagctcagttcttgaaataaagcaagatctatatatatatatatatatgtgtgataatgaggtcattgaacttattattttgaatacaattattcctagtactttttttgttactgttatctgagcatgtctctttgcttcatcaaatatcctgacatctcattgctacataaatcacttatgcattgcctacacagaacattctaatatctgcttgccattaatctgttgaataaaaaagaacccgttgttttaagtgaattttgggaattgatctgcaacatgccctctgtcataaattcgtgaatatattaaaaagggttgggcagagcagcaatttcactaataatatttactgctttggggatggagaggagattgtagtcctttggtcttggggaattaagtcaggatccaaatcaacttaaagagcaaaatggttctgtaattaagacaatgggagtgagagcactatggtttcaaccacagatggtgtaggataaggttttcaggtatgactgaaatggatgatgagtgaggacctggagcatggctgtcaaataagcactgtgatctgctacctctccccactccacgtccatgaaatttctaattgattatgtcactgtttcctgccaaatccagggcttcctcacagtccttctcaacacagcattccacacagccactaccaatctatcagagttagcacaaaactggctatcggtactttaatcaggaaaaaaaaaattcatgagttcaaactatcactaaattgtattcattaggagacagataaattagaaaaagttggattagtccccatatttaaggtcatggttaatccaatcacacagataattagtttgactttgatttacatggggatcttgaaaacacttacacacacacccacacatacacaagaccatatgagtttaatgaaaaagacatattgctgcctttgcctgtttcctttcgttttttaacagatcagttgaacctggttttctgtccatttgctggagactctatactcattcaaaatggaactttcaacatagttggagagtcaaggggcttcagcagtacataaagtgggaacaaggtgaatgtctatcacctggttacctgcccatgccacactgagcatttctgtaagaaatcaaaatttataaagtgagcctgtagaagtttcagttttctcccctgtactttggaacctgtttgtgtctgtacagatggtctctgtcagttggaatagtcaggggggaaaatgtagcataagtgaacaaaattagcaaatgacatagcaaacagaaaacagcataccagggctggcatgatggttcatgcctgtaattccagcactttgggaggctgaggcaggtggaggcttgagctcaggagttcgagaccagcctgggcaacatagtgaaactccttctatacaaaaaatacaaaaattaaccaggcatagtggcttgcatctgtaatcccagctacttgtggggactgaggtgaggtggaggttgcagtgagccgagatcatgccactgtgctccagcgtgagcaacaagcaagaccatgtcaaaaaagaaaaaaagaaagagaaagatagaaagaaagaaagaaagaaagaaagaaagaaagaaagaaagaaagaaagaaagaaaggaaagagaaggaaggaaggaaggaaaagaaagaaggaaagaaaggaagaaaaaaagagaaagagagagacagaaagaaagcaaacaagcacgaaagaaagaaagcacgaaagaaagaaagaaagaaagaaaaagaaagaaagaaagaaagaaagaaagaaagaaagaaagaaagaaagaaagaaagaaagaaagagaaagaaagaaagaaagaaagaaagaaagaaagagtataccatttgctgggggcagatctagggactgagaaatttccgaagtaatggtaggtaccagtaagcagagttgaaggagctcccaaaacatgggcttaacgtgggcagaaaaataacaggaatcagacaattctgtgatgcgtattctcaatacactgtagtaaccccaatgctttcattgtgttatgactgctcttctattgtctgtatttgtataaattaaacagcagctctctctgtactatatgaaatgaattcatgctgaacaaaatttcaaaaagttcatgtaaagaataatttcacagcaactatcatatcaggctcctggaaaattgcacttgaacttcagttccacctcagtcactcaaaggaatttaaaaattggcttccagccatccttgttcttcaacatgcagtttcagatatgcctcaataacacaaactttaaagcctattgattgtgagttaaaatctgttcctaccagagcctcgctgctaagtggacgtcaacactgacttcacagtgccttggtcaggattcctctgagttcaggagccttgaagaaggcagagggtaacactgctatgaaggagccactttgaactttataacaaaattacaagaaaaactttgaactctgtcggatgatagcggctgtaaatggttattcaaagaaatgtttcttatttgaaatctggagtcccttgggattgggagatgggaacgcagaaacgtgatctgctgtagatcactctccttcttttatgtcacttcttccctttttttctcaccattctgtttaggcaagcatcatgtaaatggttagagggtgaactttgaaatagttaaacccaagtttgaatcctggcctctgctgcttaactatctgtgcggtttaacctctctgggtctcagtttcctcatgtatgaaatgggaatgtgttatttcattttatgggaatatatgataattctaacctcaagggactgttttgaggattaaattagataatacatataaaggaactagcacagcgagtggcagatagttattgtgtaagaaacatcagcagttaaattactaattataatgatagttatttttgttagaaggagacctgggatgagggaggtattgattaaacattagcactgattctgatcaaactccatcgtgttcagtgtaccttttccagaacacccagcaagaaagtcatgccttatatgaatcccaaacagccatgaatgaatggagtttttcaagtcaaactccatttatcaactggtcaatttcaggaatgatttgtctccatttctattctgttactgtacaggagcccctaacatttaagctttaagagtatctcatctcctatctctgccacccccatcctcaaagggtaatgggccagtggtttgatgcctctgctgctgttcatcctgttttctctctccagaagtcactttcttcctctttggacgtttgctcaggtatcacctttcccaggaatccttatttgactctaaaccccaactcctacctggccaggctgaaacaagtgtctcttttctctgtccccacagcaccacgtcattacatgccgctattctgctttttatcatgtggcactgaaatgacacatttacctgtctgtctcccactagactataagctctctgagggcaggggtggtgtcttacttatttttgtatcctcaatgtctagcgaagtgcagatacattttattgaaccaaatgaacccataaatagcattaaattcactgaataatgaatcagaaaatacaattataaaagcaacaataaaaatggacattgatttgaggtgtctgctgatgtctctacatcagcagtacatctaaaagcaggaacacacatttcttctgtctcaggtacttcttacttgcattgcaacactcaccttgtcctcaagtttgctttctcaatgttctgtccttccttccacacccccagatttaggacatgtgccatgggttgcttctcttggctcattttcctgaacttcccaaatgagcaaaccagcaggcaagcaactgcaaaggccccaagatggaaggatgaagcaggcaaaagtataggtggtgattgtcctcacccagcaatttggctgccaggagctccctgccatgtgaaggagaggatgcagcagcctctgtgtgggaggacaacttcttgacccaagggccgctccatgtcactgagcaccttctgccggactggctgctcctcctcaaggctagagagtctgtgcttttctttgtccgaaaaccacagttatggtgtcccaaaaaccacataatgaagagggtggggacattggccaactctttgggatgccaatgcatcaccctttccatcactcttccacttctacctcaaactaatgagtctagttttagagtaccttatttttggtcattcattcagcagatgcgattctttaggaaggcattggtgatgcagggggtgaataaaataaacaagatgcctgcattcaaagagtagtaagggccatgaagaaatgtaagcagagtagttgcctagagcaggcagatgggcaaatttcaagaagacaaacatggaagggttgattgaagagaagaagtgagattgtgaatgttggcaaggtgttgtagttgggggttgggggtggtgtcctgcatggaggggacaggaagtgtgaagactctgaaggtggaatggcttggtgtgttcaaacaacagaaataaagatgaccatattggctagagaataaggggccacgtggaaagtcgtaagtgttactatgagagtgaggtaggagaggcagctatgggctggagtactcaagacaggtaggtcatcataaggagtttgggtttccttctgcaagcattgggaagtcactggagtgtgctaagcgggcgaatgatacaatctgattcctcaccttaaaatttcattctggctgctgtggaggtaggactgggacaatggggagtagatggattatgtggcaagaatggaagcagtgagaccagcaaggaggtagctcagagagagataatgaggacttagattaggactgtagcagaggaggtaaaagaaactggatggttgctagactgattccatttgagctgtgtacatggatatttctgctcatgtcctttttctgaaatatgcaactacctaaaatatgaatttagacttttggagaaacatcaaaccactcttttaaaaaagcacatctggagcagttcatttctttttttttttttttaatatttatattgtgagctggtttcaatgtaactttcttggggtgctctcgtgacactcattgctgacctttgacccctctgtcctctttcccaggtcgtcccattccacctacatcctcgcctagtctcctcccatctgctcagctgcctagctcccataatcctccaccagttagctgccagatgccattgctagacagcaacacctcccatcaaatcatggacaccaaccctgatgaggaattctcccccaattcatacctgctcagagcatgctcagggccccagcaagcctccagcagtggtaaggaaactccgtggtgtctgaatgtgtggtgtttcgtgagtgacattcttgattctccaccaaaatgacaatgctgaaacaagggctgggggaaggtggtgtggggagcatcagggtgaaatgcatttgtcattttgtggcatggtattttcaagatacatctgtagaaggttgaagttacttaagaggttttgcttatcttaacaggatttgggcctccttcagtggaaggcatttgcccattgctacatgtgtgagcatgctggtctcaaaggtgaagtgcagagagacaccggcatattgaattttgtattactatggttctggtcatagctgagtgaccctggacaccctcacaggcccaatttgtgtgtatctcagatccctggtttgttttttgttttcttgttgttgtttgtttgtttgtttgttttggcttttaacttctattccttgcttgtttagatgattttgaaattacaatgtgttccgttgacatcagtactgaatgtcttgccaagtctgaagtgtttggggggtgacctctcctgtaaccctttgcttgtgacctcactagaatttgacaagttggtggtgtggtactatggtaaatactgcctctaaatccatagttcttattttggttttctcattcatggaacagggaaactggacccaagatcctgtcccacttttgaagattttgtggccactgtcttagctcccaatctctgaatcttgggtggaattgccctgggcccagcgataatcatgccttattttgatttctcctgttggtgttatgttcctgtgaacatctgaacgtaggaacgggcaataactagagtataagtgtccatggcccagggagagacatttgcaaaaattaattactcctgacctaaaggcttgggagttatcttctgaactggtcagtcatgaggttaattagcatatcccatccaaagcaatacagagctttccatgccgagagtgggtcttgatgcgattgtgtttaggctccatccaggagtatatgccacccaccactggcctcaacctctacaattagagaggacctcccaaatacatttaagatgactcattctggaaatggaatgatggactgctacttaggatggcccatgcccttcttcatagccaggcctgatatatttagtaaactcatattctttttcaaaaaaaattacctaatcaaatctctcatcagatgagcaatccattgttgatattatgaaggcctttaatctaccataaatctttattagaactcatcagagcttctagtttgagagaaatgtgattatggcactcttaaaatgacattacatcattggggtgattggtttatcatttggagaagagacatcaatcataactagcataaccacacagtaaatgaattcaacctttctaccgcggaacaatgacactgtaattgctcaaaatcaggcttaaaatgaaatcggaaaatgctctttcttcaaatatgatgttaacttaatggaatatattatgaaaaatcatgtttgaggaaattctatataattaaaaatatgtggaaatatattccctttttactttcatcagaacctgattttagctacagagccctttttttgctgcagagattatgttgcatttaattgaactaccttcgcttatgttttgctgctttttatttcatactatgtaatcgtgatgaatattgtattatgaaggacaagaggcttttgaaatgaggtgcacctgctgatagctttttaaaaacagacaattattagggataaaatgagcttttaaaaactatatccttttatgcatatatggatacccaggcaatgatgatttccataagagaggtcagttcatatcttgaggccatctggaatgttttcttagcaataatgcagtaagtgatttcctttcttttggacagtgtatcagattgaaacttgttgatagggtatttatgtcagctttatgcctaatcaagacctcattttggtggacacaacagatctgtgtgttcagagtcaaacttgtccatttttcgtcactcacaccaatttgttcagctcacttaagactgatagcaatttaagctttagtaacaggagaaaatgccacagaaaatttaagggtccattttcatcccaaacaggagctgtgctgatatgatttcttcaactgagggagtgaaggcccaattgtgcaatacccttgttttcagcaggtacttattatcagagagtttgttaaagctccggtcaacaggcagtcattagaaattctggactctggcttagctaaaatgagagcaaatcgagttcgagtatgcgtgtgctcacgtctgtgtgtgtgtgtgtgtgtgtgtgtgtgtgtgtttcttgtggaatgggtttaaggtccagggcaaattggggattctatcaagatttgaatgcagttgtcatgaatttaaatttgacataaaggattgaaaattgagtttgacacggaagatgcaaagtgcagagctatgtctgagtgttttgaactgagtctgataaaaggggctgaatttttcaggaggtgtcacagcacaaacaaagtggccttgtgtttgggtgtgttgtgtttagttggttaattacacagaattttttaaatttgtctcttggcaataaccctgtgttctgagaatctggtactactttggtctttgtctctttcttaggtgaaataaaacactttccaacacatcagcccatacacgacagtaaaacattatttcctgctctcctcttatagttgctgttattatttgatgttggtgaagcccatcattaggagggtcacagtacacaattccttcccgaggagcacctgttctatagaaacaaatgggacataaactacaggaacgaaaatgtttttccccaacatgaaaaactcctcaaagcaacaacaaagcttcacctttatggcttgagtgtcattattttctatgacagtggtgcattctttagtgaatggtactaaaaccttgccacctttggagtcaaattgctctaaccctcaatctatgccaatcaagtagatacccaggtacagttagtgagatgtttacgggagtggtgtttctctcccccttaagcattttctttcaaatagctgagctccagcgagtggctcattctgtgttctgaccttctgccagagcgggttgctccagatatgtttcttgtatacagaagcataatttcaaatcctatggaataactcatctggaaaaaaaatctagatcccagcagcagcataatggaggcccctgcagatggaagaatgagactaccttccaaatcagaatagggtttgcagtttgctctcagcatatgatgcagaaaatatacaggcaaccacattatcttctaaaagcactggctttcctctacctgtgaaacattgaggttttttttaaagtttaaataaaggggctttgaacactcattagtagcatcaaactatacacataagaaatgtagtaaccaagatgccctagctaggacatcttggtagatcttatgtggcaaaagagctgtcccagtcagagagtctctgtttgtaactgagcacatgaagggtgccctaaccctttttaaagagcaatgccttagttaattctaaatgaaaatagtatatcaaaatcagcaggctttggggttgcctaggatcaataagttgcctgtctaatttatctggcatcataaaacaaatgagattcattcattcattccttttttgcacctccctcataatatgtaacagcttataaaaatcgttactttttttatttttgagacaaagtcttgctgatccaggctggagtggcgtgatcttggctcactgcaacctccgccccccaggttcaagtgattctcatgcctcagcctccctagtagctgggattacaggtgcacaccaccatacttggctaatttttgtatttttagtagaaatggggtttcaccatgttggccaggctggtctcgaactcctggcctcaaatgacccacccgcctcagcctcccaaagtggtaggattataagtatgagccatcacccctggccaacagttgttaaaaaaaatttttttcagctataattagatgatacaataaaggtaaaggaaaaatttaagggagaaagtatacatatatgctcaaatgtataaagtcctattccattatttaagatagagaacttgattttaagcttcctagcaaccaaagcaaaaagggaaacatagggaaaagaagatgcataataccccatgagataaaagcaaatcagtcatttcagggaaattctgggaatcctcacaatgaggccagaaagaagtttgtcataaaggagctcatgtgtgtatccagatgactggattcttagtaacatcatataatacatatgctaatttcctgtcaaaattccttgtaacctcccttaaataagacatagagcgcactttccatgtaaaaacaattctacaaatgtccaatatttgcacagtccaagggcaaaacttgacttgatcaatagaaaaaccttagttcttataaaggaccatgtaaattgcatgccctataggcaatagacctcaaatgtcattgctcataactgaatttttatgggaattagcagactttgaggttaaagtcaccattcaggacctgaaaagcagatgttctgtgttacagattcgtcctgacagcctcatagaggttagaattgacatcctctcatgaaaacttcaggacagcctccctcactcatctggcccctaatatccatccatggagatggatttgggatgaggaagaagtcaatatttttaacttaatgaaacttcttctccttatatatcttaggttttagaaagaaatttttctctgagatattgtaaattttcttgcctccctaagcagattatgcacattgtaatttaatttaatttaggattccctgaatagctcacagcagttattatgcacattgatgattgtacagtgctgataatactatcttgctcttttctacaaaagccattgtacatcctgtggttgtttatcccacttctcctaatgttctgcattgtaacttcttattgtgctctttatcagcttttcttcctcctcccagcttcactccgttcttcagggacctccactgcagtttctctggtgacagattcatagtagacactccgtaagtatttgttaaataaatgaatgagtgtctatagtaaccacctttatttttcactcttgattttggggtcaggatatcaagtgcaaacatcattcactttcccaagttggatttgtaccgcacataagccactttgactccaggttcttccccaagtcccttggatgtctggttcagacattcagagctacctgcggctccttcctggcatccaggcagaggtttggttccagctgcctctcttctggacaggttcttgtcccactgggtagtacaggctaagtccagcatgttatctttgctgtggaggtcacagaaacagccatccctcttgccccaaatgcagagccacacaggacttgggctatcagctcatggccctttttctccctcaactctagttagtatgctaagtactttacatgactttcttcatgtacttgtatttagtccctgccacctcccaatgcatgaaggattatcatcatacccattttctagatgacaaaaccacggcacaaagaggttaagtaatgtacgaaagtcacaaagctggaaagtgaaggatttcggcttcaaccttaaccttcctaattgcagagacttttctcctcactcctctgttaactgttaacctcagaatatttgtttggctgattgagatatacaacagacagtgaaagcgttgtattaaagggcatgggttacaattttttaaagatttcttaaaacgaaatacagcatcacaaaataccctttacgcccactgtttggcaaacacacatatccccagacacttcccctggagattctgattccctaagctcaggaggggctaaggaactctgcatttaccattcccttcaggtgaagcatgtgctctgacaagtcttggaaccattaatgtagtgggaagctctaaagtgaaagttggaaaacttgagttttcttcacactgctcctgattcacagcatgatttttgtcaagtcattcaatcattgtattagtctgttctcacactgctatgaagaaacacccgacactgggtaatttataaagggaagaagtttaattgactcacagttctgcatggctggaaaggcctaaggaaacgtacaatcatggcggaaggtgaaggggaagaacagcaccttcttcacaaagcagcaggaaggagaagtgcaaacaggggtaatgccagatgcctataaaaccatcagatctcatgagactcactcactatcatgagaacagcatgggggaaactgcccagtgatccaattacctccacctagtaccacccttgacatgtggggattatgggaattacaattcaagatgagattttgagtgggaacacagccaaaccatatcaatcaccatgaacctcagtttccctatctgattagattgagcattggcttaaaaggcctctaagctttcttcttgttctagtattctgtctctgtaagctccttgcatctggctggaccaagctgtcccaatgttagaggctccccaactcctcctctgtatagtgtggatttcatcccaatatctgggacattgtcaaaactaaggcctacacagtcatgcaaagcagatccttgtaacttacatgcaaaagttgagaagagtggttttggtatgctataacacttggctgaaaatgttgatggcaatcccatcaaggagagaaagtacagctccaccaacacaaacctgggctcccaaagaccctcaccctggcctcctaaacaaggtctcccacctcaataattgggaacaaatagtcctcaggactctctcggcattgttaacttgcctagcaatgtaccaaatagagatcagacttttccttcttttcctttgtgccttcttgaaacagacaaatactgcacatgtgcacgtgtgtgcacacgcacacacacacacacgtaaatgtgtagtttgtaggtccagcaatttccagcccaactagggtcaggaccactcttctgcaccatggtgcaaatgagcacacaatcaagatggacaggtaattcctttggagatgcacagcatggaagtgacagacggcagagaactgctctttctcagcaaataatcttgatattgacaaaattctcagggtcgataggcattgtgtacattctacctctccatttctgtccctggcttcttggtacatataaaaagatgtcctaggcaagcccagagactgggaactacaagtgatatcttaacagtttcgtgccctagtaatttttacccagaacttcagcttctcgcaaattcacttaaagagtacattcaattctaactagcttcctgcgtaatattcaatagtaatttttaaaagtgtccccagtcccttgttagggatgtctcaattcttgggttgaatcaaaggatttcattattttagcagtgggtagtttcaacagaaattatagccccagccctgggtacatctcttagacccatacccaaaataatcatgaagagtgtggactctgacgtccatactacatgctttcaaatgatagctcagccactttctaacactataatcttgagcaacttacttaatctatatctcagtatttttgtctgtaaaacaacaataagtgtctacaagtcctaaagctgttataaacatttaaatgacattccgatacatctaaataccgttaaaagaggcttagacaattgaagcaatgattgggtttgagagtacttgtttcctaatttaacaaacaatgttctattgtgggcaaatatatataacatgaaatttaccatttatactatttttaagtgtagagttctatggctttaagtatgttcacattgttatgcaaccatcaccaccatccacctctaaaacatattcatcttcctcaacagaaactctatacccattaaacactaactcgctttccctcagcccctggcaaccactattttatttctgtctctatgaatttgtgtctaggtacctcatatcaatggaatcacacagtacttgtccttttgtgatggatttatttcacttagcataatgtcttcaagtttcatccatgttgtagcatgtaattctacaggacagaattttcttccttttaaagctgaaaactattcaattttccttatataccacattttgtttattcactcctcccttactagacacttcggtggtttctaccttttgtctattgtgaataatgctgctaggaatattggtgtacaaataattgtttgagcacttgctttgacctcttttggatgtataaccaaaagtggaatcattgaatcatacagtaattctatacttaattttttaaagatttgacatgctgttttgtacagtgtctgtaccactgtacattcccaccagcaatacacaagggctccagtcactctacatcttctccaatacttgttaccttctgtgtttttgataatagctatcctattggtgtgaaatggtatttcttcatggttttgatttgcatttctctaatgattagttcttttcatgtgcttattgcctgtttttatatcttctttgaagaaacgtctattcaagtcctttgcctaatttttaatcagatcatttgttttttgttgatattgttgagttgtaggaattctttatatattctggataccaattgcttatcagataggtgatttgcaaatattttatcctattgcataggttgtcttttcattctttgatggtgtcctttgatgtgtaaaagtttttaatcttggtgtggtccagtatatctatttttacttttgttgtctatgcttttggtgtcatgcaacaaatactgttaaaggcttattctatggcagccattgttctaaatttttacaaatggtaattcatttaatcctcaccactgagaaagtgaaaagcagctcttgattctgggaacagacctgacaataacatctaggcttaggtgcattaggagctggcttgtcactcacaactaggttgtagtgttctcctactgaacataaacaattttacagaacccaagcacgaggccactccatggctgtggtgacatgaaataagatgacaagaagaccacaccatgatcttgccccaatacagacaaaaccaaagtcactgtccaaaaaacaaaaatacaaaacacccttctctctaggctaaaatgggtgattactggttttttgttttgtttttgagatggagtctcgctctgttggccaggctagagtgcaatggcatggtcttggctcactgcaacctccgtctcccaggctcaggtaattctcctgcctcagcctcatgagtagctgggattacaggtatgtgccaccacgcccagctaatttttgcatttttagtagagactgttttcaccatgttggacaggctggcctcaaactcctgacctcaggtgatccactcgcctcggcctcccaaagtgctgggattacaggcatgagccactgcacccagcccacaagccctttctaacattcttactgaagctcccttctggctccccttgtgtgtcttctccctcatagcaatgagttaatcaactgtgtttggccacagtgtgctcctgcctggtggtgttttggctagaggacatggacaccattaagctgtgaattgggattattatccctgttgtacaggtgggaaaactgtggcacagtgaggttaagtaatttgccataggatacatagttattaagcagtacaagaacttgacccaaagaaactggtctccagagtgatatatagaaatttaagtgaatttttaaaagacaattccagaaaaaatatatatattcaagaaataaaatgtagtcatcatttaccgcatggcccagctctgaatagcatttacatggccacagtaatgtaaacattgaataatgacttagctattaaatcagaaggatgagaggatatgtgggctgggcagatagaggaaaaagccaagacctgcatcttttatagtaagaagttacaagataatgcaagaagttactaaataaaatggaaaatgcaagaaatagcagcaaagcatgttatttatagaactggagataaataccaaaataattagctataaaaaggtaaatgtggttgctgctgggaaggaagaaattggcggtgatagaagaagattgctatttttgaactgaacgttatagaacgatttaattctttaaaccatgtgcacttttttcttctgatgaaaagaaaacatttacatgagattgggcaggcaaaacacttagtacaatgttaaaaccccaaaatagtagctgtttacttctctcaaatatattttattcaacaagtatgtattgatcagggccgatgtgtttgaaatgacatcaggtgctgtgaacctcagtagttaggcattggagcacttgcgtcaaacccacagatgggtctgtatctgcctctgttgattagggagccctgtggagttgttggggctttagctctttttcccaacacagcttaggatggcatgagaacagagaagatatcatgactactattcctcctcatttctaatccagtgtccatctaagcacaggtaccatcatttcctcagagctttcccaaccaacactgcccaactagaacttccctttttcagaattacagaacagctttatagtctgccttattcaatttagcacctcattgcattctgatttgtaatattctcttggcatttcatgcatgtaagtcacttgtgtcaacattaaattgtcaccacttaaagacaagggtcatttctttggtctttttgtgtcccttagcacatggtgcaggtagagatacgctcaagagctagatccttattgatctaccttaagaaggacaatgttagagtggggcaacaaaaaggtggcagcagcccccacccagtccttcagatttgggcctgttgactgcaggtcactgtaacatttttagatctgagaccatctgtgattgtggatgtgatcacatttagaaagaacagaaaaaataccacagggcatgatgagaaaagaagtgtgtttgtctaacctgcgtcttccttgggaaggacagagaggtgtgaatccaaaataacagttctttcttcatttgtttagtagctgctgtcctgagttgatgttgccttggaaatagttgctttcattgataaatgttttgtagggtacagctacaatcctagggaatgcatgcgcttagtgtatggattcatttgctggagctgccctaacaaagtaccacgaactaggtggctgaaaacaactgaatattattctgtcacagttctagaggctacaagttccaaaccatgctccttccaaatgccctagggaagagtccttccttgcctcttctagcttgtggtagctgccagcaacccttagcattctttggttgtggcagcataactccagtccctgcctccaccttctaatggccctcttctccctgcgtgtgtctgtcggtctctaactctctctccttatagggataccaattattgaatttagggctcgtcataattgtggataaatttatttgaattaagtctgcaaataacttcacaagatccaaataaggtcacattcccagctatcaagagtcaggacttcatatcttttggggaaacacaattcagcccacaacagaatccaattgaatactcagcaggatagagcaactagaaatagctccctatgtcttctctattattgaacccaccatgctcgttgactgcattcaccattagatttaagttctttgaaggcaagcaccctgtttcccttgtgtctcatttcgttctatgcatttagctaccactgagcctggcacatagcaggtgctcaataaatattaggtgaattaacaaatagtgcatgcagtcaaaggatggaggaaaggtatgcagagggtatttgcaatatccaaagaatggtccaaaaaaaaagtggaggcagaccctttctcacatgctggctccctctatctgcagtaggagagacagagaatgaagaaggcatttctggatgatggcatagtgcaacatgaatggcaaagaaagccagaagcaaacagagaaaaccaatgtagttaatatttaaactctagaatccaaataaactagttaaacatagaaaaactgttttgtgtggtgctttaaaattctagctcaggcctttcctttgattcccccagggccaataccagctctctcttttgtcatttccatcagatcttttgttttacgatttctgttgcttattatccttattcctttctggtgtttataaagccaaagatgagggggcacatgcattcttgatactgaagcatttaggcggttatcacttaaattaatgttttctgctagagttatattttagtggaaaacagtaattgtttctaagacagcatcttggagttgaaccaattctatcagtgaacactcaaccatgggaagctaacaataaaatgcagtgatcaatcgttcttcttttctctcttccactccaaaggcagacttcacatctctttgctttaaaaaacaaaacaaaacaaacaaaaaaaccacacaaaaacaaaaaaactaaactgatgatagagcacctttttaacacttcagcagaacagtttccccatagaaaatgacccccaaatttatctttattgcgacttcccacccctcaccctcacttagaatttacaaagatgcctttgcgtaagttataaccttgcaaacctctgcttttgaattgtgttgatgtccactgtggacggagggctgtgggacaggactatcttcctgcatgccagctccccgaataattccacgatgcaattggtggcattcacacttgactaggatcgcatttcaatctgttccatctgattggataccgtgttttcttcccgtctgtggtaatggagcactcgttcccagttcccaaggttattttcatctcaatgaccttttgcatctccctggggagcctgaccattacccacccccctttcactctgtctgcttagaatattgctttacatgtcgctcttcctgtagtaaccactgtctttgatacattcctatcagcgattttgttcctgtgggagcagtgatctttaccagtttgtgactctccctctttctctgtgggttcttctcgtggtcttacagctcagttcaagcaatttgcttttaaagatgaaaagagataggctgggacaccacctgtttacgacattaggatgctgggtttctgatttcttttgctaacctgcgtgccttctcgtgaagactaaaaactggttagaatataaaagatggaggatctgttgtgaaaataattcacagggaggggaaaaagtcatattacactaggcagacttggccttttctgccgctctttattgatctcaaattgctgaaagggttcagaagataaaaagaatctgtgaaacaaagaaaggaaaccatggtgaagaaagaaacggccctgatatggtggcagccagagaatccgtctgagtcctaattctacccaaaactcacggtgtcccctgggcagacccttctcctcttgggccctctgttttgtcttttgtagtgttgggaggctttgagtcagatgttttgaaagttcttttccaactttcaaatatcatgattctaggaaaagactgagaactaggcacgacacattattccacttccaatgatgtgctgagtcgccgaatctgtcgcctctctttaaaaacacacagaaacaactttttcctcccaaagggaggaaactaaagctgttgcccctttctggattggtgatgataatgatattaaataataatcatcatcacttatgtttgtgtaatattttctatttcaaggaacaagatcatgtcctttcctttaggttgcaaacatctgacccttggtcaaaggagcttgcaaaccagtttgatttgtcctgcttggtattatttttaaaattatgctttatttaggtgacaatgttgaaaaaccaagagacgtacataaacattcataattctatccttcctgaaataataacatgcctagtaatacctacctgcattatgtcatggccacaaatcactagagtccagtagagactgcccgtttgagatcaggcatgatcttttaatttattcatgtatgagatttgcatggcctttgtagcatttgtatcttcaatctcagttatctagcttgttggcatcaatgatgatgataatgataatgatgatgatgttaccactgctaatgtcattaacaataatctccatctccatgttggcacaccatctttacttttaggaaacactatcatgtgtattacctatttaaatccccactacaaccatctggtgaggaagatgtagaaggtattattatctctacttaacagataatccatttgagggataaaaatttcaagtgacttactggtggaccatatttagtctaatgatctcaaactttccactatcaaggtctttttaaattttcttaatgtactctatgttttgtaggacttggtctacctattcacatgtatttaaaaaaaataggttgtttacttattttgtgttacatgaagatatatagatagataggtacctctaacctctactctcaatgatgtatttgtttaccaagtacagttgtaactgctaatagacaaattttgtggttcctttgcacaattactctcttttttgtttgtttctttgtttgagacagagtctccctctgtcacacaggctggagtgcagtggtgcaacctccactcactgcagcctcagccttcccagttgaagtgattctcctgcctcagcctcctgattacaattactcttcatttcagtgctttcctagctggacttcttaacaagtacatacaattaggaggaaggaaagcttaagtgggccatgaaaaggtcaggtgagttttagggatcctggacccaatatccttattacatagctggggcttatgctgacccactaagatcagtgctaagggagttacaagcagaattcaaactcaagtttttgttactgtttttatgtttgacacgggagtatacagcatgggagatcacctcacctctggctctgaggttggtactcagaagctgtggactgtcagcatattttgattaaacacctatcatgtgtccaccatgtcacaggtgctgggcattgcctgggtctgaagatctatcatcgcatctgagccaggtccttggcttccttctggcattctgtttgacactgatgagttctgagaccttgctggccttgacttgcccacttcctcacagcagcacaggctcagcatgagatcctcttttccagaataacccagagacttcctggacttgattgagttgtagcttgctttggaaaagattccaacttttacaaagtgaaatttcctatgctaagcaaactctatttatattttattgtattctgttgtcagatgctgcaagtacttgaaaggagcttgtgatataacatattcttgattgtaatatagcattgtaagcacattatggactgaattacaacatttcatgagaagaaaagagaagtgctacattaaacgtacacattattcataaagcttctaattccaggaaaattaaacttgaaaaaattattttccagaatggatgatctgtagcacataggttcttataagtcaaatacagttccttataaatacatggaagatatgtgcccaactcatatgcaggcctagagtagtaagttttgcacaacctgaatcaaattaggtcagtcttctaagaaacattcccatgttacaatgcaaccaaactttaacagggcctctaggcagaggagtggttttcctctcttgggtggagaaccaaaaatgtagcactcttcattgtcaaggtgtatagcaaagcatagatcatgaggggagagcttacacagaatggcatggcatatgccatccagaatccactgtgcagctgcttagggataggagtgtttccattttcaaaaccacataagtttcagaggtcaagcttagcaaagcagcttgaaaagtgtgtacttagtaggcttggggaaaagttggaagcccatgccctcattttgcctcgattatagttctgcaaaaaccctctcttaagagctccaaagtctatgccttattcccttccccatttggactattgttaccctgggcaagttctttaattaacttctctgtgttttagtttcaccatttataacacagagataattatacttcaagataatgtgtggaaaaaaatacctctccattgcacaatgagaagtggacatgcaagttatcatgattgtttattaatagcaataacatcccacatgaacagtggaatcagcactcttccccacagaactcagaacctttgtcctgattaactcattatgactgacattaactctgagattttgctggcggcaatgtggagggagagtattaccttttggctaggtttcttcttgtcctgaggtctttttattcttcatcggcacctcctgtaagtaactgggtttgggctgctcagaaattcctgtctgtgataaataagggaaatttcagacaggatggtaactccatagctattcaggccaaagagttggtagaccattaaaaacaattcacatccttcatgttctgggtttaaatatgcatatttccatggtcttactccctccaaaattggtcagaccagttcaaggttggatgacagatgtgagcaaatcagcgtcagacaagttgagcagactttaacttcctatattgtagtagaaaattcctctcataaaacaacgaggcgcacgtatcaagacccctgctgtgtccaattagacttctttaaaaaggaacaacctctttaactctgtgagtttctgggggctgtttatcttttccttttggcttatcacaactcttaaattaccttggcatatgcttcgttgctagtattttcttgtattttctttttttccgttgccacaggaaacaaacaaaaaaggtttttttgttgtttttttttttttagtaagaggcatttcaagaacgtgttagagggagaaagaatgttgcttaatgaaataaagaagagataatttccaaacgcttttaaaactacatagtaggacaatcattcaagtatgggatgcacccttaagcaagattaggtcttatgggtgacagaggaactaagtttggtgtgtcagccttgatttcttattaccctagttcctgcgcttcatacaaatttaagatccaagcaattatgcctaacgtgctcttgaatacggtaaaatcatgcattttatgtagtcagtaataaaaatactgcagtcgtttttccatccaaagatacagtcccattatgaataatgagtcctagaaaaatatagcaaggtagtccaatgcggcagcataatcatttatgcatctaccaaacctctttcacagttcaagaagtttaatagacgatcaattccttgagggcagaagctttcttatttatctttgtatctttgttacccagtaagcaccattcctggcacatcaaaaatcacagatgatggatggatggatggatggatggatagatgatgaatggagaaaaaatacttccctcttttggtctttgaagtttctgggtattaccagtgaagatacagagtatagggcaaggttctcatacctaacaatcaggccaaaccagcacgtttaataaaatgttttttcattgcccttagaataaaacccagatcgtttattgtggctagtgtgatgtgatttggccacaggctaacattcataacttcagctccttccattctccttttctctccccactctgtgactagacttctttgcattctttggaaacatccaaactctttcctctgacagccttgtacttcctgttccatctgcccagaatctttccccctatctttccatggctggtatggtcattcactatactcaaatatcattccttggatacccctgccccatccaaatttgttcccctcctccctttcagtatcctcaacacccaacagtgccctgcacttagtatgcactccataaatatctgttggatggttgacaaattattgtgcatattttgcaaatatttaatgttactattgtatatttaacttaaaaattactgaggtttttcttcttcccaaactccaattaaaaagcaaacaaccaaaaactcaaaacaaaggtgaaaatgtttcttttgttttattctcgtaacttactagaagctaagaggttgcctcttctactcaccctggaaagaaggaaggaaggaaggaaggaaggaaggaaggaaggaaggaaggaaggaaggaaggaaggaaggaaggagggaaggaaggaaggaagggagggagggagggagggaggcagggaggacggaaaacttagaaaagactgaattaaacaaagcttaagaaaaacagagtcgtaaaacttctcagggcctttaacatgtttatgtgaactgagactttctattagaatagaggctttacttctcaaagttatttgaccagagagcatttttcctcctcctctccctcctcctcttcctctccccctcctcctcttctcctcttcctcctctccttccttcttctttctcagagtacttttgagactaatctttgatggcatacattttgggaaacaataaagtaggaaccaccatctgctgagcattttctgtgccctaggcactgtactaggcattttaagtttgtcacttgctttggttctcgtcctttcattaatgaaggaaatgagcctcacagagtttagctaacttgaccaaatgcatgtaaccatcaaatcaagcacagcagctacgatttgaaccattgctgcttgattccaatggctttgatcttctcactgctatgtactacttcgcaaaatattacttctaattaattaaaacagaggttctcactctcaaatacatacaaagcttataaaatacaaactcctggaccctatgccagatttatttaattcactatgtctgagttgggatccaaaaatttgcatttctagcaggctcccaggtgatgcctgtttctctggcctggggcccacattttgagaaccattgacttaaagccctgcgattcctgtttaatgatctttgcaataatgttattagaagcttaagaagctgaagactttttcaattagtttatactgcctttgttaatgcagagaactagataacagggagctcaacaattcatttcaattccacaaatgtttattgagcatctactgttatagacgttatgcaacatacaggaaatctgagataactaagaccaggtacttggccttaagggtactttagtctagttaatggcagcatgaggtggatgaagctttaagaagaacaaaagcaaacagatggttgtgagtcagcaggtcaggcagtctgatagatgtcgacccagtgccagcatggcacatcgcggccctccccacctgggctagagctgggactggggaaagccttcccacagagatggcacctgattggcatcctaatcatgatcagtagtcagctggggtggaggattttaggaaatgccagcagcaagtgcaaaggcttggagagacgagaaaacatggggcctttggggaaagcttgaatagctaaaggaaagactagcacacagatgtgtccagatttaggttagcagaggggaatgactggattgaggctggaatctggctgtgaaggcccttgtctgccttccgtggattatacacaaaagtcagagcaatgtttaagagaactcatggttgagacatgtggcttccaaccattcttcaggcatgcattcctttcataaataactttgcaaccctactggctgatgagggcggtacaaagaggattgaaacactgaatctgtcctctaggaagagaaataaaacatttacaatctaaaatccaatacaaaggtggaaatgtgcccttattaaaaagcacggagacataggaagaagtcctggaacagcaaagagggaaaggtcactccatttatgataactctggtaaaagagtcaaagatgggaagcaaagcaggtgccattatcaacctcgcaatacctttatggatatttttacagatggttctcttagtcacctcaaagagtgccaggatagaagctgggaagtggaaactccgaaagctgttagagaggaattgcctttagaatcacgcttgctttttcctcgttgctaaaacgtccagaaaatagctagcatgtgcgtttccccagcctgattaaagagtgcatgtgcaagcctctaaataattgctgcatgaatctttataaccacccgaaatgagcttaactcggttggtctacgatggcagaaaggcttataatgtgaggctcatcattctatcacgcatcaaagaatgggaggcagaagccctgttccattctcccctcgcttcctgattaatccacacttttagaatatgagtaagggctgactgatgagctggtttagtttagctttgtaggatttttcctccaatttagcaagcaatgaggacccgcactatttctactctttcatttggctcttaagtctcatttgtgccattagctgaactggtaccttttttttttccctcctgctcagaattcagagacttgtccttctcttgtaattataaagtgctcacaatcaagacagccctggtaaacttttctttttggcacaaaaacaatattagctaaagagctggttgtaacacagatgcttagaaaaagtaggaaaaaatcaggtcttaaaaagatttataaaccccattccagcttgtattcatcatcttcctttcttgctatacaccctggagaataaaggatgctatttacaatgatccctgtcaggagatgttgaatacagacttatctgcctgccaggtcacaattacctttaaaatctaaatgaaatgaaggaagagaaaccgcatttttcccagtaatgggatattccagccatagtctcattggcacccacagtctttgcctcatttgtgagggctgcctcaggtttgtcaaagggtccttattttagaagaaagatatacagatatatagatatatagattgatagctaagtaggtagatataggtaggatggtatggagagaacgaaacagagaactaagtttatgagcctgggaatttcagttgggtaatccgtagtaaattgttttttttttttttttttttgcatctgctgggcaccgggtactaccttaaacattggaagcagcatgaactccagccccttcgtggtgggcaaagtgattggagaggcaagagatttgcacacagaagacatgacttccccctacctcctgctgatctgggtttgtcattgaagagccctttgctatagcattgcttaggactccttagtttactcaaacctaatgaaatgtggttttcctctccataaaccacctttggatgttgccaatagagagaataatttactgctatggttctcaaattttggtcctcacagacaaacaacatcaccagctcctggaaactagttagaaatgcaagtcctcagcactctacctctctcctttccctggacctagggaattggaaattctaggggtggggcccataaagctgtggtttaaccagctttccaatgagtctaatatatgctaacgtctgagaagcactgatctagtagcttggacttgcttagctatccctttaagcttaaattggcagcctaggccagtcactggaatcacctcaggagtttgaaacaatgtaaatgccgggatgccaacccagaaactctgatgtaatagggccaggcagcagcctggacaccacagtgtttaaaagctgcccagatgctcttgagaaagagttcatatggaagcaagtgtaagaggagctgggggagagagactggagatgtacagatatttagttgattactgcaagacctaaaccaggctctcagcattaaggagaaccttgcctaaggctaagtcactgggtataggagttgccagggacttcatcaggaaagaaggtagagagccataggctggatgaatgtggagggaaatgagaaggaggagtcaaagatagctttgagttcttgagcatggctagtgtgatgagcccttcttaggaaaagcaagaatggggattgggagggaaggagatcttcgtttgagcgggggatgggaaataaatttgaatctgaaaaggcgtggattggctcgatggtcatatccaacagacagctgaaactttgggtctggatttcagggaagagaggcaagagggaagaaaagaatggaagggaagagaagatagagaggaatgaagggagggggaagaagagacaatgagaaacactgagagagattttgcatttttaaagcctgtgacaagaattccattactgaaagaagagcatttgctgaaaagagaaaagaggagaaagaggaccgaacctccaataatgcctgcatgtgcaggggaaaaaatagaaagagaagaagaaagcaaaaggggcaagagttaggagaagagtcacgttaatgtcgcattatcaaagctaaagaaagagtaggttgggggatgggtgcaggaaaggtcaattgccagcaataccaaacgccaaagacaggcaaggagggtgagatatttcaggcaagaagaaagcttgcaaagtcatcatgatagcatagtaataataacaataataataataattggtgttcacaatggatttatcgtgtgccacgctcctggccaagtgccttgcgttaattcaacaacaactctccaagtattaggtatccccattttgcagatgaggtaacagagattttaggtaccctgcacaaggttacacagataaaacgtggtggagtgaattcaggaagtccagctcccgagagacacctgacctctctgtggaaaccagagtgactcatttagagggcaacactcagtgtgggtgggaaaaccagtaggtgccggaaatctctgtccatgtggatgaaaacatctccctggttgttccagacagagttctattgcacaggaagcagattccctttctggagtgaatgttgctgggcacatgaccaagtgcccattaggatggagcgaaagaacggcatccgactcttacaaaaagttgacatctgaacaaagagaaataaaagcaagtatgttaaattaatttgaaaggtcttgtttaaatccactcacgcaaagacgttctcaatttaaggcttttattctaccctaacctcagttagttagtgtggcagctcagagcacattctggatgatgccaggaaaaattcatttcacacctgaaatgcttagatctcatgccgtttcttacagtatctttctgtctgtgccctcaacccactaaaaaaaaaaaaaaaaaaaaaagggggggggggttttggaaaggaaaggaatgatatctttctccggaaacattgcactgaggcaaacgttttccctttggtgcattaggaagcccttagatgagagaagctggtgagctatgaaacagcattgggacttctcttgcaattaaaaaaaaaattatcaaagcactttccatacatgaaaccaccgtcagttatgtgggggaggaattattatctgtgtatcatgaaggtggaaattacggtactgagaggttaaatgatattcccagcaggcaagagaagaaacttttccaggcttggcatgaggacctctctgtttgtatatgtgttcccattagggctgctctgatgatccaaataaaagttgggagtgggggtaatgatttataagcccaaggtttttaaaacatcatttctcatgtttggaagtgaaagttggctgtgagaattcatcgaaaatgagcctggatagatgaggctgatgcagattagtttttgaagtggaaggactggaggattggccttgttttcaaacggctaattttcttgttaatcactgcgttggttaataaccacctagttatgaccgtggcagagaaagactgtctgaaataggtcaagccttcagtcagcctggcgtgtcctgtcttgattgaaggctcaggaagcaggaagactggagtgattggggtgggggggtgaggtgggattgaggccttgagaggagacagcagtgaccacctgggggacttttctgtgggagattgacaggactggatgtactcctgaggagtcctgcggggtgggggacaggaatgtaaaaaaggcctgagatgtcttttttggaatatgtgtgccttttaattccttgaattttttttcattaataacatgaattagatatgttttttcctacattctaagaacacgacagaataattggaatatgcatgtgcaatttaagaagacaatgaaaaccacccaaaattgaacacccagagatgatcactgttacccttttgatatataacttccttttctctttctctttctttctctttctcacacgctttttcagtttatcttaataggtcctgactgaattgttagcacctaccacggttcctagcacatggtagatactcaataaatgttgatgtaaggatgaaaaaaatcatatttatgatttgtggtatagaattatataataggtattacctaattctagatcattacatatttttacagttttcaaataccaggctgagctattacctaaggacacttctatcatatggaaacatacagcaccatgaaccagcacgcagtgacactgtggtctagagtttgggttctgaagtcagtctgcctggattggaaaccagactccaacacttaactagcagttcttaatctgtcaagtaggagcaatactcataacatctcataacattattgtgagaaggaataaattagtgcattgaatgggcctagcaccacacctggtacagtcataattgcttggtaaataatagttattgatattatagtatgtttttaaatattatgctagagcaccgtattaatgttcttccatcatgctggcacatcgcaatttttaaaaatctacccccttttgacaggcatttttgttgcttcaattttttgttatgtaaaatactaaatagatcctctttatataagaatttatttgcatatctatacttatttccttataataaaattgtagaggtagaaatataagatcgcaggcaattaatctttttataactttatatgttgccaacaaaatgtgatattagcatagaaagcaacggtgtatgagcgagtctgttttcccatatcctaagtaatcgtcctatcctttgcacattttatgcaggctcattttgaggagcaaatccccttccatttcttgaggccatcttgggttaggctaagtggaattctgccaacatgcaacagatttttaggagcaggttctgggtgtttgtgcatgagagtggagtggggagtggggtggggtgcatgggcatgtaccctctgtcccaagaagctgcagtgagtatgaaagataccagactttcaccctcagtaaatctaaacactcaaagcaaagtgtaaaaagtgctcgacaactgttataaaggatttggaaactgtcttctcaaggtgtggactggggttggaatctggaaggctggctggagaaaagaactctgcttctgtcattggtgcagttggttgccttgtcgttttaattaccttactcttctcaagatcagattcaaggccaatccagcctcctcggcccctagcttctgcctccgcgacacagataacataactcacttcctaactcacttcctggggctgccccagcctaagaggattaatccgtcctatggagttacctcctcaggaggaaaactgataagacggttgtaaaactcctgggagaaatggaatgagttgtataaataaagtgttatggcagccgactcatcgagaatgagacccgatgtcacttaaatgttttgtcactctctgtatcttatgaaggggaacctgttttcatattgcaatacttcagctctgcctggaaagtgatcgtgtgtgacagtttgcttttgtactcccccactttatataaaaggagcaggacatttaggttggctgtatttgttctgaacaggaaaacaaatctggcatttttacatattattctgtactcctgggaaaaacagctttgacagcctaaggaaaaggcagttcaaatggtagtgattcccatgaacgttttgttgcactttaagtaaatctaccataaatgataagtatttgagatgatggatacattaattagcttgactcaatcatttcatattgtatacatatatcatagcatcactttgtaccccatgaatatgtacaattataatttgtcaatattcaataacatttcaaaaacaactagaaaacatatatataaaagatgccttcatgcaagaaaagagtaaatcttatatttggctggatggtgcatccattcagctaataataattgtacacctaccccaagccagcactgttataagcattgtgagctcaagagtacccaagaaagatgtggcctctaagctcacgaagcttctcttctaaagtgaaatttaagattttggagtaataaaaatataatgattaccaatgtgagagcgatgccagaaagagacagggtgctgagctagacaatcacatgaagccgcctactcaggtagaatggaggaaaaaaaggcttttgaggtgacttcttagctgaaactgaaaagtgaaatttcggtcacccatgtgacaaggtttgggtggctggggtgggggtggagggtggaagggctattttcaggtcaaggaaacagcagggaaaaggatctaagacaagaagcaggaaagttcttggttgtgttgaggaactaggagaaaatgtgtgcagctccagtgtaaccaggcagatgagaggagtttgaaaggagacagaatagtaggtggatgtcacaccagcagcatcagcagcatctgggagtttctcagaaatggagaatcccaaccttagaccttctgaattttgattatcaagtggttcctgggaaagcacatcaatgttggctaagtgctgatgcaagccatggcaagaggcttgggtttgggatttcactgcagtggaagttattggtggatttaaaatgggatgtggtgtgctcaaacacgtatttaaatatcactctggctgaatagaggattgcagagtggcaagaattgaaatgggggactagttaggaggctgttatagtaattcatctgagcggtcaatttaatctagaccagatgacagagaatttccaagcattgctatgtgcctgggaaggttgtctgctgtctcatggttattggcaagcagaaaaatatatgcctatttatgccccccaggcaggaaaatagaaaattgtttcccctaaattagatactttgtcttagaactcttggagagtcaataccatcaaggggctggattagctgaagtacactgtgtggttaggagcatgggttagaggatcatcagagctgcatccccacctgccaccccacatcctacctggacaatggtgagcaatcacctagactctatgtcttggtttcttcattggtaaagaagggataaagatagtacaacactgctttccttagtacattgatgtgtgtgttaattaagaaaatgcacttaactagcaaagtaatttaataaggcctctataaatgaagctattaatattagtaatattatttcacaataacaataagtacagagtccctaccacacgctggatactgatcgagcttgcatgcttgtatgagttacaatgcccagccccgccccacacagagattacgtgctaatcagaaaacagcatcagaaagtgattaaatccacctttttatttattttttctcatttccccctgtgtctgtcttgtattcagaaaactcagaacttaaagaaagcccaatgtataaaacattttttaactcccaattcatagacaagttaacttaacccataaggagggtgaccaacgctgccagttctctgaggactgtcttggtgctgacactgaaaatgcctcatctcagaaacccttcagtcttgggcaaaagggacagttggtcactttgactttagggtctgtggttgagtcaaaagagcttctttctctcagtttaatagccacagagtacgtatgaaatcttggacaactctttaagcttcaggttctttatctgtaaaactgacatatatatttcaggatatggttataggatagtcagacagcatttcataaaacacatgatcagaaatgttgagtccaaaaatgatctcacggttgcaactattattactagggcggttgtatgtggaaaaatcagaggtaaaaagaaagaaacccccaaatgcgaacataactgtttcctagaaaccctctgtcgatgtctattccatttcccgacagttcggaatacacaggtagtctaaaaaaatcaactttcaacctcatcgttttgtggctgggaaaagggggaaataggcactatttagaaggtatttgggatagatggagttaccacgaatgaatcttcattgggatgggagtttagacctgttgaatgaataaaaatgagccatccttgaagatgattatgagaagctaagttcataccagctcgtaacagtggcacgctgtcagtagctgggctaaggctgagatttttcaatgagagcatctggcttaaaaactccacaggagggggctaggggtagaggaagaaaatccaagaaatccctatgagacctttttaaatttagcactcaaggcactaatataagaatataccagtgtgtggatgagaaaacgagggagtctttacaaataggagaatttgggatatctgtgtttgagaaattcttttggacaaaagtggagaaaatgacattatctgtaattagaaataataatgtgtaattggttcatttgccatatttctacagttctgatttagttgaacaatgtgatcattatgccaccagctttcaatagaggtgtcacaatgaaaaataattgcaatattccacaatattaactgcaccctaattgcaaaagttttgaaatataattaccatgaaagctaatgcgacagggaacattaagcataattagtgttttttaaaaaaaggaaaaactgttaggagcttgttattgtctagtaaggtagcttcaaattagctggctgtagagcactttcatctagcttttctataattttcattattagcacagactgtaataaatttatttgacatagctcacacctgccaaccctgcaggagataacttataatgtgcgccagccccaagatttcccactgaacctgtcagagcttcctacaaggaggcagccaggagtgaggttattttaaaaaaaataaaataaaataaaaaccctcaattgcacattacacagttcagatttaacacttaagctgtgttttaagtaattttcatagaaagccaatgctctaggaatgcaattaagaacctcttgtgggtggtgctaaacaatcaaatcagtgaacatttcaaagaactcctaaggtgcaagcctgctctccagtgactagcaagccgcaccagggagctgacaattagcccgtgcacctgtttgcccaagtgcagcccctgattttctgagaaaggcaccaaccctgaactcagtggccaccatcaaacccctcaatttcttctttgacaaaactactcaaggtcagcattttgaagcaatcacctgcacctcctacccactctggcctcagcctgtccataatgaggcttaagagtcaggatcttgactccacatagaccatctgatgaaggcaaggagtgtactctgggtgggtacacaactccagggagcgccattcacgttgttttttatgtaaagttgtgcattggggggtgttcaatgtgaatggtgccccctgttgtttcttacttctctttttttaggctctctgctaattggctacgttacatccctttgattaaaaaagagagtcaggaaagctaaaaaaagaggagggagtggggaggagcagatatttttgagacctgacatagaatctaattaaaagagaccctccatcctggatgatgcagcagacgacatctaaaataaaggacgcaggccgggcgcagtggctcacgcctgtaatctccgcactttgggaggctgaggcaggcggatcacctgaggtagggagttcgagaccagcctgaccaacatgaagaaaccccatctctactaaaaatacaaaattagccgggtgtggtggcgcatgcctgtaatcccagctactcgggaggctgaggcaggagaatcacttgaactcaggaggcggaggttgcaatgagccaagatcgcaccgttgcactccagcctgtgcaaaaagagtgaaactccgtctcaaataaataaataaataaataaataaataacataaaaataaaagaagcatagcaacttaaaagagtacaagtttgaaatactatattccatacatttacatgtcaactttaaaaactcacagacccttgtttacaaagcattgtatcgaaaggtgaacattgtcattttaaatgtggtcactaataacactaactgattaaaaggtccaaataatagtagccaggaaaaattaataactttcttgatcaagatggcctttctgccttagtaattttgtttagatcaccctaaatatatatatatatatatatatatatatatatatatatatatatatatgtatgtattatcataaattcttaaagcatatttatagagctaagaatttatggctgggtgtatctcatgcctatagtcccaacactttgggaacctggggcaggaggattgcttgaggccaggagttcaagaactgcctgggaaacatagtgagactccatttctacaataaataaattataaaatatatttaaaaaaatttaggaagttatgtattccatcttgtctctggcagccccaccacagagataaaagttccacgaaccttgcattaataaccatgcagccaatttgttaaaatgatgatgccctaacttaattaaatctgatagagctgatgacattgaacctcttaggggagataaagttctccggttaataaagacaccatgtttatagatagataaccataagagagccagtcacgtgcccatatgcctcagtttcctcatttgtaaaatgaggacattcaatttgattatctctgtctgtctgtaaaatcaaagtgagtttttgactagagcattccttctgattgcagatttaatacttctggccaattattggttctcggaatcactctgtcctagactttctcttgttagaaccacacattctgttagtaacagatgagcctaaaaatgttgtctggagacaattggcaggacctcagcaggctgtaaatcctttcaggaaaaaggatccgatcctccctttcccctaccctcccttcccctcgcttctcctctcccctcctctcctctcctctcccctctcctcccctcccccctcttctcctctcccctcccttcccctctcttctcctctcccctcccctaccctctcttctcctctctcctcctctccccttccctcccctcccttctctttccttcccctcccctctcttctcctctctcctcccctcccctctcctcccttcccctcccctctcttctcctctctcctcccctgccctctcttctcctctctcctcccctcccctctcctcccttcccctcccctctcttttcctctctcctcctctcccctcccctccccttccctcctctcttcccctctttgcttttcttctatttctttttctctctccctctctgtttccctctctctctccttctctcttttcccaacacagtcctcagcatataggttctcaacaaatatgccctgaggaaagagaaaagaaagtccaagcttggcagttctccagccagagtgtattgcttgtgtaaagaggaagctaccacagatcagagttaatctttaggtctgcacaccatgggcatcatagaagctttccttagttcagcatttgaggcccataatctgctgaatagagtgcctttcaatttatggaaaggggtcatatattttagtggttatgcatgacttaaataatatttaattcttattatgattcctcagtgtgacatttctgctgaattttatattttcgttttcttttctctctcttttttttttttttttagtaaaaattgaaccagttttattctttttcaaggaagagaattcacttttctaaaggaagaagaggaaacaaactagaaacttacagcatatattttttatctttggtgacacacagaagtttgctttgttttttactttctcctgtgtccgagtttacagttggacttttgtaagggaagtggaccaaatgtgtggtccttgacttactttcacggtattaactacatttcctttgttctgttgcataatgtaatcacttgtgtttaatctcccttctatagggaatgatggattattaaaagtattgctgcaacctgtgcatgtaccccctaaatctaaaataataataattttattgaaagtattgttgcactgccactgtaaaattactcaatgaaatctacattgtcactactcagatattgcccttcatttataattgtgtggtcattaattcttatttgtcagtacattttaggttaagaggttttttacagccttaagatctaatctttatttaacaatcaatcatcaaatctgcatttgcaaagattagaaatctcatttttaagtaaaaacagacaaagagttaggatttgaacccaaagtttagaggactgtattatcacccaaatgcctagatgttaccatgcaaatcaaaaataaaattttgaacaagtagttttattttgaagagagaaacataaatatagaacagacttatctcatggataaaacagaggatagactattaaagtcatgtgtttagggagaaattatgccttccaaagttaatgcctggctttgaaattgtgagtaaggcttttttttttttttttccagcataaacacatctagacaaaatgtaagactctgtgtcaatattttttttgaagggcagattgggcttataattatataatactgacctatgacttgtctcttaggacttccacaaaatgagattttgatctggtacttttggatgtgtaatttatctatctacaatgcaacacaatgaaaatgttctctcatggttttggaattatcttcattttggcagatacaggcacatgtgctacacacttctcattcttgcacccagggcagacatcactaatcgatcacagccctctttcccactgggaacagatggagcctgtcaatatttctcagcggtcctccaggcagctactactaatcaatcagaattggcatgcaagattaaatgcccttgccattcagggcaataatcacagaaaatgacaatcacacagatgtgagtccctggggtagccaaaattccaaaacctagtataattgcctcttcaaaatgtgattaaatatcctctttccctccatcacaagcaaaaagaataaagtcatgcaaagtaggtttggtttgggaggaaaaaagaaaacaaaaaaacaaacaaaaagaaaccttctagcatctgcatttctttgtggctccaagatccgaactgttcttacacaaaaaagacccatcattgaactccactaacttatacctcagttcttatttatttcctccaaaaaactaacctttatactacagttttactattattaaatcactcttccatggagcagatgtttctgaacgcttttttgcgttctttgtcttgaatactcttactaaatagtgtccttccacagaataaaaaaattcctaatcttgaaggagttatatttatagaggaataatttatcctaagttacattaaaataagtaaatccatggcagcacagttaaattcataagagcaagaacctatcattactctcagattctctttggatctctgctaaattgaggactatacaatttatgaatacatattttttggttaaacaaaccctaggaaaaaagcgtatttatgcatcaaaaacctgttattaagagctcaaaaaacgtaaacttcttattagaagatttgatgtttttttcaactacaacaatctcaagaattaagagtaattttatatttccttttgtagtaaggtacaatcatatcatgttttacttgggatgaatgtaactatctatggttttaattgttactgtagaatggagttgtttcacaaaaatgataatccatgttgtagagtggttagtgaggtgagaaactcaagggccgggcacggtggctcacgcctgtactcccagcactttgggaggccgagacggacggatcatgaggtcaggagatcgagaccaacctggctaacacggtgaaaccccgtctctactaaaaatacaaaaaaaatagctgggcgtggtggcgggcgcctgtagtcccagctactcgggaggctgaggcaggagaatggcgtgaacctgggaggcggagcttgccgtgagccgagatcgcgccactgcactccagcctgggcgacagagcgagactccgtctcaaaaaacaaaacaaaacaaaacaaaaacaaaagaaactcagatgacatcagcaaatatctcttgggcacctaccctaggttacacattggaactacaactggagtgctttgggttagttccaggagcactggggcaggagtactcaccatggcgtgtagaaataagtaaattccaacagtcattcacgcagcgaatatttattggtgttagctgtgtgccaggcagtgtccttgtcctccaagggcactaccagactacagaaatacgtacaactggggatggtggcttactaccatgaataattgattttaagtttctcttttacaataagcttccttttttaattaacaaatatatatatatttatgatatacagcatgatattctgttatatgtatgtaatggatatgtccataatgttatggaatagctaaatcaaatcaattaacatatctcttaccttgcacactttttttgtagtcagaacacttaaaatctactcatagcaattttcaagtatataatactttgttattaactataatcaccatgttgtacaatagatatcttgaacttattcctcattccaattgaaattttgtatcttttgaccaacatctacccaatctccaccttccagcccctagtaaccaccaccctactctctgcttctgtgaggtcaaccttttcagataccacgtgtaattgagaggggtggtattcgtctttctgtgcctgtcttatttcacttatcataatgtcctccaggttcaggcttactgtcactatgacaggattttttcttttaaggataaatagtattctgttgtgtatatatgccacattttctttacccattcatctattgatgcagacttagctttctcttgaatagagttctttgggagcagaggccaggctttcccagttcattgttgttctccagcaggtagtacagtggtagcacatagtagtcactcagtcgacacatgttaactgaatcaattatacaacgggagtgggaggaaggagtgggtgagtggaaagtccttttgcacgttgcttttgcagacaatgagctcctgaagggaagggcacaagtctgttattcctgtgccctgagatcctggcatctcatgggcatgccaaaaatgtctgtggaatgactttggaggtaaccaaggaacagttagaggtcagttacgtgttaggatgtgaagcaaagggaatggtcaaagcataagaaacttttagaacactgattttgaatatagaaattcaaaatacctttccttctcccaagagtaactagagagtgggggtaatttacttaatgtacacattttgtccatcaatattccttgtgccagccactggtacaccctgggcaaaggcaaggaaaggagaaggtattcccagatggaacaggaccagccaagcagcaagaaaggttcaggcaggcatgatgtgatggatgacagggctatctcttaaaaggcctgggggcattcattccatagcatccctgcattccagagaaaaaaaactatgcagcaacctcagcgagatagagcagcattgccataatgttgagaaccatgggggcgctcacccaagctccctggccagctggttggtggaccattttaactctgcatccacctgcctcttctcctagtacaacctggagtttctgactacattctaatgggctgacttcatcctctttgcatgggatttcagtgtgttgactttgtgccaaagatcagtgggttttataaactttgataaagcggtaaagaagcaagtttcacatactgccaccaatcatattttcatattgggcaagaagaataagtttaagtggtgttacaaagcatatttatttatgcagacgctctttttatccttttctcgacaggatattggcactacatttgaaacagggagaaaaaaagcaacatgttcccatttctcaatctctttactgccaatttctgaattgagactagcttcaagattttgaatatcttcagcattgatctactgctagtttctggtggagaaattgaaacaatagaaatctgaaaccgagatagacagcaacttgcagtgtacatttcctctcctgatgcttttatagacagaaaggacagaggggttatatctcgttctccagcttgtctggccatcccatccccaggaagtctatttactccagaaactactgtgatgcccacctaactgccatttctgtcgattcctgtccaagctgcacaactgaccagctttgtaacttaggtgaagttatttaatttctattgcctctgtcttcttatcagtaaaatggacatatgcacagagtttagtacttaaggttgttgcgaggattagaagagaccatgtatattaagtgctgctaagaatggtgcctgcgtctggtgagcaatcaataaatgttagcagctgttgttattatgactactctttttattgtatgtgtatagaagggaaaatcacctgtgtgccttaaatgggaaggggaggatagtagagtcttcccctgtcttcctatattgactgagcctgggggacctctacctctctgagttgacttgtacaagttcagcattacttccctgcaatagttttctatggctgctatggcaaattaccacagtgatgtggctttaaaaacacacatttattatctgagagttttggaaatgagaagtacaaaatggtttgatttgtgctaaaatcaaggagtcagcaaggctgaatttccttgcctttttcagcttccaaaggacgcctgcattccttggctcatgtcccctcctctgttttcaaagccaacatcattagactgagtctttctcatgctcctgtctctctggttctctctcttctgcatccctctttcccttataagaacgcttatgattacattgggtccacccagataatctaggataatctctccatctcaacgtcagctgattggtcgacttaacctcatctgcaaccttcattccccctggccatctctattcatttctcaggtctgcaattgcaaattaccactgaatgggtggcttcaaacaacagacatttgttgtctcacaggtctagaggctagaagtccaaagtcaaggtgtcagcagggccatgctccctgagcctctcagggaggatctttccttgtctctccctagcttctggtgttgccagagatttttggtgttccctggcctacagctgcaacacctcactctctctctgcctgtgtggtcacacggtgctctccctgtgtctctctgcatctttacgtggctgtcttctcataaggacaccagtcattttggattacgagtccacttgctcaggtatgactttatcttcactagttacatctgcaataaccttatttccaaaaaaggtcacgttgtgtggtcctaggggttaggacatcaacatatctttgtggtggggagacacaatttaactcataatatcatgcgagttaacatattcacaggttctggagatgaggttgtggacatctttagggggccattatcccacctaccatacctcccttcactcccgattgggatgagaagatgatagtgtagagtggatggagatagtttttccccaaccttgagatgctaacatctcaatgtccattactgcaaaaaaaggtagaccccaaatgacacatgcagcacagctagacgtggtattgtcagaaagggttgtagtccacaggagtagggaagggagatggaaagacaggaaaacaggaagaaattaaatccctacaacatatggtcaaatctcatcccaactgagctttcatgtaaggtgtctgaatccgttcttggaagtgtcttttcccctcctgttcgctaaaatttgctccatattgaattgcttttctcccctacacccccaccaaccaccagctcccttcagctggcattggcctctgttcctctgctgatatttgaagcatgtgggtgggtctcactttcccagcaaaatcttttgttcccctgtatcgattcaccaattatcacctcatccccattctccaatccctccccttacaacaaaaacaacaacaaaaattaaaggcataaaccaaaagaacagaacaccttcagccttcatagcatccctgagagagaaaacctatgtattaacaagaaagatgatctgtatttctttttccctaggaaaacatactcagcattttatttcatgaaaagattgtatttccttgattgggagggtaattactcttccaaaatagacttgctgttaagtaatcttgtccatgcaagtgacatggtatatgagtgagaaatgtgggcaataggtatatttgattatccacactgctatcttatctgactgaccttagagaagttatttggtctccttgggcctcagtttccttatctgtaaaatgaggattttaaaaagggcctaatttataggtttgtgatgaggattaaagaagctaataacagatatcgtgcacgtgccaggtgccgggtactgtgctcaacacttttcatggattatcgcatgagtttgtgttatgtccattagcgcagggtctgaggcttcgccagcagtcaaagaaccgtcactatttttgtgagtacgtggcttgctttatccagtctgccgctggaagcaaaatattctttctatcctggatgtccagtcttggaaccagctccgaatccattgaaaggcccctggtgtctctggggggttggtaccttcagacgttattgtactacatttttgttcaatgagtcagagccaaaggacttggttggtgaaaaatttaaatcagatcggtgagaagcagcaatcttcatctcccccactgctcggtggtgcacctttgccaccaggtcagggaaatcatcaatcccggggagcaactacaaagctgtttccagagccaatttcctgctgaactgtgtgttatactcttagcaacattccaaaaattatactcacttcaaagccagctttgatctggcccccctccctcccttctcccccagcctttgccgagaagcgcatctccaggagtagagttcaccttgaaaggctgagacgcctgtgagcagagctcggatcttcctgagaggaagggagggaggccccagaaccaaaaaaaataaaaaataaagaaaagaaaatccgtgggaggcctcacttattctctgtggcccactgcccttgccttggcagctcagttccttcttggggtaagcaaaaccatcagcccaggctctgccctccacagaacagcagcagccgcagctgatctcagcattgttgccctcacgtggttttggtgttgttgcttaagcagggagctgctttgggtttctcactcagagctgcaatgggaggtatgtaaccatcacccagggctagggcaggaaggaaaagcttgccctgaaggggaggtactgtaccggtgcctttcagggaaaggcctttgtttgatactgtcaggcatcagatgcacctgataattttttggaaggaggaattcttgcagcagctcatctttccttcattttacccactccctttccctcactcctagattacaatgtggaaactgaggtacactaagagacttgctcaccaaacaagatgcctgtggattccagagtgattcgcaaatcccagttctagcccaagagaaaattccctcagaagccgagcaaaaagaaaggggcaattagctgcaaatgcctcatgcatggatgtggtgctggagtctcggggggttgtagggattgggcgctctaaacccagtagatgtgccgcactggcttcatttgtgagttgggaatcctggggcttccctaggcagggagtttttaaaataatagttaccaagtttaaggaatttatttccacctatttgggagtaggagcaagggtacgtaatgacagcctggaggaggagcaaagcactgccacctgcttgcttgtgaccttgaaaaccccacctcacctgtctaagtcttagggtccttgcccaggaaatggggattttgtggtgaggatgagtgataaaaatccatgtaaagcacttctccctgtaactgacacagttcttgccctacaagttcatagttgagttggagtgaatcaagaagccttcactgaaaggggtctcacacttgtctatctccctagtatgttgccttgcatttgatggagattcaaagtgcgttgactagtttgagtgaccttcaaggtaatagttcaacatgttgacaaaagtctccataagggaaccttgtgacaaagtattgtgtaaaataaagaatctgtgtaaccgctccaatattattctattattattattattggttagtgttattattataggttattattattactatttttggctataaaagacaacaataacaacaatcactgcttactgacatatgacatttagtacagtgcttagcacaaagttagtgctccgtgaaggttaaacaacagtgagaaaaaaacactgcctgcttttcaaaacattgatttctacatgcagttttagccttgcatctgtgagatcatgacgggtttatttatatttctctttttatgaaagcttagcggttgtgttgagtgaatacaaacagttaccataggtccttaaaaaggagctctgagatgtgtattgagcgagcgctgaacattttcaggatgtgactggttccctggggcccactgcatcaggctgaccattctgagaattaatagccaccctgacacttgaagcccatcaggaatgagatgcttgcctcgtctgggaggacggtgggacacgtcaccacctgcacgtctccctataagctcttacctgccgaattagcaagctgcagctattatgttagacagagccacagctgagcccgcagtttgatttttgtcaccataaaggcaggactggaattgacactggagtaattaggaatgaattctcagatcttgacttatcaagcacactgccagggagggagacaggagccgtgtggcagtgttttggaagctgagatggtgaccttgcaggctgacctcactcttaatctttctattagagagaccagtaagcatttggccagcacctcctgttaggctgacaaccagagcagttcgtttgggattggatatttttctccttttttttttttttttgtagcctgtaggcacttagaagaaaaaggagcaggagaatgaagccaatatgggaagcaaagttaccacggggacaaaatgttcttccgagcagcttgaaatgagcataattttggagaatttctgcaatagcgagttaattcataattgggtttgctgagcaatcaacaatgtgttgcttgtattttcatatgctgggagcatatgactccgtgtgtgcactgtgtgtgtattataatgctccagtactttgatgcttcactaatgtgcaatctctatttcttgcttttgtctgggggcctctcatattacgtttagattgtatcctttatcatcccaaattgacatttatgcttttacttctattgtttccctagcttctccctggtatggatcaacaatttgttttaatctgtgtcacttctcttatctccctcgacacagaggagcagtcattttgcaccgccatccgcctacagaggttgtgctgtcgagagtgtggtggggtccctcaccctctccccactgtctaaagtgctggcgaatgttaattgcttttccagttagtttataagaatgcagaaaccgctgaatgcagcttgactggttttgatgaaagtaatggaatgctagtgcctatgaataaataaatctgatttacatagaggactattgtggtattgggtaggaagcctctgaatgcaagcaaattatagtttaaggacacattattccttggcttttattctaagtaaaggagaagagctcaggtttccttgggttcccagaacgggaggcgaagaggtaaccccttgacctaagaggaaaaatgctttctgagagcagcgttgatctgaaacttaagggggatgcattttgtttggagagaagctgtagatctaggtctcacttcctgaaatccccttacagaaagcatatagaatagcaagtggtgaagaatttatgagaagcaaactgaaaatgtatgagtgcctatcagagtgctttggtgaaataactggagaacactcttagaggaagacgggatcacaactattatgactatcacgacatccagttttatttgtgtttcctaaattcccacaagagtgtgtggccactagaaatggaataaatcaagacattcttttttttggacgagaaaaggcaagtgtggtagaagtaagaggactcacatcagggcatctgcatttcggagtgcctgaggattgttctgggatgagtccatctggcaggaaaggagatgggaatagagaggctatgggaggcacaattcaagtagatgctcagactaaaaatgcaaaactgctacgtttcagaagtgaccctattggtggcttctgataaatgaatgaggattaaacgccaaaattaaatcacttaaaaaatatttgtatgggccaggcgcggtggctcacacctgtaatcccaacacattgggaggccgaggagggtggatcatctgaggtcaggagttctcgaccagcctggccaacatgatgaaaccctgtctctacttaaaaaaaaaagaaaaaaaaagaaaaaaaaaatcaaaagttagctgggcatagtggcgggcacatgtaatcccagctactcaggagactgaggcaggagaattgcttgaacccgggaggtggaggttgcagtgagccaagctcgtgccactgtactgcagcctgggcaacaagagcgaaactccatcacacacacacacacacacacacacacacacacacacacacaaatagcatgggcaaggtactattgtagatgctgagggcacagcagcaaataaagccaagtcccagactgtgtaggacacttacattctcacacccagctcgcagcaaattataaactctaaggagataaataattgggggagatcttgaaacttgactacaggcttaactgggtaagactgccagaaaacaggaacagttttctgtgtatttagtgccattcataacatgacagcatccacagtgactaagcaaacagcccagaggagcaagggtgtgagttaggagttgagtaagaatcagcgacaataaaaatgaacacctgacatatttttcccattctagggtcctctgtctataaatatgtttgaaactaggttattatcctctctcacccatgcttatctcccaaattcttcttaatcatttctcgggtcctgatgatatattgataggctatggattaaatatgaaattactgcaaatctcaagcacccaaagatttatggactgaggcttaggccttatatcaaatcaaccatctaagaaaatatatgatttcaccataatattaaaaattactggcagcgtcttcatcttatccgattggtgttgtcctgatgataagctccagtaagcagagagagaagttgtgtgataaattatggaacagacattgaaaaatatatttattacatttggatgtgcaaggatttcactcgctgtgtacagaaaaaaagagagtttgtgttgtaacgcctactttggttccaaatattctacagtctctaaagactagctgatcttccgttggcctcattcgcaggagttgagttcctagatgggaaaactgtgtagtgattacaaatgaaagtatttgttctaaaagtaagagtttcctggtcaatgtgaagaatatccacagagaggagaatctaggtccatgtttctcaaagtgtggtctatggaccagcacattgtcagtccccgcgagcttttgagaaatgtatactccctgaattaaagtcagcctcttaacaagacccccaggtggtacataactgtttgagaaatgagaaaaacaaactatgatagacgggaagccagacaggaagagagaagttcttaatgtatctcagggagggtgctcgatgggaggcatgacagaaattatattaataataaaaataaaacaatgaaaatcatggttaatgtttattaagcacttatgaacagacattgtacaaagattacttgacctcatgaaatcttcatgaagacagccctgtgggaatactagtattaccccaactttacaaatacaaagatgaaggctgagaggattatagaactttctctggctaccaaagcttgcaagtagcagagccaggatgcacaatcacacttatctgatttcttacacatttcagtgaagtctcatgagtcagaaactctagtggacagggccagccatattggagggaaatgttgaaatatcaagaaaaaagagtcatgaagtaggaactgtctttgtacataaggagaaaaggaaaactggcaaaatggtcttttaggttctactagcatatgcctccctttgaaatccccagctagaaacctgcagtcatccttggttcttccttttcctcatgacccatatccatgagacttctgatttccatcatgtcccctccttagtgtacactgactgtgtccctggctcttgaagtgcacctgctgtcgtagttcagacttcatcatcagtagctgggtcttgagcaacatcctccaaattggcccctgcagctccatagtctcccttttccagcccctctatcatgaatcaccatatctccctagaacccaattcaaccatgttccttttctttctgactctgtgctagatgctgataaaacacacatcctgccctcaaggaagcaacaagcccagggaaagtcctcacactctgccttgtctaccactccactcccatctcaccttcctctctctgtgcttgcacacatcactcttgtatttgtcttcatacatatcccttacaggtgagcagaaatcaggcgcagtccttggttctcagccacttcctgcttctcctcagtcactctctttccactgcccaggatgttccctcctccttaattatcctgtgaacaccaacccatccttcaagggccagctcagctgtgcctgcctctttgaagccttgtccttagccttacctcggtgtaagcagtcactccctcctctttcagatccatcagcatttgtcttccttgtttattgctcctcctagaccaggatgtagatagattcccatcatgtccctggaacaaagaaagggcaaggagacagtagaatggcttacaggccgaaaacctgaactttcaaacctgtttttgggtttaagacagtttagatgcttccccccagtgcctctgtctcttatactctaatcgaggccatgagggccaggtgcagtggctcatgtctgtaatcccagcactttgggaggccaaggcaggtagatcacctgagttcaggagtttgagatcagcctggccaacatggcaaaaccccatctctactaaaaatacaaaaaattaactgggagtggtggtgtgtagtcccagctactcaggatgctgaggcaagaggatcgcttgaacccgagaggtggaggttgcagtgagctgagatcgcaccactgcattgcagcctgggcaagagtaagactctgtctccaaaaaagaaaaaaaaaaaagccatgggaagaggttatagaatgttttcaggctttaatttatgatccaagcacaccacctggtctacctgccacctctgtgccaacagccttgtttgcatctgaatagaaataggattaattgatgcataaataatttaaattacctgtataatctcagaacctccgccgctgaggtagaaagacggcttgggtgacttcaaatcagaattatgtccccaggggataggttgtcagattcagtccacacttgaggtcctagtcatgtctggtctgcatggtaaatgaatgccacatgtattagctcattgatttctcctagcagccctgtaaaataaatgttttaacttccattttacaaataagcaaatcagggccctggatctattgaatactctgcccacatagctccctcctgcacttgaaagtgggagagttgggcattaactctcgggaaggaagcctagtatctcccactgtcttatgttgtcccacccagaacgaactctctttcccggccatcacctttccgtcaaatgttctcagggtgcatgtgcgttgaaataaagagataaggtgtgactgtcaagcagaaacatgccagaataaggcatacattaaagtctatcttaatgcttcgcaattgtgcccgtggtgtgagcatgcttttgtgtttatatgtgtgaccagttgtcagtgctgacaaagagtgtccaagtcccgggtctccttatttctgttttcttattgcttaaatagaccatatggaggacaggatgcttcattttagctcagggatctggttgcatcgtctccccacatccaaacatcagtcccatatttgtcttcatgcatattccttacaggtgagcagaatcaggtgcagtttttggctctcaggcccagttagctgaatacagatgacacgcaaagtgctcttgctgactcctctgtcagtgtcgtggggaccagctctgatccatttctgtccatgagcgcttgccaggaaccattcaggcgagtcaataggatgcccattgatgggccaaacgttgtttttctcgacaggagcatgcagagtaggcaagaatgtccaactggctgcgtctgacctgtcagccaatttttatctctccaggcaatagctttaaaatggtaaaatatctggagttcatgacataggttagcacttctttcaactcaaggtggcagcagcatgaagaacgcattcatcaaaaccaaagggactccactgaaatggatacatcagaaacatctgaaacttatttcccagcaccctttgtcaaagtaaagtgggaggaccacctgcattagaagcgcctggagagcttgagattgcacgtcttgtctaaaggttccacctagaggcaaaacctggggctttaatgaggtctgacttcatgtctaatccatattacaaaatgtgtctcaagatcctctttctaccatgccttcaggtagaaagggaaaaaacacttaggtatcatttcataagccccagaatgcctaagattacaaagactgagaacaccaaatactggcagggatgtagagtacctcacatactctacatgtggtaggtgtataaactggtacaaccattttggaaaactgtttgacattctcttatacagttaaacatatacccaacaatcccactcatcagtattgaccccccaaataaaaatatatgttcaactgtagatttatgcgtgaatgttcatggcaggtttgcttctcagtaaccccaagctggaaataaatcaaacgtctatccacatgtgaatgaatgaacagacttgaatagcatcatacaatagaatactattcagcaatacaaaggaataatctactgacaactcaacagcatggatcaacctcaaaaatgttatgctgaatgaaagaagtcagacataaaatagtacttgcttatcattccatttatataagttcaaaacatgtaaaactaacttatgatgatagaaatcatgggtgtgacctccagagggttgaggattacctggaaaggggcacgagggaactttctggagtggtggaaatattctctatcctgagaaagccgatagttacatgggtatatgtatttgtcaaaacgtttcaaattatatgcttaagacactgctggtgggagtgtaaattagttcaaccatcatggaaagcaatatggggattcctcaaagagttaaaagcagaattaccattcaagccagcaatcccattactgggtatataaccagaggactataaatcattttatcataaagaggcacgcacataaatgttcatcgcagcactattcacaataccaaagacatggaatcaacctaaatgcccattaatgacagattggatttttaaaatgtggtacatatacaccatggaatactatgccgccatgagaagtacaagatcacgtcttttgcagggacatgcatggagctgaaggccattatccttggcaaactaatgcaggaacagaaagccaaatatcacatgttctcacttataagctggagctaaatgataagaacttatgaacacaacgaaggaaacaacagacgctggggtccacttgagggaatagggtgggaggagggagaggagcagagaagatcactattgggaactgggcttaacgcctgggtgatgaaataatatgtacaacaaactcccaagacacgtgtttacctatgtaaaaaaccttcacgtgtaccctcaaacctaaaatgaaagttaaaagaaaaataaaataaaaataaagttcagggttgagtatgatgaacctgaatacaatttttagaaataaaaataggaaagaaagacccacgtaaagatgaaaatgaaaatcacctgtattcttcccacacagaaatactcctctttataaattttgttgaattcctctctgttgttttgcatatatatatataattaaatactcctcaacttgtcattgtaaaagaaatgatttctatatgtaaacttccccttagtttttaaaaagcagagtgggagagaaatgggcatggctacaaaagagcaacaagaaagaccttcttagccaggcaaggtggctcatgcctgtaattccagcactttgggaggccaaggcggacagatcacctgaggccaggagttcgagaccagcctggccaacatggggaaaccctgtctctactaaaaatccaaaatagtagctgggcttggtggcacacacccgtaatgctagctacttgggacgctgaggcaggagaatcgcttgaacccaggaggcagaggttgcagtgagctgagatcactgccactgcacttcagcctgggtgacagagtgagattccaccacacacacacacacacacacacacacacacacacacacacacacaagaccttagtgtcttagcgatgggagttttctgtatgttgactgtgtcgacgtcaattccttagttgtgatactatgatatcattttataagatgctagctttgggggaaactggacaaagagtacttggcatctctctgtcttatttcttacaactgcatgtgacactacaattatctcaaattaaaaactttaattaaaacacaacaaaatttggtattaacagcttggagtttgatatttttaatttttaattttttggccagcttcaggttttaatttggacttcttgtaggtagcccattgtattcgtgtgtatgcctgcatttgtgtgtgtgtgtgcacatacaagtcttatgggagagagagaaaaacagaggtgttttaaaatttactttgatttttgttttgatttcccccacagataggggctcataatttaaaagtcaccctttccatcaggctgggttcatcggtctaaagtcaaaaatctctatgccactttctacttcttcccaatgttttataattccaaagtgtccttgctatacaaggagccttcttcttgaatgttacattattctactgacattgtagagtgaatagtgcctgtgagcatcttggccactgagttgggggagatgtcagccacatgtgattctgcacatcttccaggtaatgcagcggtgctaatgtagtctcctggatgcagggacaccaacggggcttatgtcactcccttggtggccttaagtgcataaatcaatccttatttttatgccaatccatacagaaggcttccttgtgtgtgctgcacatagggagggagggcaggatgcctccttgagcaagtggtttgcattcgaagaaagcaagcagtattggaaactggtttctgggtatttttgtttctttatttaaatcccctaggaaggctgctctggcttggacagaaccagagtgaggggactcattagctggagtgaggttggtgtcaggaaaaaaacagagctcctgccttggcttgcctgaggtcgcaggacgccacccttgagtctccatttctggcccgggtcctgagtgcctgcccaccctaactctaaagcagacctagcctggtggagcctgctatagagaggctgatgttctgaaatacatatgccaacgatgataaaggcatactgtaggaagactaaatgcttttttgaaattattttggtagggaatcaccagcattatcccagttaacccaacagtgtccaggaggtgggttgatacagtttatttcattcagcaaaaaggaaaatcagttaatcacaactcttcctcctactcttcctcctctccctccttcttctctggggtatgggggcataataacaatggtaagacaaatgtaagaattatctttgtcatttcttgtctctcctattggcatttccttaccctctctaggagcccccgaaatgtctatggttcccatttcattctcactccaacatcaaaacctatcaattatattctcaaggccctcaaaaccccaagtcttaataggacattggatgacaatgagtttaatttgataacatgaagctttagcaaatttgaagacattcatttcctctaggcccataaaggatattactaacgtatcccaggcaccatgatagagctgtgggagagagagagattgttaggcagatagctagagctttggtcttctcaaaattgcatccaatgggaaaacagcacatttaattatttagttattactgaaggagggcgatatgcttatatcatcccctggcacagaagagacaccaaaatatgtgttaaaagaatgtgtgggccaggtgtggtggctcacacctgtaatcccagcattttgggaggccgaggcaggtggatcacttgaggtcaggagttcgagaccagcctggcaaacgtggtgaaaccccatctctactaaaaatacaaaaaaattagctagatgtggtggtgcgtgcctgtagtcccatctactcaagaggctgaggcacaagaatcacttgaacccaggaggcagaggttgcagtgagcggagtttgctgcagtgcactccagcctgggtgacagagggagaccctggctcaaaaaaaaaaaaaaaaaaaagaagaagaaagaaggaaaaagaaagaaaaagaaaagaaataaaagaaataaagggaggaaggaagggagggagggaaggagagagaaagagagaaaaagaaagagaaaggaaagaaagaaagaaaagaaaaaagaaagaaagagagaaagaaagaaagaaagaaagaaagaaagaaagaaagaaagaaagaaagaaagaaagaaagaaagaaagaaaagaaagaagggagggagggagggaaggaaggaaagaaggagggaaggaaggaaaaaggaaggaaggaaggaaaagggaaaggaagggagggatggagggaggaaggcaggcaggcaggaagaaaggaaggaaggaagggagggagggtgaagatcaggatgattcctagactgtttaaagagcatttgagaaatgcctcttagaggatgttacagcctatcttgcttgccaatgaaattgccctagtctagaaaattctgagtctatgcaaaagcatatgagtttctattatgttaccatcagaagaagatagttccagaataccctgcacattcccttttctttccatttatcaagttctgttgaagtcatctgtctctcttactaaaggaccaactcctcaaggataaggactatattttagatattaccatgttattagcatcacaatcaggctcaggcatacaatagatgcttcataagtggctgttgaatttatggaatattatttctgggtcattttccagaaagattgcccatagaatggcttgtcaaagaagtggactctggacctgaaggactctaagagatgttcctcagtgatcttatttcagattccctcgaattgctacatgggagagtggattctaatcaaggtcagccatgagccacaagcaaaaatagagactgacaaaattggtaggggaagagttaggaaatttttccttatggctcagggctatgttttcatgcaagataagagttgttgtgcctcagataggagcacaagtgagcagttcagctctgcctctctgccttctgtcctcttcatgcaccaattctcaagacaacactgttatcttgccagaaaatacagcccaaagcattacagatgtctggtacaagcggaacccatattaatggttattgcttaaagaagaggcatgctcagatctctttactgcactccagggaaatcgcagtttttactttcttccagagcagaccagagatgtaaaaagatcaattgagtttggcctatctcagatagagggggctttcttagaggtaatttgaatggtagtcgtgacatggcctgagacacatcctcacaaatacagatttcttaacacttattattttttttaatcaaggtgcttagggatgcttagacataaatgtttcagttttctataggaacaaataagttagtgataatatatgaagaatcaatgaagaatcgtttttaaaaaggcatttttagtgtctgttaacaattgacttatggtttaatttaaattagctgagcttttcttagaattttatttatttatttatttatttatttatttatttattagagacagggtctcaccctgttgcacaggctggagtgcaatggcttgaccatagctcactgtagccttgacctccaggaattaaatgatcctcccacctcagcctcctgaatagctaggactacaggtgcatgccactatgccagctattattttattttatttttatttttgtagagacaaagtctcactacattgcccaggctggtagaattttttttaattcttagccagtttctgacagagtgaatcatttctaaagaagagaattttttttttttaaaaaagcatgatttcttttcaaggtgccattaatggaattaaactgaaaatgcattaaatgacatttaaactagccccaaaagagttattatttttgctctgatagaaaatgcccaatttcaaacacttattaagcaatgtgtgcacaccgtatagttgcataaggtttacaactttgtcagtgccacctttagccaagaggagttatttgcctttaattcttacaaaaaagcagaagatcgcaaactagtgcagcaccattctgaccatgccttatgctataagctctggaaataagataacaccctttgccccttgaaaagcattgccatttgtaatcatcccaagtttccaactatagagattgtcaacagcaagaggaacttttaaattggttgcctttgatgaaaatgaaaatgttatccatgaaaaatctctaggaaaataaattcaggcctgattcctgctatgcaaacagatatatacagtatcaccctgaatcagcttttctcatcagaaatggagctactgtactttattgtgatgtcagagattgaactggggtgagaatgcacttctgataattaagatcatatcgggttgggaaagcctaattcctaacagaagataaagagtctcctgatggtatagactcaaaaggcctgtaaattgggccatataatagtcgtagaatattgggatatgtttgaaattccttattgctgaaatgtgcagataataccagaagggagagcaccccaaccccataaacccattggaaaaaaaaaaaaaaaaaaaacaagaaacatctcttggagcaggcaggtggtgtatcatatgttccccgggtggagaatgagcttcttgcctttaaaagtaattgattttatagcgaaacgtgtcaagagcactggttttcaaaatgatttcgttcatgtgtgttgggaaataatatatactgctaattgcttcagaaatagctggattatttaactttggttttgatgggatttggaaggaagatcttgagcccttatgccttttcccttatcgcagattaatagctgttttgaagctgtgtctacttctgccgttgcagagatgaaatctgcatcccctcactttcttgtgtagggcactagctacagtgttcttagttcaacctctatgagtgttctaaagatagcagtgtgacatttctgtttcaataaagcccaaatagtaggcgagatataaaacaccagagaagaaaaaagatatgtttgctgatttcaccgaggtccgtattgagctgcctaggtgaacagttgtaagtcgggagtctgactgcaggtgcaggagggggagagagtgttaacttctgtgaggcatcatctgttggctgcttagcagcacacatcttgctgcaattccatcgtgaaggtctcagtcccctacagactaatggtgagtggatgtaacatgggacctgcgaaaggaaaggtggttgtttcttgttctgtggcttttctcctcagttgtgtcttcaatgagctaaagtgaatgtgctgatttacagtctgtatttgctcatggtagctgtctcattattaattattcagggtcttcttccatcttacacacatgtgtatgtgtgttcatatgtatatgtatgtttgaatgaatgaatgatgaaataaacaggcataattagtagggtcgaatcgttgtccatggtcaacactaattgaccctaccagttatgcctgtttgtttcatctttcattcattcaaacatacatataatatacaataaacatacatacatatgtgtgtaagactgaaggagaccctgttgaattaataatgagacagtgcctgtacctcttcctccaggaagccttccctcatccgctaagccaagaatcagcaatttttttttcctatgaagatccagatagaaaatatttcaggcttcattttgtgagctgcacgcagtctctatcacatattcttctttttcacaatccttcaaaaatgtataaaacattcttagctcggcggctgaatgtggtccgtggccatcgtttgcccgtttgccaaccccaaaaccaaaccaagtgtctcctgtcttccccaccaaccatagcagcctacatgttgtattgaaaagagctaaactctagactcctggaaagggggttcacatctttgcagccccagcctaagcagtggcaagaattcatttttcaaatataaggtgatctccaccttccaattttatattccacctgggaaaacaaggtcatgtgcaaaaaccagcgaagtgacaattcagagcacggtcagtgttcttgacaggcccttgacaactttgactttctgggcgataaccccaagtaaagaaattagtttcaaaaactgccctgtaagctctcaaaatggcttttagaaggcatttgctctatactttgttaggccttcagctaggtgtttgtttgttctttgttaacacatgacttttaaaaattaaatgtttttttaaacaaaaacttcagagatgaacagcaaaaatggtaaggagtgtgtgatgttgtgagcagcaggcctagaaacagcccaaagattgacagcgtgacctcaaggatggagacaaaataaatcaaaaggaaatacacagctatatgactgcatagtacaatatgttttctcttaataggttttcagtcatcaattaaatgttgaattatgctcattatgctctctttaaaaatgcagccaaatttagcttccaatttggaattattatatccacacagcatggttaaaataaaaatatcgagcgtttgcagacagtgagttgggtttgtctgggaagttcacgcatttcgactaattcatttatgaataaattgtgaaaaaaaaaaaggcacattcatgacccaggaccaactagagtgaggagccagggatgggatggcctgggctgacaatgacttcctacctgaggcaaggtacttaagctctctaaacctcagcctcctgatgtgtataatgggtatctccttccaccccggtatggtcactgtgatgattaaataccattacctatgtaaagttcttaaaacaaaagctggcaggtggtaaaagtgctaacaaaaaattagcaattgttattattatcattatcatcaatattgttaatgaataagtgtgaaaatgaatttgacacacacagtgtgccaaaggagatgacagaaaagtgtaaatatgaatatggcgaagacatctaggattgcaccttataggaggtggtacttgatctggaattatcaaaccaattttagaaatcaagttaaactgggactgattcccccagaacacatattatcatggacagctttctttggttaggttgagaaagactgttttgtagaagagtaaaacctgcccacataatattacatcagatcctattataaactttcaaatgttttgaatttccagcaccatatcacattaattgttttatccctaaactatcagagaaagcagcatcgtaacagggtggaacaaatgcatttaactcagaaaataagacatccctcctcctagaaggggaaagattccaatttcctttcccaacattttctttaaaattgttttggcttcagaccatacctcatcttatagccaaaatgtaacctggtaggagtgtagacatccccatttgtcgtcacctttaaaagcaagtacttgaaagggtctgttttcctctggaaaacaagtaccgatgtcaagcctagccactgatgtaacacgatgaaagctgcttcagaggaagaaattggaacgagggagtttggctggagcaatgagacatgtcgagagcctttgggtattaaccagactggcagtgtgatccctgggagggaagacaaagatagcactcgcctgtctgactcagggcataccaatatcgctcgaaccttcccgtcttcccacaaggaaactcggctccagcccattcagggcagccttccagggcctggcatgtgtgtgctcagcatcacgggcagctagcaaagaccagtgcaacggaggaggcttagcttagtacgcgttcggcaggacgggtgtgcaggctgcactgcccttgagtcgtccaggtaggcagaaggatggcttttattgactttctgagactggaagcaaagaaagggggtgggaaagaaaacagtaggtgtcattttagttgtgccctcatgagtgcgagcgggaaaggtcagaacacctcaggggatgaggacagagccagggcaagagtgttccccagaaagctagacagcaatgggacaaggtactgctctacaaaccgagagagaaacagaggcgtgaaaagagccgttagtgcaatggagtgtcgtgaattatctgtcagtgccgatggcactcttgttaggattctcacacttctcacatgttgtcctggtctacttcctgggacaagcttttgtgagccaaagaccctattgtgagcctaggcagtgccatttttctgtacatccctctcttttctgtgagttcccagccccatcatttaggaaccccctggaatctgatggacaggactgatgtgggtcacaggtgccaaaactgaacagacagctatgttaattacaccacacctgtttccccaggttaagccgttgctattggaaactgtgatctaatgaaccgttattgcaactccccttcagtcatgtaacagaccttggacttggagctcagtcccttgtgcaaaaggataaggagagtaatgaacgagagtggcgggtgggaaaatagcatctgtacatggttcctggaggtggtgaaggagagaagttggttccacctgcaggggaagagagtggtccaggaaggtactccaggatgatctgagaactaaaagatgagaaagcctctgctagctgctggcattcatgacacagggactagaacagaccaagtcattttagatgtctccgtaagttgccagcactgtatttggcatcccctccattcctaaaggtgtttttccaataaatccatggcaacatgcagagctgtgccatcgcattaaacaaaacaggtatgattttttttttcgatttccccagctcatgttctgtatctctacccaatatgttgccgagctgtgagcacccttaggcttccatctaaataatttttaaactttttatttcttttaccactttgcactttttgttcccagaatgaaccccttctactattggaaatttcctaagacaaacaagtttctcttcctgggtagcaatttccattgatgaaaaaccgccttgtatgcagtcaggaagtagagcaggttgggaaggtctgtaatttgtttcccatcaactaataatcttattgtgatgagtaatgtagtcctgttaatgtctcaacaaggttatggattgtgctgagtgtcagtagagaagccgacagctttgtacagtgaaaccattcattctcctttctacacagtatagtttcttaaacagcttgcaatagatcacatgagctttagcaaacaatatttaaatgaatgtaaatacaaaaacgattaacgatatgccaataggacttttactgagaggttgattccgtttttgtgttttccagtgtgcttttatttttaaggacatgacaaatattttggaaacagatttaccaagttttcaggctgcctttctcccttgttacagagtagcctcagtgtctctgcctgaaatggctcctaccgttaagcaagtctttcccccatccattgaagcaagtctatcctattcttagcattcagcgtgatgtttaattttattgtggtattatatttttaaagttaacatacagtaaaattggcttcactgtgtacagttctgtagattttaacacaaatacaggtttctggaactgtcacaactgcaggaacccaagacaacccttttgcctcgaaaatttcccatgttctccttttgtagttacttacacaccccagccctgtctcagtctctcctagtcactaatctgtccttgtcactacagttttgtcttcttgaggatgtcatctaaatgaaatcatagcttttgaaactaatttctttcattcagcatggtacctttgcaatgtatccaagtggttgtgtgtatcaatagtccatccttttctttaattaacttctttaatagacaaataacatttgtatatatttatggtatacaccacgatgttttgatatatgtacattgtggaatggctaaatcaagctacttaacatattcattacctcacatacttttcagttctttgtggtgagaacatttaaaatctactcgctcagcaattttcaacaatacaatactttgttattaactctagtcattcctgcttttgcttcatagtactccatgaattatactttgtagtatatgaattactatactttgtttattcagtcacttgcaggacatctggttgttctcagtttttagtgacaaggaataaagccgctacaaattttcacgtgcagattttgggttgaacattaagtcctcatttctctagggtaaatacctagacttgggattattagggtgtgtggtaagtgtaacatcacgggaaactggcagactgttttccagactggctgtctcattttgcatacccaccagcaatgtgtgagagttcccatcatggcaatgtggttagctttcatgaaaagtaaaacatgtatttctagcgtgatactgtattttatcatgagctgcttctggttaattctgtaagtcattttttttttattccctaatgaaacagtccttacattttctgttggttaacgaaaaagaaaagcaaaatttgcctgcctgcttttctcaattctgtttgtggtttctccttcgggtcagaccgcacgtgttttcattagaaaaatgctgagtcatgggtatttgtttcatccatggaattggcatgatggcgctcagagtgttcaaagacatatagagagatgaggactggatgattggaggaaacccaggaggtgacgtatcttcctatcctcctctttcattttcccttcataagtcttgctccatttcatgcatgcaaagagcaccctgaaaatcacgtgtctccactgctctccatcatcgtctccactcagcaactcagaacccagggcaggaattctgactctgaaccttgcaaagaaagcaattcagcacatgtattccgtgtgcttaattgaagactccaatttgccatgctctattatctagaattaaacacaaaagacagttgataaataccacattcagttgaaaacacaaatgaatcaaaatgttacagtttctctccataggtaataattaacattcttgtgaattgctctgtgtgccatgatgcatcctttaaatggtgtgcaagcaaaaaacctgcacattgagatgtgcatatgtgtagacccaacagaatagtgacttagccttgggagataaggctggggtgaggagaggggaaaggcgttgatgtagagtttaacaatatgcctctgtgaaacactttcaaagcagtgtgtcataatggcctctacaaaattttatacatgagctgaaacatgaaaacaacatacatggaaaagtaaagtattttggtggttaaaaaccacaagggaacaaaagagttaaggtgaagtctttgtggcttacccaaaaggtcagcataggacatgtctctttctttaccttcgtcaaggccaggaactctgtacctccaaaagccctctgacccagggtaggtgcccaatcattaattgctgaatgaaggaacatgtgaacaaatgaagacgtgaataaaggaacaaatgaacaaatcaatgattaagaattgaggccaaggcagtcagatcacgaggtcaggaaatcgagaccatcttggctaacatggtgaaaccccgtctctactaaaaatacaaaaattagccgggtgtggtggcatgcgcctgcagtcccagctacttgggaggctgagacaggagaatcacttgaacctgggaggcacaggttgcagtgagccaagattgtgccactgcactccagcctggatgacagagcaagactccgtctcaaaaaaaaaaaaaaaaaattgtttgtcataagtgagcttagctaatgtgtcactgttcttgtgtaagaaatttaattggacagaaggcaaaaggaatcttgtggagaaaactgtcactttggatttctctcagagaatataaaagactttctcaagtgactccctgcgcatggcttttctaggctctatacaacagcattcctcaacctttttggcaccgaggaccagtttcacggaagacaaattttctacggaagagggggatggtttcgggatgaaactgttccacttcagatcatcaggcatgagttagatgctcataaggagcgtgcaacctagaacgttcacgtgtgcagttcacaatagggttcacactcctctgaaaatctaatgctgccactgatgtgacaggaggcggagctcaggcagtaatgcgtgttcaccctctgctcacctcctactatgctgcccagttcctgtactggcctgtgtcccaggggttggggacccctgctttacaacaaaaaaatctgttaaatggaaactctatccaagctctatttccccatgtataaatcagagaagcttataacaatttagtgggctaaaaattatcaaataaagtgtttcaatatataacgtgttgatgttagctccaatgtcagccctagaagggagcaaccataaaacaacatacttgtcagcatagggttgaggaagccattggatttcatctgatccaatccaaaaagtcttcctgaaagaagcggaattccatacatcttacttttgatttgcaaactcttagcaaatcatcctctttctgtgccacatcgagttcctttctgtatcggcaactacgcagatgaatcaggattcacccagcctggttgagtcagaagcctttagcaaagattctttgatacaatggatttgtgatgaaaagtgaacattttcaggtggcagaaagagccacaggagatcctgttagtcagagtttggaagtgaaatgtgtctattcccgcttggggtgtgtgggaggcctctgctcccattagttccatggggatttctgcttgtaaggcatttgttgtcgtgtttggattgctgtaggaagagaaaaaattactacagtttgcatgagatagagctgtgttttggcaaggaagcccatgataatttttcttcttgaactttgatcaagttcaagcttttgagatttgtctcaaatgataccgcagtatacttcaacatactttcatttctgatggaatttggagcatttctccaatttctttgttcttgccatatttgtcaatgtgtaattaattaactaattcggtcatttgttcaacaaccgtctattgtgtctaccaagtactccaagagccagggattcaacagagaataaaatagcatctttgccttcaagatacttacttcctggtgcagaaagacaaatgagttttttaaaaaatgggtgccagtatgtgctttagagaaaaagaaagcaatggaaggatgataagatgactgatgctgtctcggaaggcaggtcttaaaagatgacatttgagctgagacctgcagacatggaaagaatgaactactcaattatctgtatctccaggccaagggtacagcaaatgcaaagagtctcaaataggagcctgcttggccggttccaaatcaggcagaggccagtaaggatccagatcagggcctttcttatttcttgcaatattttcttcaagaactaggcttgaatctgcaggaaagagacgaacctaggctgatattctgggcaattcctacacaccacacaagtcccagatttaaaatgcctttgttcttgctttttcctctgcctgaaacattgttccctcagacactggaatggctctctctctctatttccttcaggtctctgatcaaatatcatcttatcgagaagcctttccagactacactattaaagtgtcagataggcagtgttagaaatggaaattattttctccgccaaatctgattatttcacgtgagagatgactccctctctacattatgggattaagaatgatcccatttgagatgataaatactagaatgtttcagtaacccaagaagccctgagaaacaaattgctaattcatgacttaaaccatctaaatgtgatgaacaactcaggacgtcagtgaattgttcaacagtggattgcaatgatagagcaacttgcatggctcataaatgagccaaagaaacttgaaaaccttgattttattttaaggtttttcatgcaaaatgggggctgatgtttaccaggactaccagaactcaaggaaacacaggtcttcttgtgctaattaataaaagaagaagagaatttatcaaaggacaaaagctgctataaggcacttcacattgtccaccattggacagttttatttcagtgtatttaaactgcaagtgtgaaaaataagtgcactgattattttgatattctgtaaggcctggagttactataactcagtaggaaaatggtcccttattcttaatggtgctatttaccttagaagtatctggcaacagaaagtttttcaagtcattgaaataataatcctggctgggtgtagtggctctaaacctgtaatcccagcactctgggaggccaaggtgggaggattgcttggggtcaggagttcaagaccagcccgggcaacatagcaaaatcccatctctaccaaaaaaaaaaaaaaaaaaaattagccaggcatggtggtatgtgcctgtagtcccacctacttggaagacttagtcaggaagattgcttgagcccaggaattcgaggttacagtgagccatgattgtaccactgcactccagcctgagtgacagagcaagactctgcctcttaaaaacaacacacacaaaaatctaaatcacagggtctgtgtcacccctctctccaacatctcaaaaaacaggccaggcacagtggctcacacctgtaatcccagcactttgggaggtcaaggcaaaaggatcacctgaggtcaggagtttgagaccagcctggccaacacggggaaaccccatctctactaaaaatacaaaaattagccggatgtggtgacacgtgcctgtaatcccagctactcgggaggctgaggcaggagaatcgcatgaacctgggaggcagaggttgcagtaagccaagatggcgccactgcactccagcctgggtgacagagtgagactcccatctcaaaaaaagtaaataaataaataataattagcctattcaggtgaaaataaatgctgacatttcctgagggccttctatgtgtgatgcattttctgagcactttaaacgtagtatctcatttaactctctttaccaattaggaattgttattaaccaccttttacagatgaggatacagaggttaagcacctcagaactttggtggtctaacttcagaagtcctccaggcaaaactggagagatcaatgttttcaagactgaaaaggccctagaaatggcctcctgaacccttgctagaaagaaacctttcttctagtggagcacaccgggacccagtgattcttatggcaatgcctcttcctcccactgcaaaactgagggctgataacacactggcctcctggtggtcccagtttttttctaaaagttagtggcatcctggggatcttcaaggtgagggtgagaggtttctcctctaagcctgctcagcagcggggtacttctactcatcattcatgcaacatcataagaaaggtcttgagcactgtgagaggtctgatttattttaattgggaggtaaagacaactccaagacaactttgaaagaaaccagtaaacaattaccagcaaaatccagagagtgctctctctgacagtagttgagccatgtagtcttaggcagtggatgtttctccagatatttgattatcttgggtaattacttgtgtgggtgcgtacgtgtgtgtatgtgtgtgcattctaaaggcaaaaagggggttctgaaaatatctccagcgatatgtctttacatcccatgacatcagctgttacttgacgtgacaccagatgcagttcaaggtctgacattcagctggcttctgtttatatagtatggagaaacttttgttcccttgccctataaggcatgtaccaggagagattttgggaaaagttcacccagatagtaaataattctgctgagctttgaagtgaaaatgctccaggaacctttatcccatccttgccatttaactggtatgcttcggccactcttggtattaatgaatggtgtagatcagagtttgtttccattattctgttcatcagaggcacaatctcaaatcaaaattatattttatctttgttttgatctttctatgtttgggggaaagcactgtaaacatctcaaagagagagagaaaaaaagaatgaaatacacccccaggaaattctagttaaagacctaaagaatggcatctcagtggaaaagaattccactgtgaggtttggcttttttaaaaaaatagcctggtctttgaaaaacatattatctttcatgggtagggaaatatccaaattttgcccagcctattttacaataagaccttgaaaagctatgtgatgagctggaatgagaggagtttaaatttttgatgcaattctctgcctgggaaagtgataatgctgctcacataacagaaagagtattttctgctacagcacaacaatcaacataacgtctgggcatattaataatttcactcctaaacttctcgacagggagtgcatgggtcttaatagtattgtcaagatccttagggcaattgaaaaacccaaaatcattactttctactgataggctttcctctcccagaggaggccaaaatacctagggtaatgtagatttactgaaatgctcagataggcactgctcagacgtaactgtgtaataaaatcttctctttagaagggtccttctcagatatttcaagtggtcttttttattttgtctttgtcacttggaaagtagctaatggagatgacgctgatctcaagtaatactttcctgatgatttaggaaggcaaagaatgagtataggggcaatggtcaaatgatgtggcacctacgattaaaatccctttctgacccttcatgtgtgagaacgtgccctattggggcgggatggtcccaaattcacaatagctattaagctcttaacccaagggcagctactgacttggcacccagttcgagtccccttatcctttcttgtttcccctcccacaaatgtccctgcctgtgcctggctaggtgattacagccatgcctgaaccgctagaacaaattcccagctcgccctcagacattcacatgtgcaactcgttctcaaatgccatcacctaacaatctccatctgaagaatatcagcagctgcagggtctcagccaaaaaaaaaaaaaaggcctgcaggggacctgcttcaggttgccaggggaagatctttttaagtgctaggcagtgtgccccgtttgagattgaactttgactggctctgatggagctctgcaacagacagatgtcgtggttataataaacagagggaattgccatttccatgaaatgtccaggattggcacatccataggaacagagagtagattaacatttgccagaggctatgggagggaggaagggactgggccgtgactgctgatgggtatgttgtatcctttgagggtgatgaaaatgttctaaaattagatagtggtgatagttgcatatcttggtgaatatactaaagtaacactgaaatgtatacttttaaaagctgaattgtatgatatctcagtaaaactgttattttaaaaaagcagaagaggtgatcaggcagcaagtgccaggaaaaacaaccaaaaaacaaacaaagacggaggagtttgaagtcaccttccctctgtgtctagccatctccctgttaaaggagccctagaggtaacagaaatgagggaattaagtgggagggcatcattgattccagcaatcaactagaatgctctagggatagaggcagaaatctactctgatccctgtcctctgagactctaaatataactcccagggacatgatttgttcattcattcattcattcatcaccactagttttataccaggcactgtagccttatgctgggatatacagacaagtgagacagactgtttttaatggaggcactcatgatctagtggagagcacaggagagtccaaaaataatataaaaccatgtgctgagcgttacaaaagaaatataagcagtgggcaaatcaagcacccggggggggcacagatacgttacagttaaatacaaaatttaaggagagagaattatgttacttaacctccccacacctcagtctcctcatctttaaaggggagagcaatatcttctttaaagtgctttaaaggttattgtaagttttaaataagatgaaatatgtagagtgcttatcacacagttggtgcttactaaatgggagctattggacttaggtgatctaagatgtccctgccgaccctagtcctttacgaacgtaggcagagcggaggaaaactttgaattctgagcctgcaaatgattgctccttgtgactgtaattcccgtgttccgctatgcagtgttgatctgtgcgtcattgcgaatgcattcggaatgtttttctctgaggtcatatattttgtgtaagaaagagagctataaatcattccttacaggcaagcacagccctttctttctctgccctctgttcaggctgagcggggtgcttccttcaaggacagccccctgatacaggcctgtgcaacccaggccagaggcactggctagagctggagccagcggctggggagatgaggaggaggctacaacttgactcactccttcatcccccttcttgtttctcctccactctgaaatgtggaaaagctgcagctgcagcttgcgacagcagtgaccagatccaagaaagactgcagacaggccacctgccctgtgaagccagccataccatatgtgtgtcaataacaaaaaatgcaagtccattctttaggagataagtcattctgtaggtgttaagacagaaggaggaagcaaggtcattgtcccacatgcccagtacttagagacaaataaggaaatctcttcaaatatgggaggaggctggatttggacctattccttccatccctgggctcttggcaaagtacctcaggtcagagcaggacaggacaagctgggatggagtgtgcccttggttctgcccctgacaggcctaattgctgctcattcctcatgctgcccctcacgccgctggttagggagccagggatgcagcacagtgaaggaagtttggggagggcctttgggaaggcatagaaagagattgcactgcagtttggctgttctggcctatttctcctgattcaagcagcatccgtgaggtggtgcagagctttgaggtgggcgattccctccagtttctcacaagattggattctgccatttaagcaaatgtgcaaagaaatgagtccaggctgttttcctctgtatttgctaggcatatatcagccagggcaggggacctgtttcctccctgtgtgcctgtgttctggttttgggttcctttgcatacagctgggaggggaagagacctgggatcgtgtgccagctctaccacttactaagctatatgacatctggtgcattacttaacctctctgaacctcacttactggatctgtgaaatgggcatgataagtgacctgtctcctaggagtaagtgggaatatattgaaatgatttatgtacaacacttggcacagtacccgacacacagggagaacttaactcatggcagccatggacaatattattgttttgttatcatcagcatcaattgttttgcttatggaaatggagcagttctgaatcccgttttatttttgtgggctcttacagagacactcttgagactatctgttaatagctcctggccacgtcacttagtcactctgccctcctgctggccaaatttgaaggtggaggggtcagagattgatgattttgcagccaaatgcagccgcatgttcattgaatatccccctccaagaactgccatttcaaaggacttggaaaagttgggcccacagtgccctaggaggtactaatcattttcctcagagtcatagttgctatagctgccattgctattatcagaatgattaattatatcaaatagtaataatcataataatatgtgttaatagcttgctatgtaccatgaattgtgctaggctccttaaaaatatatttccatttgactctcctaacaatcatgtatgagaagtaagattactatatccattttacaagtgaacgactcagaaagaaaaatatgtcactttccagtgtccacacatctggtcagtggccaagcagggattcaagccaaccactagcctgaacatctgcaacagactctgtcctccttggatctaaccagacactgttattcttgaaaatcctcacccccaattccctctggccaattcaaggtcaaatttgaacagggtgtcctggtgccagttatcatcaaccagagattctcaagtctctgccaacaccatctcctcttttagaaactttaaattgctattgagatgtaacttgccctaaaaggtggttcaagagaagaaggcaaagagtttgtggttaatttgtcatctgagggtctgagggagttgaaaattttaaagaccaaccattggcatgccattcccaggaatgagtgatttattagcagctaggcaggccctgacttttatttttttctttcatatattttatcatcatttctaatcaccaggaaaaattggtgaagactatggcgcaagacaagcctggtttaatttgtctctgctttcccaccccatctatttgtcgatgcttggcaaaagtagacccaacctaaacacgtcctccagctgtttatttaggcagaatgcaacaacaatagtcgattattaacaatttcttccttagagcccctgaaagtcttcctttatatgttgtttaaaacgtgggcattgattgtttccccatgccgtgtgagcaactctaatggagtcaacacaaaagttgatatgccaaggtttttcacttcccacatctgactttatgggaattggtatcgttactcaacaaagaagcactgcttcatttttctcaagtttcactgccaaccggtaggcatttaggaaggacagactatgtgactggcatccctctcaaaatcaactggcaacaactgtcccacagaaaatctaaaagcgcagaagcacagaccattctttagcaggacagacagcagtgctcattcaagcccttgatttttaaacatacaggaaacatcttgtctataaattcacttatcatttccaggcaccttacttatacctcccctggtttttagtaaagagccaataagacagttccttcttcctaggactaaaagccacgcagtacctaaaaataaattccaggttctggactgaaggtaaatcaggtgcagtgtcaggtcagcaccaatattttaatgacagttgccttttgtctactaatagcatactgattaggttgatactgtgtaagaatttaccttatatagtttcttatgtttaaattgcattattatgtaatttcatatttatgtaatagaagagctcttagtaatatgcacattaattaaacccaataaatgtatggaacttacagtggacatgagggttccttcatcaagctgagttattcatctccgtttcatagtaagttgaagacatcagttgctttacagaagggcttttcatgtattttggctttttggaaagcaagagggcatgttgtcagcattgtttgcatttttgaaacagaaaaccttcccacccagcaagtgtgttggatgactgtagtgaaaagtgataaatgcaaaaaggtgcttgtgatcatttgttgtagcagaggtgcttcatactagaggtacgttactgatactgaataccaaggcacccgagtgaaactaggagtcaaaaacatactattaggcgtcagtaacataaatacatacagccagctaaattacgagaacagggatcgctagggttgatggcaaatcagataagccaccccacccctcacagcattcagctctatccagttgttttgaggggatacagactccatattttgggtttggttttgctttcaagagaagtcagaaatctggaacactatgcaaaatctcaactttgaatttttgataatattcagcttgagggctgtcagtctgtgacatctgccctagatagatgaaatttggatttaattttcctactcaaatctggggtccctgagagctgcagttatgtcttatccatcctttcatccctgaaagaacccatcactgttctctacacttggttttcggggacttgccaaccatcaggcagcatgcttagcactttacattcatccttcctctctaactttcacagcaaccttagcgggtagttactgctgttttcaccagttggcagatgagtaagctgagaatgaaagaaatgaggtagcacgcccaggttcacacaactagaaagtggcagactcaattcttgaacccagttctgtagattttatctcctaacctctagctaaatgcccctcctagatgttcccacattcctctgtatatatcccaggggtcacatttaccactctgtattgtaattgtcttttccttctgtctcctgcacctcgttgggaaatatgactgcaggatagatagacaaatgagcaaatataatcaatgccgtggtgaaaatgagcaacagttaggaggagaatgtcttccaataccgagaacgctggataatttttgtttttgttgctgtcaataatttgatctatctgcaatgaaatatcatcttgctttataggagggctgggtgagcggagaattaagtattcttccatcttcccttactcttccttctccatttcccccaggaagctctaggctttctcattaggataaatgaaaagagaacttgacctctcttctagttaactggaaaactcccaattcattttatttggaacataacacatggcacccaggtcggtgcttctcttccccctggggaccagccctggatattgtcagcacacaagcaaccgcaggaattctgcccacgcataacacagatggacctcacaagggccacacaagctggagtagataaggagaacttagctcagagtgaatacacaggaaggaggagggtctggtatctcatttagggaattaaatcctttatatggcctctttgtactttagaagagtgtgtggtctggagaggggagggtggggggccaggacagagggagatggaaagttaggacttagggctggggagggcaggttctcacttgtgcactgacccgccccatcttcctgaggcaagtctcgtaattacctaactaatggggaataatgacaccacttggatgggagttgagagagggggaaagaaaggcatgagaattcattaaccatgtgtgaggggcttggatagcatccctgaaggatcattattacatcatttcacccccctttcccacctctttccactaatatgagacagacaaatgctaaataactatgtaataatacattactagacagacaacaatgccagaaaatataatagcctgctacagctatgaaactctcccaaagatatatttaaaatgtcactgatgcataatgtaaaataggaattacaggttcatttggaggacatgatttaaaatctatacaactgtacagtggtatttcccactgggtttttgttgtcactgtccttttctaaacatcacaaagaaaacaaaaatcacccaaataatttcagcctagagatgcgaacttcaaggaacctgtttcctccacatttttccttcttgtttttgttggtcaggatgctctccaaacctagtatcttcttgacatgttgtcttttcttcagaatgtttctgcagcctgcacaggaaccccagaatgtagattacaccttttggagatgtagcccggccacataaggagacaagtagttgaaatttgtgtcaaattgcttgtttaaatgacttgagccaacttcttaaagccaggacagcaggggctgaggatttttaaagttggcaggggccaaaaatgacaaggctcagcagtcacctggtgagctgccagccctgactggaagcttcaaaaaataaaactttctcaaaggacacaaattaaaagtcatgtttcagcatccattaaaacgaaattataggcttcatcgcatagcaaactactttcattttcattatgcttaaaatatttcattttgtagattgagaatcggttgctaggaaaaccttgtgtggagttgtcagagacagcgatatctacaaggggatattttccaagggagagctctcctttgtttttcctgcaaggatagaggattttgttatttaaaaaaacgcaggatgcaatttggagtcggggtcatggcttgaaaacatctgccatgaccttctccagagaccgagtcctcagggttcatctctcagaggaaagaagttagcaacctgctgagctgagtgggctcacaggtgtgttttgttcactctcattttaaaatagatatatatgtgtatattacacatatacacatatatacacacatacatacgcaaatatgtgtgtatacacacatacatacgcaaatatgtgtgtatacacacatacatatatataaatctcattttgaattgtcaacatttttaaaaactaggaaattttatctacaagtccagatttccagcttttctagagaaattagaaattacggctgccttgagctctctccctcattcccacgtgatcaaattgacctggtgctgagtgagggctgccccctagtctcttcacctcaactcagtccttagctagcccactccaccttcctgcctagtccctataggtatttaaaggtactattccctgacttagagtgttccatattcttaatatcttcaaaagatgaaatttttgaaaagaatgtgtgcagtataccagtttacctggaaagggaatagggacttgctacgccagcgatcagccttgaatgtcatgttactttcattgcagtattaatatgtttcaaataattcctctggtcagcccttatccacctggttttgctaaattagtttctcattattcttcatttgatgcgtgtggataaatgcaaatcaaagcccattatttatttgtaactgactctgggatgcctgccgcagtcttatctgtcgctctagcttgcagctttcagcaattgtcagcttagagactttggtttgaaactctcctccagtggtttgcagagtgcctgagactggaatttgcagacgctaacagtcatttctcctttttttttcaggccctccgaaccaccacagccagtcgactctgaggccccctctcccaccccctcacaaccacacgctgtcccatcaccactcgtccgccaactccctcaacaggaactcactgaccaatcggcggagtcagatccacgccccggccccagcgcccaatgacctggccaccacaccagagtccgttcagcttcaggacagctgggtgctaaacagcaacgtgccactggagacccggtaagtccccatcgccagctcacagtcacactcagtgtcaccttacccctgagtcaccacacagagccactgggtgtctcagagttccagtcggagagaccctctgggtataaataatgagacaagtttaccacctccttgttcccttggtaatttgaccctggacagtaggttgacaggtatttcttcgttcacatgtgtctccttttaaagcttgtttactttctcggatagctcttgtgtacccaactaatagaattagcataacatatttttactcgaaggctcatgggaaacatgcttataagggtatattgactgaaagctgctgataaattatgcatttggcctttcttgaagtaataaatgaagactcatttgaaattaagtgtttggggagaccttgagaaacaatccctgattccaaactgacagaagtataatttaaatttatatttcatccaacatgcagtctcactttaatccctcctgtacacactaacagcttgatgcctgtggggcaaacggtaatgtataaaaacaaacaagaaaaaaggggcagcacttacgtgaggagggaagagtttgaaaatgatctccaggtctggctttgttttgtgtagcctttgcttctgtccttttttcaccttcgattctgttctccaaaaccatatacaccttaatgatctgaaagaagacctgtcagtcagggtatggaggggctggaatgtcactgacagtgaaggctctgtgtgggttggccagactctgaaacagccttgctgctctatccccaggcacattcttggtttgtgtgtttcaaatgctattgtttccttgtctagaagaaccatggagacggaacagagaggagggctaattcatactgacccttcataaagttcccaaatagattttaaactttaataacttaggtttgaggaaagacagaaataatctgtaatgtttctgataatggccagtgaattctcttcacacagctggaagcaattttgaaagtagcatttggagttgtttcttacctataatttttttgtttttttataagatcctgaaaattaatatgttatacatctttgtcactataatcactccaaacttttaattttattttctgacaattataggatttttaaagaatttttgctttattaagagaaactaaaagaatgaacctaagctaataaatatccttgatctcaacattagtttaaaagaattggtacagaaataaataaaatgacacaaaatgaagcactaagccaaatacaaagggtgctgcattattattattttcctctgcaaaaaatacctaacgtgtgtgcacacacacactcactcacacacacacacacacaaacaaacacacacacaggctctcacacaaagaatggttacataacaaagtaaacgttataacaaccacatctgtttgactcttaatccaaactaacacgaaaaatctgtcaagacaattggggtaatttaaacacggattgggtatttaatgatattaagaatataattataattttattaggtgcagttttggcatgcatgtttggttcaaacattaaaaacattccaattgaggaatgaaaagctacgtatcgggtattatgcttttttaaaatttattatagtttaagttctgggatacatgtgcagaacgtgcaggttcgttacataggtataaacatgccatggtggtttcctgcacccatcaactggtcatctatattaggtatttctcctaatgctatccctcccctaggcccctgccccctcacaggccccagtgtgtgatgttcccctccctgtgtccatgtgttcttattgttcagctcccacttatgagtgagaacatgtggtgtttggttttctgttcctgtgttagtttgctgaggatgatggtttcccgcttcattcatgtccctgcaaaggacatgaactcatccttttgttatggctgcatagtattccatggtgtatatgtgccacattttctttatccagtctatcatggatgggcatttgggttggttccaagtctctgctattgtgaatagtgctgcaataaacatatgtgtgcatgtgtctttatagtagaatgatttataatcctttgggttcatacccagtaatgggattgctgggtcaaatggtatttctggttctagatccttgaggaatcaccacactgtctttcacaatggttgaatcaatttacactcccaccaacagtgtaaaagcattcctatttctccacatcctctccagcatctgttgtttcctgactttcaatgatcgccattgtaactggcatgagatgttatctcattgtggttttgatttgcatttctctaatgatcagtgataatgagctttttttcatatggttgttgcccacatgaatgtcttcttttgagaagtgtctgttcatatccttcacccaatttttgatggggttgtttgtttttttcttgtaaatttgtttaagttccttgtggattctagatattagccctttgtcagatggatagatggcaaaaattttctcccattctatagattgcctgttctctctgattatagtttattttgctgtggggaagctctttagtttaattagattccatttgtcaattttggctttctttgccattgctttttgtgtttttgtcatgaagtctttgcccatgcctatgtcctgaatggtattgcctaggttttcttctggggtttttatggttttaggttttgtgtttaagtctttaatccatcttgagttaatttttgtataaggcataaggaagtgttccagtttcagttttctgaatatagctagccagtttttccaacaccatttattaaatagggaatcctttccccattgcttgtttccatcgggtttgtcaaagatcagatggttgtagatgtatggtgttatttctggggcctctgttctgttccattggtctatatatctgttttggtaccagtaccatgctgttttggtaaatgtaaccttgtagtatagtttgaagtcaggtagcgtgatgactcctgttttgttctttttgcttaggctatatcacttggccgtatgggctcttttttggttccatattaaattttaagtagttttttctaattctgtgaagaaagtcaatggtagcttgatggggatagcattgaatctatgaattactttgggcagtgtggctattttcactatattgattcttcctatccatgagcatggaatgtttttccatttgtttgtgtcctctcatttcgttgagcagtggtttgtagtcctccttgaagaggtccttcacatcccttgtaagttggattcctaggtattttattctctttgtagcaattgtgaatgggagttcactcatgatttggctctctgtttgtctgttattggtgtataaaaatgcttgtgatttttgcatattgactttgtatcctgagactttgcttgaagttgcttatcaccttaaggagatttttgggcagagatgatggagttttctaaatatacaatcatatcatctgcaaacagaaacaatttgacctcctgtcttcctatttgaataccctttatttctttctcttgcctgatttccctcgccagaacttcgagtactatgttgaataggagtggtgagagagggcatccttgtcttgtgccggttttcaaagggaatgcttccagcttttggccattcagtgtgatattggctgtgggtctgtcataaataactcttattattttgagatatgtttcatcaatacctagtttattgagagtttttagcatgaaggggtgttaaattttattgaaggccttttctgcatctattgagataatcatgtggtttttgtcattggttctgtttatgtgattaattacatttattgatttgcgtatgttgaaccagccttgcatcccagggatgaaaccgacttgatcatggtggagaagctttttgatgtgctgctggcttcagtttgccagtattttattgaggattttcgcatcgatgttcagcagggatattggcctgaacttttctttttttgttgtgtctttgccaggttttgctatcaggatgatgctggcctcataaaatgagttagggaggagtccctctttttcaattgtttggaatagtttcagaaggaatggtaccagctcctttttgtacctctggtaggattcaactctgattccatctggttctgggcttttttttttgttggtaggctattaattactgcctcaatttcagaaattattattggtctattcagggattcgacttcttcctggtttagtcttgagagggtgtatgtgtccagcaatttatccatttcttctagattttctggtttatttgcatagagatgtttatagtattctctgatggtagtttgtatttctgtgggatcagtggtgatatcccctttatgattttttgttgtgtctatttgattcttctctcttttcttctttattagtctggccggcagtctatctattttgttaatcttctcaaaacacagctcctggattcattaattttttgaagggtttttcatgtctctatctccttcagttctgctctgatcttcgttatttcttgtcttctgttagcttttgattttgtttgctcttgcttctctagttctttgaattgtgatgttagggtgtcgattttagattgttcctgctttctcctatgggcatttagtgctataaatttccctctaaacactgctttagctgtgtcccagagattctggtacattgtgtctttgttctcattggtttcaaagaacttatttatttctgccttaattttgttatttacccagtagtcattcaggagcagattgttcagtttccatgtagttgtgcagatttgagtgagtttcttaatcctgagttctaatttgattgcactgtggtctgagagactgtttgttatgatttccattcttttgcatttgctggggagtgttttacttccaattatgtggtcaattttagaataagtgtgatgtggtactgagaagaatgtatattctgttgatttggggtggagagttctgcagatgtctattaggtccacttggtccagagctgagttcaagtcctgaatatccttcttaattttctgattgttgatctgtctaatattgacagtgaggtgttaaagtcacccattattattgcgtgggagtctaagttgctttgtagatctctaagaacttgctttatgaatctgggtgctcctgtattgggtgcatatatatttaggatagttagctcttcttgttgctttgatccctttaccattatgtaatggccttctttgtcttttttgatctttgttggtttaaagtctgtgttatcagagactaggattgcaacctttgcttttttgttttttgctttccatttgcttggtagacattcctccatccctttattttgagcctatatctgtctttgcatgtgagataggtctcctgaatacagcacactgatgggtcttgactctttatccaatttgccagtctgtgtcttttaattggggcatctagcctctttacatttagggttaatattgttatgtatgaattcgatcctgtcattatgatgctagctggttattttgcccgttggttgatgtagtttcttcatggtgttgatggtctttacaatttggtatgtttttgctgtggctggtaccagtttttcctttccatgtttagtgcctccttcaggagctcttgtaaggcaggcctggtggtgacaaaaatctctcagcatttgcttgtatgtaaaggattttatttctcctttgcttatgaagcttagtttgactggatatgaaattctgggttgaaaattcttttctttaagaatgttgaatattggcgcccactctcttctggcttgtagcgtgtctgcagagagatccactgttagtctgatgagcttccttttgtgggtaacttgacctttctctctggctgcccttaacattttttccttcatttcaaccttggtgaatctgacgattatgtgtcttggggttgctcttctcaaggagtatctttttggtgttttctgtatttcctgaacttgaatgttggcctgtcttgctaggttggggaagttctcctggataatatcctgaagagtgttttccaatttggttccattctgtccatcactttcaggtacaccaatcaaatgcaggtttggccctttcacatagtcccatatttcttggaggcttagttcattccttttcattcttttttttttttttttctttttttgagatggagtctcgctctgtcgcccaggctggagtgcagtggcgcgatctcggctcactgcaagctccgcctcccaggttcacgccattctcctgactcagcctccccagcagctgggactacaggcgcacaccaccacacccagctaatttttttgtattgttagtagagacggggtttcactgtgttagccaggatggtcttgatcttgtgttcatgctttatttcattaagttgatcttcaatccctgaaatcctttcttccacttaatctatttggctattgatacttgtgtatgcttcacgaagttcttgtgctgtgtttttcagctccctcaggtcacttatgttcttctctaaactggttattctagttagcaattcctctagccttttttcaaggttgttagcttccttgcattgggtcagaacatgctcctttagcttggaggagtttgttatttcccaccttctgaaacctacttttgtcaattcatcaaactcattcttcattgagttttgttcccttgctggtgaggacttgtgatcctttggatgagaagaggtgttctggtttttggaattttcagcctttttgcgctattttttcctcatctgtgtggatttatctacctttggtctttgatgttggtgaccttcagatgggttttctgagtggacgtcctttttgttgatggtgatgctattcctttctgtttgttagtttccagtcaggcccctcagctgcaggtctgctgaagtttgctggaggtccactccacaccctatttgcctgggtatcaccagcggaggctgcagacagcaaagactgctgcctgttccttcctctggaagcttcgcccagagggctacccaccagatgccagctggagctctcctgtatgaggtgtctgtcaacccatgctggtaggtgtctcccagtcaggaggcacgggggttagggacctacttgaggaggcagtctttcccttagcagagctcaagcactgtgctgggagatccgctgctctcttcagagccggcagggtgggaatgtttaagtctgctgaagctgtgcccacagccgccccttcccccaggtgctctgtcccagggagacgggagttttatctataagcctctgactgggtctgctgcctttctttcaaaggtaccctgcccagaaaggaggaatctagagaggcagtctggctacagcaggtttgctgagctgtggtgggctctgcccagtctgaacttcccagtggctttgtttacactgtgaggggaaaactacttactcaagcctcagtaatagtggaccccccctccctcccaccaagctggagcatcccaggtcaacttcagactgctgtgctggcagcaagaatttcaagccagtggatcttagcttgctgggctccatgggttgggatctgctgagctaaaccacttggctcccttgcttcagccccctttccaggggagtgaacggttctgtcttactagcgttccagtcacctctgtggtattaataaaaaaactcctgcagctaactcagtgtctgcccaaacggccacccagttttgtgcttgaaacccagggccctggtggtgtaggcacccaagggaatctcctggtctgtgggttgttaagacagtgggaaaagcacagtatctgggccggaatgcaccattcctcacagcacagtccctcacagcttcccttggctagaggagggagttccctgaccccttgtgcttcctgggtgaggcgacgccccgccctgcttcagcttgccctctgtgggctgtacccactgtctaaccagtcctagtgagatgagcctagtacttcagttagaaatgcagaaatcacctggcttctgtgttgatctcactgggagctgcagaccggagctgttcctattcggccatcttgccagccagcagaattataggttatttttaaccatgtctacaatcttaatctttaaaggttaaaatatgtaaagtcaataaaaactgtatataatagagatatttaaacttctgccctgatatggtaaaccattaataaacagctttgctggaagctgactggctggccaggcttaactcaggatattgtcaaagttgatggtggtcttaaaggctggatggtattttctgtctttttcctctccacacttacaaactgccatagagtttgttaattagtcagcctatttttacgttaacagactattatttgaaaaatagtttctggatataaatgctacttagaatggactagatgaagaagaagaaaggaaggaaagaaagggaagaggagatgtaatagctattgtagaaaaagaagaggaccaccatgaccattatcaatcagttgttattgtttagtttatatatgctgaacattaatgctttacgtgcattatctcactcaagcctgaaaacaatcctatgaagtaggaagggacttttattatggccatttaaagatgcagaatctagggatagagggacaaagtaacctgcaggaagtctaaagcttcagaaagatagtaaactatgagccatgttggatgaaacactggaagttcctacacccaaaataaggtggtggaatgtctgatgggtgaacaaccacaaatctaggtttattgccctagttgttacatttacaggaccagatccaccagagtgtctgctcttggcaatgagtcttcccttagtgataagaacacacgaaacacataaacatatctcccagctcccagctcctgatgcaatcagttggttttctagatttattttgaataactttttgtaataaagtgtcctcttgacaaatatctggtagagaggaccaatgaaaccacgcagatcactgtcctgctttcctaaagtaagctcttccagaatttactttctggtctagagtccttcttcagatcctttgaatatttggcttttctccaaggattaggacttctcaatgctaattttggaagaagcacattaaagaaaaaaattggtgggaagataggagtgccaaaaccttgacatccatcaaaaggaaaaaaaaaaaaatgagacaacatctgagtattctttgatccatatgttcaagagccaaggattagagctccttgggatggagttgttggcagaaatccagcacaaggtgcaaaacttggtaaatatttgaaactccactcatggaactgagcacatagaatatgcatctagtctcatgtatgaaaattctagtcatagtccatagaactgatgaaatgtatgattctgttttaaatattatttgtattagtttgttctcacactgctaataaagacatacccgagacccagtaatttatagaggaaacagatttaattgactgacagttcagcatgacgggggaggcctccagaaacttataatcatggtagaaagggaagcaaacacactcttcttcaacatggcagcatcaactgctgagcaaaaggggtgaaaaccccttataaaaccatcagatctcatgagaactcactcactatcacgacaacagtatgagggtaaccgcccccatgattaagatacctcccactgggtccctcccatgacacatgggaattatgggaactacaattcaagatgagatttgggtagggacacaaccaaaccgcattgttattagttcagtctcttattagcaaatatttattgagtcccttgtgtatgccaagagctatgttaggtactggcaagatactgattaaaacatgtattgtcccattaaagatcgtccaacctaaaggaggaggcaggtacataagcaaaaagatagttcaacatatacagtaatggaagtctaaaagttacagagattttatagtggaagaagcgatttactatccgagaaagatcaagaaaatttttatagctgaagggctgcttcagctgggttttgagggatgaataggaatttatctattacataagtaaagtcagatatgatagcatattattatttgttctcattcaccactgtttttccatatagtcttagcaatagataattgaatgaattccctgattcaaatgctaaaatattgtgagtttattggtgtcaatttcttagccatgagagagtatagatatgggatttcttctttttaggagcatgatgccatgctagtatttccatttctgtctttcataccaaataagaattggtctctctccaggagagagaaccattaaaagcaagacattctgaaggttgattataatttagtcaccatttttgaaaatgtggtgtaaatttacaaacagcttgaccacccttactctcattaatacagatttctgggtttgatggaataatttcaaaactctgagaggtaatgagcaggcattctgccactcccagaatgcaaagcgtgtctctttagtccagtgtgtctccttagaccagtggggagtgggtcctttcctctctgcattgctctcttgatgtccccatcagtcttaatgaagcatgttagatcttctctgaactatgctgcttttttttttctatgatgagtacattggaggggctgattaaggaggcataaccagaaaataggactgtttggaatttaacaaaagacaaacaagcatataagggaagttctgcatcaatgtaaaataaaagaacaatgcatataaatttgtactaccaaaagcagtctattcatgtataaaccataatataatccaacgaaaatcaaacataaggcagaactaactgcaagcagtctgtactgtcttttcttaagtagtgtgttacagaatccctctaccctccaccttcctcccagcctattcacagaaggttttgaaacaaagtctacttgcaattcttgttcaatatcacctatctactccttcctctgctgaaagtgacaaggtgagaaatcttcccggtcggctgcttctttgggagtttctaaagtcaacttctcttgtctaaaacagtagaaagtagctcagtgacagaacctaacttttcttcctttgtgtgttttgctgaagcaagcgtctctctttggatctgtctgagcagtagatcacaaaaaagagtccctaagcaggacaaaacttctctctgagttcacttttgccctgacatactagaagccctaattttaatcatcaagatcctcaagctgcaaaacggtttgcaatttgcctttttaaatggtcattcattaattattctagaaatagctatgagaacctaccatgtgtcaggcactgaggatccggcaaaggagaaaaacaaaacctctgtccttatggagattctaggctggaagcagacagaacataaacaaatgtcccttacaccatgacaaatgcagtaagtgccacagacggctgaagaagccagacccataagaaatggacatttaagctgagcccttaaggatgagtaggggttaatcaggcttaaagagtgctctagatcacaaaaacaatgagccactaggggcagaaacactaaggtgccagaaagagaaagcaagagaaagcaaactagaaaggtaggcaagggcaagatggatcaaggctttggaccatgttaaagcttttggactctacctcgagaacaattaaaagtcactgaagctttttaagcaggagagcaaaataataagatacactctgctttttgcttttaataatgatagctgccctatgataaatggattggggggcagttagagtggaaagtatgcaagactaaaggtccagtttggaaaataaaataatagttaagataaaaagtggcatgcctttgattagggagtggtgctgaatattcaaagatgtgaggtatagtttgaaggtaggatcagtagaaattaatgattgctgggatttgaagatgaaggttaggattcttcaagtttttgacttagatgtctgggtgaatagcaatgtcatgtgctgaagaaggaacaggtttttgtggcagaaaacaaaagttcagttttggacatgttacatttatgaggcaagagaattgagtgcagttattggccagacttattttgattctaaaataatatgtataacacagaaaatcatccatttacagataatagcatatgtagtatatccaaagccctcagcaattgatttttctctttaaaaaatgtctctccaggccagatgcagtggttcatacctataatcccagtaatctgggaggttgagatggaagaatctcttgagcccaggatgtggaggctgcagtaagctatgatcacacccctgcgctccatcctgggtgatagcgtgagattccatcttaaaaaaaaagaaaaaaaattctctccagaaatttgttaaatttatttcacacaatcatataggcctgtgaatactaacttttctttgtcaaatactttttgcttggcactaagctttacctacaggatcccatttaatcccttaagctctttgttaggtatatgttactatccatatttaaaatacagggaaaccagggctgggggaattaagttatttacatgtcacccattagtaagtgacagagctgaaatttgaacctgggttgacctgactttaaatcccatattcttaatgaccatatgataatgcctggggaactaggaagggcgggggctggaaaaaactctgtctagcctgatggcaaacaacaaattaatttgcttaggccatgaaatgaagtcaatgcattacaagtggcataaggcgagaaatgatctatgggatgaactccagcctgttactggacatagacttagtcattgtcaaactcataagccaggccagatgcaagagacccttctctgaagctctgaggaattggtggcaacccggatggtaaatctgaggcctcaccactccatggtggtggcagcatagcatatgatttacggggagaggttttatgccctgcatattataaaatatgagtgcagattgacaagggagaattaagaagcacagctacttgtttagctctgcaactcgtaggatctttttcattctaaacagagctctgccagattgctgggagaaagcgcaacagccatgggtgccatggctgacccttggggcatcccttgaatatcatccttgttcctgttagcaggaagcatgacaagtgctcagaaaaagaattgagcatgttgggcttgctgagtggtatctaaggaatctaattttggtgtcagaatttttaaaaacacactttttgtcttcaagaagaagcaatcttagactaatctggatgccttattggtagtgcgtatttggaaatcgagattcaagaccttcagtaaatgaggctttcacagagaagaaacaagattgttgaaacatcttcaccatgctgagtgcaaagactattccaaacttgttctcagattgatttttctacctaaggattaattttctgacagaatcactgacaagcctgatctttagaatattaaacctaggcaacctgtttgcttttttgtttgttttttaatgttttcaagtgaggtttaaaggtaggattcattctgggtgaaccaaatgcatcgaagcactttcaaatcaataggcagcttgatttctctgtattgcaaaacattatgccccctctaaattctcatcacaggcaacatggaaattaatgagacctttagattagcctttcaagctcagccttattttatagctttaccttgcctttttgacaccacgatctcgcctggccaccagcagcatttcatgttgcagtgcactttaattttgcagttttcttagtcttccttggaaactggcagcttattaatctcaataactgagctgctcaataggcaagctcaccaatgagagaccaggctgtgtcttttttttttcttggcagatggaaacaagggggttggttgttggatggaggcaagggaggtggcagagaaaaagctggttaggaggggcacctcatcccccacatcactttctgataattggcaggaaaataaagcaagcctagtctaatccactgctctgtaatttatggcttgtggtgttaaacacactcgaacccattaataagaaaataaataaagtgttgtggcacgtgtgcaaattacaaggtgcattaagaaagaaacaagcattacatcttattcaagaccactccagcctattcttggcatggtctgcaaacttggaagcatcctggaaagtggaggtacctaaggagaagctgtcctttttaaatttgcctgcctctacaaaattaaaaacttattgaggaattgaacttcttattgcagggtaccacagctaagtctctaggtagaaagaacttaaaaaaaagaaaaataaaaatccatccctcagcagcctttaccgtggggacccaattacaaattgagaccaccctgtggtcatgcattgtaagagcaagactttgccctgagtctgtgtaaatgtcgaagactctggggttaagttcacagttgaaaaaagccaaatatttccatctctgtctgtgctctttcacccattcaactaatatcaactgtcattcccttgaggcacttcctgaagtcttcccagaggatattttatctggctcagacagggagaaacttgatgaagcgcaagtcctttctaattctggctccctgatgatccttttcttttcgcagaagccagataaggcatccgcagtcctaccaggcaggggaagtaggtcctgcaacttttctgaaggcacctttgatttattagtcttggccttatttgcttttgtgagttggaatcttatgtccccagacttgcaaaccgtcacgagatactcagccattctgctcagctgcagctgcatcctttagattttatgggaatgtttaaaaaaacttttcctacattaggtttttttctttcaaaacccaccagacaatttggggccattctgtgagtattctttgcaaatactcctttgagaggtcatggcaaagcgctgcacaaaggatcaccctcaaaatcgtgtatttttcaaatcccttattgaatcatttcttgctcaaaataactgtttaggagtgaggaaatacctccaattgctgtcatttgtacttaagctgtgtatgccttatagttcaaaagagactgaataccaattcttttctatgtgttaaatggtactgaaatcagatttcaatttgctagagcttcaattgcgaaccagcattcatgagtccatttctcaacaattaatactcctgtaaaggtattgcacaccaataatacgacctttaaatttttattttattttttaattatttgaacaaagggttaaaatcccgccctaaagggaaggtgggaaatgttgctttacttaacactggtatgttcttagataagaattttcgatgatcttagtgactttcttatttcttatcaacgcagatcctctccactatacttggggacatgtaatgagaaggcacagggagctattaggcccactgaagcatttggtgggactctaaggagctctactctcccccatccccactctcaccaattcaggaaaatgaaggaataaatttacaagccccctgtgcaaggggcggtgctatgcacatgtgcattttctggatgttcttgtactcagtcatcttttccagcttctaactctcagaatccatacaaggagacattgtagttctattgacaatcttttcacttcttggaaaccacggaccactccttttggtctttgtttttagacataatcatctctgaaatgccgactttgtgcccagtaggatactaggcactttacatcatgttatctgaattaaagcccttaggggagagatgttgatagggtttggctgtgttgacacccaaatctcatcttgaattgtagctccaacaattcccacgtgttgtggtagggacctgctggtgggagttaatttaatcatgggggcgggtctttcccatgctcttctcgtggtagtgaataagtctcatgagatctgatggttttataagggggagtttccctacacaagcactctctttgcctgctgtcatccatgtgagacgtgacttgctcctccttgccttctgccatgactgtgaggcctcctcagccatgtggaactgtaagtccattaaacctctttctctttataaattacccagtctcgggtatgtctttattagcagcgtaagaacagaccaatacagatgttcttgtcccctttcaacatatcaggaaaatgaaacttgagaaagtggaggatttgggacagagagaagatcctgacagaacaggattcaagtaatacttaaactcaggctttgggagtctctcagccttgcacttctttactttctaccatcgctgttatgtaggcctcctcttgtgggatttttatggtaactatatgctatattctcaaagcttagaaacctaacagaaagtaaagcacttcttgacatttcaacaacactcccttgattgagtctcatggaatccaactagagtcacatgcccacaactgacccaagcctcaagcctggagtcttggcgagcagaccacattaattggccaggcctggatcacgtgcccatgtgggggcctcatagtggagaggaaggagtgtggcccataaccaaacatcgtgctattaggagaccctgaaatggagggctggcaggcaaaagccacagaccaactcaggccacattcaatgttaatttggtcacagcccagctcatattgcctgattgtaatgattttctcctccaggcagacacagtcccggccagggtggggaaattgcaggacattgagttatctcacttgccagagcacagaagggggtttacagctgattccaataagaagtcgaaaaaattaagtttcactgactaacttctgcccccttctgactcatcaccctctctggttgacttctcaaacgtcccacgactttacttttgagttcactgtggccacttaatgcattttaacttttattagtctcctgacatctcttttaagctatcatcttctttcctgcaaaagtgcttggattccacattttctaattaaaacatgctcatttattgtcttactaaccagtgctctttatgagggctcatgatgagaaagttaactcaaaacatctcgatgcatttcctctctcttggaaatggctggagaagcagttttgccttatcaagttgaatgacttcgaagaacttttggttttgctttttaataaaaccatgaatgggaaacatttaactccatgcttcaagctcctaatattctcagcaatgcagtatattctgtttgttgtggtgtgtgtaggtgagacagattgcaggggtcagatagctccataatgagtataggtaatatcagaatagttctgtgtttaattagataaaaatttttgtcctaacatgcaacacgtcctaatgttcataatggtgcccattgctgtttatactccagtgaattaatctgatattattagaggttgtaagcttcagtgcagcagggggtaagggtggcacacatgcatttaaacccaccgagaatttcaatataatcgtgtgtgtggtggcactggggtgggctgggaacaaggtagaaggcgcatattcagtatatgtctgcgtatactttgttttttcagtttcactactatttgctttgtctttggaaacataaaagcagtgttacaatggggacatcctcatgtcctgtcgataatgtgcatcttcaaattcataataccattcagtttggggaaaagagcgaagtatagcattcttcacagagcttaccccaaatagctaattcaggcagaaagggagagacagagatagagatagagatgatagagatagagacagagatagagataaagagagagagatggagatagagataaagggaggcagagagagagagagaaagaaaggggaaaaagggacctggtgatgcagatatggaaaaaaatagatgccctcttcagggaggtcggcccttgattctgaccactacattagaaaatattagaaggagtcaaggtcaacatgaattgggttggccaaaacaactgagcccagctggacgcggtgcctcacacctgtaatcccagaactttgggaggccgaggcaggtggatcacttgaggtcaggagttcaagaccagcctgacgaacatggtgaaacttcgtgtctattaaaaatactaaaattagccaggcgtggtggtgcacgcctataatcccagctacttgggaggctgaggcaggagaattgcttgaacctgggaggcgaaggttgcagtgagccaagatcgcgccactgcactccagcctgggtgacagagtgagactccatctaaaacaaacaaacaaacaaaacaaaacaaaacaaaacaaaaacaaaaaaaaccctgagccctgatcatttaagtgaaggggtcatcatttggctgcacagaggcagagttttcaaactggaaaccaagttaagatcacctagtatagtccaatgtctatttttacagacaaggagagtgaagctcagaaagttccacaacacgccagcgccttccactataaatgccggagtggggctggaaggcaggcctctggccagagctttccccagcacccctcactatttcctgcatgattagggaatgttggtgcctacttatcccacacagaatatttatctccatttccttctgcaaaggaaaggtcatgaatttaaggcaaagaattagagcacatattgcaacagcttttgtcttttcagttattttattgtagaatgtacacattctcttggtaaaatattcaacacatagacagaaaatggaaaggaatattccctgcttttcaatttccattttcaaggaaatttcatttgaaggttgattattttaggctttcaaaaatgcttgtggatgtctgagcatgtatattttaagtttaatataaatggaatcatatacatatcatttggcaacttcctttttatcacttaatcagatattgtggaagcattttcaggtaattttatgtagacttacctcattcttgtttaaagtccgtgtaatattccataatgctctaatttatttaaccagtctcttcttgatggacatttagatcgctttcagaattttgctattaaaaacaaatctgtaatgaaacatcttgtgtatatatctttctttgcatacttatataattatattcaaaagttaaattcctggaagtgaaattactagatcaaagggtatgtataatgtgcattttgaattttgatcgattgtgccaaattgtatctgtctccattcaaatgttacgatctctctttacttctccttatttgatggcctgagtttcttttgtggctttaaaataagagcccagaagtttatggtgttagatttcagacatagaattaagaggattttttttcaagtaataatgtaataaataatacataaataccctagaaatgccaatacctcttcttaatgccagatatagtatgagaaacagacatagctgcaggggaaaatctgactctctcactccccttggttctagctgtagggccctttctcttcattcccagactgtgctacagcatggcctacgtgattcaaaactcctaacctttgttgcctttcctttctcattattatttggcaatgtttgagtttgcctcttctcctcatccaccttgcctctatctacctaatggggatattataagaatgtctaaaaagacctagtcaagtttctgaatcccaagagaaatgcctagtaaggcggtatgattgtttaactattacagaaaagcattatgatcaagggcttgaaaatctggcgaggaagacagccttttttgtgaaataagtatgtgagggctctgtcagtaagaggccctcaggccaaacttatatagttactttatctgaaactctgattttatgctaactaaggatttttgtatttcccacctcctgttggtaatcccattaccagctgtgttcataggacttcagcttaattcagccaacatttgtaggggcccaacacgcagctgagcaccatggcacagagagtgaaagatcgaaaagacatggcccctgacctctgggaatcacagtctagtgggagaaaggtcacagagcagattatttatattgatataggatgttgtaagctggacatgagctcaggggactctacggaagcatggagcgtggagtgcatccaacctacctggtcagggaagcctggctggcagatacggggtctgagttccatctgggtggaacagtgagagctgccccagcaaaagggcattccaggcaaaggtgagagaataggaaaaggccggaagagcaaggctgtgccagcattctggaccaaccagagtgagactcaggaggcagggtagagaggtctcatggcccaagtcaaggtcaccttctgggtgcagtcaagcactctaaggtctattcagtgtgggatggggagcccaaaagggatgtacacaaaggcatgttacggttagatttgccatgaagaggtggaaagggaggatacaccagaaagggaggaaactaaaagtacattgaagttaaccagtgcctctgatggaagaaggaagggagaaagggagggagggagggagggaggaaggaaggaaggagaaggaaggaagggaggaaaggagggagggagggaggaaggaaggaaggaagggaaggaaggaagggaggaaaggagggaggaaggaaggaaggaaggaaggaagggaaggaaggaagggaggaaaggagggagggagggaggaaggaaggaaggaagggagaaagggagggagggagggagggagggaggaaggaaggaaggaagggaaggaaggaagggaggaaaggagggaggaaggaaggaaggaaggaaggaagggaaggaaggaagggaggaaaggagggaggaaggaaggaaggaaggaaggaagggaaggaaggaagggaggaaaggagggagaaggaaagaaggaaggagggaggaaggaaggaaggaaaaagggagggaggggtggaggaaggagggaagaaagaaggaaggaaaggggaactagaaggaaagagatacatacttaaagtaggcagtctatgggattcattgataattatctgcataacagtaatagccaacatttattgaggatccactcaatgtcaggtgtgtgctgagccactcatttaatagacacaatattcctaagaaatactttccatcattttcactattttcatatgaggaaacgaagatgtaataataacaagtcatttgccttaggctgcacaggttaaaggtgaggcaaccaggctctgaccccacctgctgccgacagtttccttattaaccatcgccccatccagcctcctagaatcagcagggctgtcccaacctgaccgactgtgaccctgaacttccctcttcttccttgcttctcctctctatcacttctcttccccctccttcctcacttccctccacagaaatgcagacattgctttgtttttcacataaccacttaatttcttgtcaagcaaaacttgagagccagaaaggatcccagttcaagtccaagccttcaagatgtctggaaaggcagcctccccactaccagacttgcctttaggttttgtttaattctgccacttgcaaagcaaatgcctgaaggcgggcacctgccttttagtctaacatgccacctccctgtcaggcaaatttcaatttaccatgcctcggcttgtccaactgtatctgcatcaatacttccaagatggcagtgacaagcttttcaggtacttaaggcaaacctgcatgacagttttccttgacacttgcatttttaaaaagccttgcctggggccctaggaaacccagcatttaagaaactaggaagctttcaaggaagcccagctttcagaacctgctgccctgggacttgttttgtgatagggatgctgcagggtctgccttagagtatattaagtgccatggcgatatttatgtgttgatgctaaatgatggttacctttcttagtggcatttttttttttttgacgactgaaatatatagatctgttttgtgcattgtcagtgggtatgtgtctggcctacaaacacacttaaatggcacacttctgcacaacattcctgagtgtccaacagatatatgtaggcaggcagacatgtcacaggggttgccataaagcttagttaatatccctgaagagctcttgtgtcatttcatgaagagttctaaataagaagaaaatattgtacctatggctattacacaaacaaagaaatgtgagtaaatatgcagatagggtttcttctgtttgctcatgcctcaaagagtctgatgtaaattcaaatgggaaaatagatagtaatagagatcactactgtttatttgagggttaaaaaaaaaaaaagcaacagtgccccaaacttaaatgcttgaaattgctatacacagttgatgtgagaggagcaaatctataataagcaaaaaggagtggcagctttctttttcttttgttttctttcacctctgccagcccctacatttagaattgttttgatgacttaagaattgtcagtagctatacaagaattcggataaatcaattttgttttccttcctcggccttgaagaaatcacatatgatacttagtctgtcccctttaatttttacaccatttatataccttcctctttctcttctttccttccttccttcatccatctacccagcaaatgcatcttgagcacctatgaaaataaccattatgggttttttggttggttggttgttttttcacttctttctgggccttaggatactgatctagaaacagagagaaatgaattagaacttcatttctcaaatgagagatgctgtggaataccagttttacggctgagaagaagggtatatatatataaagctcacaaaaataagtggaataataaatagtgtagagtactgggatatttatgatatttaagtattaggtttgtgaagacctgcagtaatgtttactccatttcccaaatatcatggaaccctctctgtatctaacattagtaatatacaaatatacttggtgatccaaaaagcacattttaagatgttgtatttcagatcctctctgatcttatgacagaagtagaaaggccagaattttttcaatcccttactaggaaggactttgtgatcttgccttctaaaataaaatagaatttttctcttagcataaacttttaaaatgaatttatacccaaactcaattatcaagtcaggcaatatttgggcttggtacataagtactgtttataatacagtgcttagagtgtaggctaacaataaaaacttttgtttaaaaatttcatggatatcattgggtatatacccaaatgaatataaattattctactgtaaagatgcgtgcatgtgtatgttcattgcagcactattcacaatagtgaagatatggaatcaactaaatgcccatcaatggtagactagataaagaagatgtggtacatatacaccatggaatactatgcagccataaaaaatgagatcatgtcttttgtgggaacatggatggagctagagaccattatccttagcaaactaacacaggaacagaaaaccaaataccacatgtttttaattataagtgggagctaaatgatgagatgagaacacatggacacaaaaagggaagcaacagacactgggtcctacttgagggtggagggtgggagaagagagaggatcagaagaaaaaattcctattgggtacaatgcttagaacctgggtgacaaaataacctgtacaccaaacccccatgacacgagtttatctatataacaaacctacacatgtacccctcaaccttaaataaaagtttaaaggaaaaaagaaaagtatgtctatcacatattaaaataagacgagtgattatataaaaaattgaagaacttaaactgatgcatgagttcttctaaatactttatataatacatcaaataaaatagaaaaaaatgtcatggatcgatagctttcctagaatataaaccccactaggctctccctgaaagctctttcctgaaatgagagcctgctgacttggggatgttaagacattttctaaggtatgaaatattttggctctttctactactgctgccacctggctccttggtgatgcttcttgttttgtaattcattaacagttttcaaaaacaagctcaggatatggataggatgcagagagactggcaaaatgcttactgtcaaccagaatttgagcttcctgaagagttcaatgttgattatcattttctacatttagaaaacatttagaggtttctcaaaaagttaaccattttatgaccatattatgtagttgggatgtttgtcctctccatgtcccatgttggaatgtgatccccaatgttggaggcgggccctggtgggaggtgtttgggtcatgggggtggatctctcatgatcaacttggtgccttcctcccggtaatgaataagtttttgctctattagttcctgcaagatctgatcatttcaaaagagcctggtacctcctgctctctttctacctctcttgccatgtgatgccagctccccttcccctctgccatgattggaagcttcctgaggtccttaccagaagcatatgctgatgcattgcttcttttacagcctgcagaatcaggagccaaataaacaccttttctttgtaaattacccagtctcagggtctccttaatagcaacacaaagtgtactgaggcacctctatgatgcagcaattcctctcctagggagatcccccaaagctttcaaagcaggtgctcagacagacattttcacaccagtgtttgtagcagtactatttacaatagtcaaaaggtggaaacaacccaaacgttcatcaatggatgaatgaataaagaaaaagtgtacacacacactcacacaaaaggaaatagtattccaaaagggaatgaagtgctgatacatgctacaatggggatgaacttgaaaacattatgctaagtgaaaagaagccagacacaaaaggtcacatattgtatgagtccatttatctgacatatccagaataggcaaattcatagagacagaaaccaaattagtggttgccaggagctgggagtgagagagtgaaggaatggcgagttactgtttaatagattttggggggaatttgaggttttttggggggtgatgaaaatgttttggaacttaaatagaggcagaatttaaacatcgtgaatgctctaaatgccactgaattgtgcaattagaaatggttaattttgtatcatgtgaattttacctcaacttttataaataaattaattaattagagaaaatagccggaggatcagcgtgtcaccctctgtataaaacgtctactcaagggagagacaacaagatagttaggctagagaaccagtctcttgctccagtcttctcctagaaaggtgccaggaaaaaaaatgtctgttctcaaaacattccttgaaagggttaaagtcacaacacaaaatacccagtacatgtgatttgattaatagtggtaaatggatctgagtgtgtaatatgttgacatctgaaagactgtcaacaggatccccattcaacatcagggtaaatgcaactcttcagacagatgtcttgaagcaccaaagataaggaaataaagaaaggtgcaccaggcaggactcctttgttacacaggtagggggaaaagagaatgctaaatggattcttctctaggtggagggggatcaacataggatttttccaagattaaaaccattctatcatattctattaaaagtgatttagaagagaaaaatgcaccatgaaatctccatgtttgcagagataccaaacctaggaagataaactgctctgtaggtgggcagagaggtgacagataaggatcacgtacatttaccaaaaattcttctagacttataggaagattatctctgaggtcccagttacaaactgggaactggccaggtgattcgtgtgaagtaatgcctgaagatatacatccactgggttgctgtgggaagaaagaaggggatagggctgcaaaatacagagcatccctatagaaactcttagaaattaatcaaaaatgcattatcccacgattttccaaaatcattaggtatctacagtggaaataatcatgattatagctgatatccctcaagaatgacagaaaacttgaggagaattccaatctaaaagatcaataaaatgaagaggctctcacaaaacacaccaaagtgctcctttgaatagaaggaagatgacttcacaacagattttaaaaaataaccgtgtgtaggaataatacgaacatgatgttgtttatcgaaatcttgaaaaccagagtgacgggattccttgaaaaggacactaccgggaaaataaataaaagtgttgcatctgagagcagagagaaactttttacattcatcacctcctacaggcagtatgagatgatctttcaagatcttttcaagctctatattggttcatgcctttattcattaaataaaaattgttggaacaccaaacctgggctgggcattcttccaggggctggagatacaatggtgaggaagaagatgaaatcctggccctcctggaatgtgcatgccattgggaaaggcatgtgacaaacaaggaatgaaggagatagctgcccaaggtgatgcatgttaaatgagatatctcaatgaagggtgagggaaatgggcctttgtattccacccccatctctggatgttgactgttctcagctgtaaccttggacaaggtaggatgcaagatgctacgatgggaaaggctgatcaagaaatcctttctgaggaagtgagctttgaggagagacttgaaagacctgagaaagaggagccatgcaatgagaagacagaaagagaggaggagagaagtttccagactgagggaaacacagtgtgaccacctggacatggggaggagcttggcctctttaaggaacagcaaagaggatggcaggtgccttaggagcagagcacggagaggttaggaagagatgacctcgaccatcacaagacgccttataggccatgatgcagagcaggataacttctaagtgtaaaggaatgggaagatttgaaatatgttttgatttatgtttgtaggaaatgactgactcctgtggggagaaggggtgtaatgggtaaagtggaaagagggagacctctttaaagattgctgtgtgcagcaggccaggcgcaagatgatgtagaggtgtgagtggtaagaaaaggaaggggatgtgttggaggcaaagaggaaatcaactgatgatggattgggtgtgagagaaggacaggaaccatggtgaagcctagtgaagtagatggcatggtgcccacccagatgtcacccttcaggactggagcaggtgtccttccagttgctggtaatgttggcagccaacagagctcagccaagtccctccctgagattggccttcagcagaagagatccacgtcttccaaggacctttctctgggaacagctcacatccagtgactggtccgagtaaggatatgaaggcccagcctcctttgccctaactggaacaactcagcagagccatccctgctccagagctttccatggaatcgccataggcccctctgccacagcatcacagttcagctccccgccatccccacccagggcagtctgcttcattcacttcctcacacatggtcttcccaagagcactttctaatacacttcctgcatgcaatatcttcccattcctagggatggctcctgcacaactggagaagtgatgacatctgtaactgatataggtgaagcctggaagagaagagaagcttggagtggaaatcaaaagttgtgttttggtcatgctaaacttgagatgcctaactatatccaaatgtagatagggtaataggtgtaatattgtgggctggctagaatattctggacaaaaaccaaaaccctcaaggcagaggtataagaagacagctgagctctttcatcacaaaggcctgtgctgaattccccatgagtctctcctaccctagtaatttttcagatagaatgctcctaaatgtgctttgctaactcaaagagatggcatagttagaacccttcgtacttggtctaaaatccagatccccttggccaggcatggtggctcatgcctttaatgccagcactttgggacggcagatcacctgaggtcaggagttcaagaccagctttgccaacatggcaaaacttcgtctctactaaaaatacaaaaattaggcaggcgtggtggcgtgcacctgtaatcccagctactagggaggctgaggcaggagaattgcttgaacctgggaggcggaggttgccatgagctgacatcacaccactgcactccagcctgggcaacaagagtgaagctctgtttcagaccaaaaaaaaaaaaaaaagaaaaaagaaaaaaagaaaatccagatcccatgccttcaagccatggttactggctaccttttcttcctgccactggcccggaacacactgcccttctttcacatcctcaaaaattccgtctttcccaccccagggactttgcacaggctgctcctgctgcctgggatgctcttttttaccattcttcatatggtcagttacttcttatcctcagacttctcctcaatcccatggtgcttctgacattttgaaagtatttcatgtatttattgtttacctggatgtgagttctgtttatttgttctgtctctccaattggaaatttcctatgaggataagaacttactcatcaatgcatccaagcatctagtaccatgtgatatatattccatgctcaataaatactggctgggcagtgatttcatatttgagatattgtgttcattgcagaggtggaggcaatgcagtacatacatatattaaacacttcctgtgggcccgcttctgtgttctcggattgtattcctgttctttttcagcccttccaatagttctgggatgtaaatattgctattgtctctatttttttagaggaggcatctgaggaccagggagaatacctagctttccccacatcatgcagctcctggaggagttgagatttgagtccaggtgcacctggctccaagcccattcattttcccctctaccataattagtgaattccttcagcagactttttgagcacctactatgaagagggaagggtaccagaaagcaaaagagagagagcctgactttgtaatttgacttaagaaacaagacaaaaacaaatgtaatcacatgaagcagaataacctagagggtccttccagcttgaacactgtctaactgtctgaatggtccagacactaaatgcaatgggagaaattatcctgctccttggctgtgtctgagggtgtgcattttttcttcatctacctctacctgccggtgaacacaaatttaagtccattcgaaatggctgtctggacactcccatatgatagtgcatagcgaattcaaggtcaaatctaaagtcaaagtcagacgtctttgtttttcttcccctactatatcaagactcttaccaattaacttgaaaaaagtcaccaagttaacaactccagagggggaaaaagaagaagaaaaaaaaaaaagactcttcatctcatccaaagactctgaaatggatttgctcacaaaacaccaggtttctttaatgacctcgagagaccttgcctgtcacactgagcagtatatcatttcatggaggaaaaaaaaagttttaccatgaaaaatgctatgttgtatcacagtgtgacactatttaaatatcaagagtcgaagcttctatttagaaaacggaaggcaataaattgagttgctaattattccagctgtgaatatttttggtacggctgcaaattttgaagagggcaaaatagaggattttcctgttgttcacggcatatgcaaatgtagtggcagtcccctatgagccgaaaggttcagggatgagaaaccttgaaagcctatttttttcctgaatcaaacgggcttgagtcgaagcttagggaactatgatataaaatggacttttgactacactaattgggttattggcttcttgtttttcaaacctgagaagtaacgattttaaaaactgtaagtcctattttaaaggaaacaattcacttctcaacctaagcataaattctcaactggaagaagagaagaagcacattagtaacatccctagtcccttctcttcctaggggacagtgagtggaggtgcctgcaattctccaatcaccaggctaattagaacgactcattcattcaacacatattttaaatcagctgggcactatgctcggtcaaggagatttagtaatggctaaaatatactatacacggctcctgccctcaagccattaatatctgcatttattgaccattcactggatgtcaatctcaatgctaagcatttcacgaataaactcacccaatccccctaacaagcccaagaagtagctactatcattctcagcctcctagcaaggttaagtaacttgcccaagatcacacagtgataaatatagaagccaggatgcaaaccctggttgtctcagtctaggatttgcagacttaaaactgccttctaggtaccatcctattggatttcttaaataattaaatgaataataatcatgatgatgacaatgaggaaatgtttctatgtagaaaaagaaggctgactacaaacatcagatgtttaccagtctatctctaaagtacaggagatgtttactttctatttttaaaatgtatatacttgacccagtgcagtggctcatgcccgtaattctagcactttgggagactgaggatggtggatcacgaggtcaggagtttgagaccagcctagccaacatggtgaaaccccgtctctactaaaaatacaaaaattagcctggcgtggtggcacatgcttgtaaccccagctacttgggaggctgaggcaggagactcacttgaactgggaggtggaggttgcagtgagtggagatcaagccactgcactccagcctggacaacaaagcaagactttgtcttgggggaaaaaaaaattatatgcttgttttttttgtaatgtgtgcatgttatatttgcaaacaggaaaataaagacagaacgcttaagcgatcacctagttttgctactcaagtagggctcagtggtgcagtatccatcatttttctcgttatctcttttttcacctcatcctctatgcttctctccttctgtttttgctttctctccacgttccatgtctctgtctctgtctgtctcaggaccctgccccttgaattttgcctcaaccagcaccattccttttcatatcggagagtatattaatggtgccagaaagggtggtggttatttaacctctctccagctaaatgtttcattataactcctgaaaacctaattacagtaactttacatgctacagtaccctttatgggctgcctctttattaaacttactcttttagagacaataaacctgatgcttcaaagtgcatggccagaaccagtgaaatgtaatgaaatctggagttctctagtgcacacctgatctccctcactgagcaccacagccccattcctggggtgtttctgcctctatccttcccctagcttttgatcaaatttcagacactgcttgtatgatagtctgaatattttagggattaatgggctgtgtatcaatgttttcatccgctcctctgaatacccatgagtttatttactggggaggtcaattttctcggtagaacaacagtcgacacctggtttccctgataaccagagttgcttttttgcacacagcgctacgttgagaccatttaagacttttgctgtatttcaaaaacgtttgctgccgcagacttcgtgagcaaagaacaacatgtcagtctgctctgttagtcattagttgtcctggttagctgagtggtacactgtgatgagattgtgggatacggggtgagagagagagaggaagagagaaacaggaaaaaaggcattgacctttggagttgaggcagcacaattatttgtatagtacatttcttttcacagccctgctaggattttcccctgggaataaagccaaaacaacagaaaataaggggatccccctggttgcaagctgcaaaatggtacttagtgttaaggaattttatgtatttgtttgtttgtttctttggtgggatttaaggttaatgactaagtttacttgtgattgactcagagaaaagggaaaaacaagaaaaagaaaagaaatcttttgttggagcctcaggtagcttagccagcctccgcttctcaaagctaccactctagattagtcaagctccttctgtatcataagaataaaataaaaattcacagccttttgaattggtgggggctcttgttgcatggatgttatgaatgaggtttttttgtttgttaggtttctttttaaaatctttcatggttgtttaatcagagacaatgcatgcccttaattttctaagccaatttgaagcagaagcctggttaaccaagattctgcctgaaatccatgtctttgctgtcacgtaaaggatacaggagaatggctgttcagcttttaggtatgcttctcagtttttattaaatggttttgttttcacatgaggaaaagtgatgacatttaccaaaaaggttgatagtttagggtgaagtgatgatccctgtattcttaagaagtcacaggaatgcaggacacagagctgagaacgcagaacctttgccttactattccatcccaagcccctaacctgtgcctgacagaatgctgggtgctgtgaccaaagctcccatcccccgcatgacatgactgggaagggaaagaagtgtgtgagctcctcttttattttttgtaagacatcaaggactggttttctccatctcttggagtgttagcaaactccaaggatggcactttgggggcccctcatttgcctttcctttcggaggcacaagtggccaattctgagagcaattgagttgtgcttgaaaaacgtcaagtgcatttggaaactacacatttttgctgatgcctggagtcccgagctgagctacttccatgaccgaccgctgggaagaagttcagttggggcatcacaaatgattcatctgaacacactgagcaggcctctgaaggggagaagctgtcttaacagccggttcagggaaaaatcaggagaagtcccctaagccctcttggtcctccctgtgaccatctggccaaaccattaccttgtgggtcttgcttcattttatttgattttccagcagcatgtgactgaaatccttgggtgaatcaaagcttgaggttttttcaactttttgttatgaaaaatttcaaacatacaaaaaacttggaagaatagtaccatgtaagaataaccacctggtttcaacgattgctatcattttgccacatttgccttatctgtttttatagagcttgagagatgagatctttttgctgaatcttttgaaatgaagttgcagacttcatgaaacttcacctaaagacgcccacatccaaagcttacattaaaaaatatatatctactaacaatctggtatgtcctcttcaagtaagatgcatttggaagggcataaaagtgattcaggtagaatttcttaaatgttaatgtacactagaatcagctagggagcttcttcgcttcctttttttttttttagttggagtttccttcttgttgcccaggctggagcgcaatggcacggtctcagctcactgcaacctctgcctcctgggttcaagtgattctcctgcctctgcctcccaagtaggtgggattacaggtgcccaccaccacacctggctactttttttgtatttttaatagagatggggtttggccaggctggtctcgaacccctgacctcaaatgattcgcctgcctcggcctcccaaagtcctgggattacaggcatgagccaccatgcccagccactagggagcttcttaatcgatatactcccagactccaccccatacctggatagggcccaggattttgtactgtttttaacactgagtgccgcgttaaaaacagtacaaattcctgggaccaggcgatcacttgagtgctgtgttaaaaacagtacaaattccaggtattcatgggacacagtctgaagatcacttctatcgaatctttctctttttgtttgctgaatttaatcttctaaagattagtgacaccagggtgtaactgtatcatgggagaaataggattctacttatcgttggttttttgtttaatcattttaaaccccagagactagaaggaagggaggtgataactaaatgggtttctttcagctgcaatcatcacagacaccacagtgccaatgagcggcctgagagctacatcctgcgagggtttatgcagtgctgaaaagcatgcaggttgttttttctgtggagggatctggccttgcatgtgtaaatatagactcttgcctgcatgtacatatgcaaacttgtaaatctgtttggcaaacaggcatcaacacggcaggaggagcctattttaaaattaaaaatgttcacagcactattcttttagcattcattattttggtcttggaaaaggttgtaagttatttatttaacaacgatttgttgagttcccccactgtaagccaggctctattttaggtgacaggatgcggcgtgaacaaaataattattttaaactttattgaaattcagttctaacgatggggacagacaataagtaatatgcaaatatacatatgcatttaatgaagaaaaataggcagttatgacagggcagagagtaacagaaattgaaggggcccaggaagatctctctgaaaaagtgctatgagagcagagattgaaggaacaagttgtgcagatatttccaggcagaaggaacagtaagtgcaaaggcccggaggcaagaagatgtgatatgatgggcaatagcaaaaggataatatgatggatggagtgagggaggacaacagaggtggaagcttcagtgggagaggtagccagagggcagatcatgcagagagttgaaggccatgagaaagacacctgattttattctcaatattattagaagcctttgtcagggagaaagggcgctttgtttgatgacatgtgacctaagctgactttatttttagaagaaagtgtagaaaatggactaaattgtcaagggaacatttttaggatttcacgaagcagtgccatatgcaagatataatcatatccatttttcgtataaatgagtgtattaaaaataacattaaagccaatttaaacttcttatctttaccgtgttgctctcatgttgctaaaacatttctattttcaagttatttattctgtccacaaatatgactgatgtccaggcactaatgtttcgactctggagataacaggagtaaggaatatctaccagttcaagtgtccaggagttcacattctggttggggatagacacatttaaaataattatatatagaaagagattaataacaccaggatataactgtatcatgggagaaataagattctatttataaatagaatgtagatagatagatagaagatagagaaagagagagagagagagagagagagagagagagatagatagatttgtgagtgcacaaaatgaagggggctgtgttagaatagattccccaggtaggtggttggaaggtggataggagttagctaggatgggttaggtgggacagagaagaaaaagccatttgattcaattgaacgggcttgttaagacaaagtgtgtctttttgtgtggctgaagcgtgagtgcataggagctgggagcactgattagaaacaagggtcaaaaaatgggtagagagccatggttccatgttgtagagagcttggttccatgttgaaacttaggtctcatctttcaggcatggaaggataaccacggatttgcaagccagagcacactggcactgtggcttgggaaggaaaaggcaggaaggctaaaggacggggttggtgggtaaggttttcagaaatgaaattgttgggattcattaagctattggatggggaaaggcaagggaaaaggaggaagttccttgggtaactgggagtaaaggaagtccaggaggggtggagttgggcatgtaaaggaatatagtctgagtttggttgtgacttgttccagacagctgtgaaatgtagaagacaagctgcccaatgcacaacgggatgtgggtcaggagctaaggagtcatgagctagatagaaatggagctttggagactccagacccatcagtggtggctgaagacctagaaattggcaagatcactgaggatgcgagaactggagttcaaatgttttcactcattagtgactccttacaatgcctttacgttcctttgttttcatttgatttcctattttcactactcactctgggagaatcatttaagaaataaattcggaggactcctaaatcaaattccgaggtttctctgtcaccctggctttctgctgtggatatgttctagcgttgttataaggcagcagactattatttagtgacttagagaactcttcaggtgtttgttcaacatttgtcaagctttaaattaaaatctgcatttcaggctccttatgtagctctgaagaattaataataaaagctactcacatgggctgacacttactatgggacacaccttggttaagttcttttgctacgtaatcctgcatgatattgtaggattagtgatgcttttcctacacagtgttgcaatcctcacagcaagcagttatgaggtacctgtacttttattacctctgttttacaaatgaagagatggaggttctcaaaagcagtgtcaggtacttgtcagaaatggcacgaccaggactaccaaggtctgtcttgtgctacaatgctgtcatgaacaccatgcctagcttcctcttccaaaacaccattttaaaatggagcattaaaaaagagccattggacaaggagtccaaagccttatttatggaatcaaacttctaggctttattttaacattagctgtgttaaataattcactaatcagatactcattttctgacatgattgtcagtcatattgggtttgtttgatctctgtgaaggattaaaatactttcaaggttttatctgcaaacagccaagatacaaatatttgtaatgatagcaatcctgccttagaagcccactgggaaagcctgctagcccccagaggcaaggcagtgtggtgtagtaggtctgattagagcttccaaagggtctaactggatgtaaataaaaaaattttttaagtcaggcagactggagcttgagccctaatgacccgcttgccaactcccagcgtcagttttctcatctgtaaaactgaggtaataatagtacccacctggtgggattaatgtgaggtttagttgcaagtaaaacattcagcattgtaactgacacattgtgagtggtcaataaactaagtagcacctactgaagacatcaagagaaaggaaataactgtagtaacattttgaaaccttagaattgcagctgagtaaaattgcaagacaatgagaggacttcattcattcactcattcattcactaaaatccccctctgcatgttgggcttgatgtgggtactgggaacataggacgaacaaggtacaaaataagacatagtccatggcctccagctgctcagattctagcatttacttaactcctgccttaaatcccactacacatttcctggaagacaagtcatcgttttaaacaaggtctagcaagtcacatttgaagtcttgtaagtggcatgtataagaaagaatcatcagagaattaatggtccttccttaaagtgcccttggagcgacagactcccgaccctgaggaggagctatatcctcttctacactgcctgttctactgtatggttctgctgtgtggttgtcacaccacagctctggctaacacggacaccttattcaattgataggcaaagatgattccaaagaaataatcatgatcacatgaccttggagaaggcatctcagaacaggaatcaggatttcacgggaggtgaaaacggaacaagggtcagagacagtgtagggtaaaatgtcagtacacaggttttatcgaaagacagagctctgggtttcagtcctcagacagttgcttggcttctcaaaggctaatatctccaatctaaaatggagagattctgccataaaaatggaatgaaataatggcttttgcagcaacttggatggagctggaggccattgttctaagtgaagtaactcaggaacggaaaaccaaacatcatatgttctcacttataagtgggagctaagctatgaggatgcaaaggcataagaataatataataaactttggggacttggaaggaacggtggagggggcgaggaataaaagactacatattaggtatagtggacactgctctgatgacaggtggaccaaaatctcagaaatcaccactaaagaacttgttcatgtaatcagaaaacacctgtacccccaaaactattgaaattaaaaaaaagaatatatctggattacagaaagaaaaaattaaaaattttaaaaaataatgaaatgaaatcgagatattaaaatatttagtttgtaaatagttgtgacaatacatttcaagtacctttcaatagtaggtatctagctctatccatgttcctgcaaaggacaccatctcattattttcatggttgcataatattccacggtgtatgtatagcacattatctttacctgggtgacaaaataatctgtacatcaaatgccagtgacacgagtatacctatataacaaactgcacatgtaccatgaacccaaaataaaagtttttttaaaaaatagtaggtatctaatatgtgataacacttagcatcctcaacctcatcatctctgaggaggtgacagtcattcagtttccatatttgctttgaatgctttgcaggttgttgtggaagataacaactagatgcatatgtgaaaggagcaaattatgcacatttatggaattaatttatgtcatcatcgaatgtaatgttcgccccttcttccactccagggtaagcttagttaactaggattatgctaggactagatagagcagagtggaagaaaaatagctaaatgttgctccttggctacccatgaccactctgactctttcccttttcctggcaggcacttcctcttcaagacctcctcggggagcacacccttgttcagcagctcttccccgggataccctttgacctcaggaacggtttacacgcccccgccccgcctgctgcccaggaatactttctccaggaaggctttcaagctgaagaagccctccaaatactgcagctggaaatgtgctgccctctccgccattgccgcggccctcctcttggctattttgctggcgtatttcataggtaagtcagggcagccttattcagcaacgctggggatgacaacatgaggggagaggccatggacttgtgaatctagaggccctctgatgtctgtacagtttgcttctttgctcctgaaagatgtgataatgagtgatggatggaggtgattttttccctcctgaaatccacttaaatctgatgagtttctccttcatgtttctaaatgacatccatcagaagggaaattaagcatccttactatatcctttcttggagatgagctgagacttttcattcccgcaaacctatccctcactctcagagtggccttctagttttctccatccttggattttaacccaggtctgtgctttgaaatgtatgcaacattggttaacttcagccaaaaactgaattgaagaatagtggttggcatgtctgagaacatcttgattcgagagaaagccaaagtagctagcttattttcagagctgtggaacagaaacaggactgacaggctggagcatccatccaggtctttatacagaatcgaattagccagacacacttggccttgcccatatcccttccacagcctctgtcttctcatcctcaactctctcctcaccatggacagctgaatctgaatcagggtcacctctcctggcaactgggcttctggtgactcagtgtatgacataggtgaagttgctggagtatctttctctgcatgccaaaggtgttggtttacagccatagggtgtagccgtgtcaccacagaaagtggcagatgctgagcgcccaggggcagggtgccacgtgcataagagcttctcaggctgcacacaaagcctgctcacagctcctggccccaacaaagagccccaaggctgctgctctgtcagttaagcctgccaaaggcagatctcctggcttaggaagaggccatggtgatgtttgttaaagtttatttgaaacacttgatgcttgtggcttggtttcagggcagctatgagagacctgcccagtttggctgtgccatgttgcaaagcaaacccataaagcaccagctcaatgaagctgactccaaaacagttcccaacacgtatgctgaaactcctcccatttaagagaaaagaaaaggcaaccctgactgtgttggccttgccccttccctcaacataaaccctcccttctcgctcagcactgggggctcccacacttccttcatccccaggcagcaagcatggtatctgccaaagaaggaactggcccagcgcttcccagaccattctcctaagcttgcctgatggcaaaggggcatgactgtgcacccccacagatctggggccctgcctaaggcagaccaatatgagccaacaattgacataaatttttcagcttcttccacactatagctgttcttgtcttaatatggaaaaataagcatttatattccttaccagttgcatttctcaggaatgccctcccaaagtgagaaaactgactctccagggaaaggtgccgtgttcatctggggctttgcagaagtgtagcttgcactctaaaccacagctgtacacgggaactgaggcctgagacccaagcacccctaatttcgagtcatgtctgcttctcacttacctcttgatgaaggatgaagtaatggattgacctcagaaaggcggaaggatatctgttgcccctctgaatctcttgagtacatcttagtgtgttgctaaagtagctttgtgtgcttctgcaggtggctgttcagggggctccgtggaagcaaattgaatgtgccttcggggtcttttcatgatttggttttgtgtcagaaacttcagaaggggttcctgtgctcacttctcaggcttaatgttctgcggggccagtgagcaccacggggccagtgagcaccacggggagcccagatacagaaattgaggtactgcctgcctctgccaataccgtcccagtgcgccttctactctacttccaggagagagacagatggctcctgcctgatttatggggcttgatagttaaagtagaatagcttcctgtaagggcagtcatatacatgggaaaccgtatagtgagagtttaatgttttaatcaggtatgtaacttgtaaatgatagattaggaaatatatttattttcaatctgcaggctgctagaagctggacctgagcatcttagcatcgtttattagttcataatccatcatttcctattatgtattctttaggtaagattatgctttgaccctagagtatcaaaaaatagtttatgacacaaaatgagtgatataatgggccaatttaccctgcagtgatggcagtgagcatgcagctatagggctactctcagccactctcccgaggtgaccgcaggtctgcaagcgtggtaaggggtcaggatctgaagtgctgatcttggccccagttattcctttctccttagccttgacaaacttgtttgccttctgggtcttggtttcctaagtacaacatgggggcaggatggttatttacgtgcagaaactcagaagtatggtgaggattaattaatgtgtataaatcactttgaagatgaaaagcagtatattattacttacagagctgcaggggcataaacagtgcattgcaaacacagagaaaagtgccttttggagaaccaatgattgtgcccacctgggaaacaagccatcagggaagggcagaaagacaacatgaaaaccgaggccctcctgttaaggagaccggcgcttttaagggctgagtccattctggttcacacatgactctgcattccactagaacatgacaggtcctgaaattgatgcatcagccccaggacctttatgggcaggcagtgggttcaggcctgccaggcaccgtgacaaataagtcaaattatcatccttgcgtgttcaaacccgaagaaagaagactttccagaaatgagcagtttggacattgctcggccccctgacaagttcttccatagatccaggcccgtgggcgggtgtaaaagcagaatgccagccctgtgcaaactagatgacccaggtctttacgagctcagcagagatgcccagttcctacccacacagctggggtcagagaacttttatgatctgctcctccatcagaccctctctgtgccaaattctctcagcgtacaaacatcctggaataaattactctggaaagctgaataaaccaccaggggaccactttgtgcatcactcaggccctggcacaaacaattcctagggaatactggtttaggagaatttttctgtgaaatgcaagagactttcctctcaggaaggtgtctttcttcttcaggcagctcaggtactttcattacctgcaccaccagaagtccctaagtttctgaatcatgtaaccaaagtattttattaccaacctcacctattttagacaagatgtattgtgttatcttgatagtatgcataacaatcactagttagaaccttctacctgtttagaactagaagcatttccatttgaatcactttttgtttgtttgtttgtttgtttgtttttgagacagagcctcactccattgtccaggtgcccaggctggagtgcagtagcatgatctcggctcactgcaacctctgcctcccgggttcaagtgattctcgtgcctcagcctcccaagtagctgagattacagacctgcaccaccacacccggctaatttttgtgtttttagtagagacagggttttgccatgttggccaggctgctctcaaactcctggcctcaagtcatctacccacctcagcctcccaaagtgctagaattacagccatgagccaccacacccagcccatttgaagcacttttatacaactattcaatttgaatcatatccccagtcgtcaaccaacactctagcagaaaataaaatctgcatattacaatcatttgacaagcactgacaccgaggcccagagagtctaaagtctcctggcctaggtagatagttgcagggcgagcactaggcccttggtctcttgatgtctccttgaaggtctttctcttcacttctttctcctcaagattgcagttaaccagtttctcacatactgtatgaaactgaaataaatgatcccgttgatagcattaactcaccttatctagctctatcctctttagcaaggtagagtagttggttcctgcttcctgaatcatcttctaacgcagtggatagaaactatagcccctccgcagtattataatcagtcctcatatttctgctttccagttgtcttgtgttatagaggtcagcaaacattttctgcaaaaagttggagactaaatatttttggttcatgtgctacttagtgacagctggttaactctgctgttgtaagttaaaaacagccatagacggtgtgtaaatgaacaggtatggctgtgcacccataaaattttaattatgccccctggttttttagtttaatgtaatttttatgtgttatgaaatattattttctttttaaaaaatttcagccattagaatgtaaacccattgtttagattatgtgccatgcaaaaacaggtggcagcctggatttggtccgcaggccatagtttgtcaacccttgtttgattacattacagcttatttcctaagaatacctttcaggttgtccacatctctattacaaaaaattgcttcccaactggctaagagtccaaccatatgtccactgtcaatgaagcaggtgactgacattttctgatactgcaactccatttcacaatgagtaattgcatctgactttctggcccaaaccaaaaagtagaaaaagcaagtcacttttctctttaaatactttctataggataaatttttccaaggaaaattttaggaattttaggacacttcatcatgaaagcatagcttttaactagactgcttgaaacagtgctccaatccatggatagagtggaattgcctggccattttgcctagtactcatttgtcctcaatctttgattatcccaggttcctctggaaaattatcacctgtttttagaagttactcagtttctgatgccttcgttgttgaggttttccaacagattgtaatgatgctgtgtcatggaatgacatcattgctttcttgtcctaggttaacattggaatagatctagtttccttaaaaggcatcgaagttcttgcagggctaccccacatcaaggaagaaagatgcttctcatgtgtgactctgttgtttaactccagataatcttagaaattctaaggcgagagtcaacacaagagttcggcatgacatgggactcagactgtcacccctgagctaaaacaatacgcaacatacactgagcttctgccaaagacacttcacggggttggtaagggaaggcaggagagagaaagataagagcatttatgtcatcctaaattagttcttagctcttcagatctctgccaaactaaaatacatatatatatattagaaagtcaccttgtcttttttcactacagtaattcctgccaaatgtgaaatactatgtttgaagttagctgctcaacactctgtcttctgccactctgactttgatctggaaagaacgcgggccatcaacatgtcaggatgttaaaagtgtggtaatttggggtgctttcagtttcttttgaaaacaatgagagattattttctatggaaactaaaagcctaccatgtgtttaaagttgctacacttgaaaattgatatgttgagactcacgctgatgaatcttgcgttctctgctgctattttgtgtattctcatctcactgaacagagcaggtttggagaaaacataaagaaaatgacagaaaatgatgagaatggtacacttgcctggcatcttttgtgggggcgcagactaggaaaaatgtcagccctctcattccaactcactgctctttgactatctggagagatgggaaacctcatcctcctgtatgaattccaagttgtgtacttacctcccacatctaaagggcaaaatgctaatgattaaatctgaacagtcaagcaaataacatttccacccaactccctgggcccagatggtcaaactgagaaaaagagagctgcccacaagtaagtcaggggacccagtcatattatctatgccagtgttagtagcagacttcttatctaatagatatgctaatgtgctcttaacctgataataaagtcctgtcagtgcttacacactggtgagtctttggcagggggactgccatttcgtaactgaacatctgatttcagagggcctgtcaatttatgggaagacaattacatcattcattagctaggtctccatcacctagcggccatgtggcaatatttgtacctcgtgtttgacattcagaaaaaatgaatccctctgcttcggaggaggacgtggcctctttaaaaacatatttgtgcaatctgggggacttgaagtgcttcaggagggtcagcagctctcgggagatgcctttgctttcctctccgagattcccatcagaagtcaggatagtcggcccatgcagggctttctcacccttgtgggcagacgctggtgatgagagccaggaaacaggttctggtcctgactttgtagaacatcgtaatacagagccagagaggagtgataggtgccacaaccctgtgcacctcaagaatgccaaggaaacaacaatggtatcgtctgccagcccaggacttcgtgcctccacagagtatacattgagtaaatgaatatggagagttctccacctactatccctgaatcaccattcaagccttgccctagactttctctctataacgatgatctctctagcagtcatccatccagaagcagtaatagaatgctagaacatcagtgttgacttcttcacacaccctacttatttgactggattcctttgggtggtggccaagccaacaggcccttcagcttccacagtgtgcttttaaattctccatttctgacatctttcgttggttcattgatttgtgcttggggtttcctgattgaggattctgacacaacttctaatggactgtaaattagtgttatttcattctatgttttatctggaacacaatttcaagttcttgctttgccttggtagttagacaagaagcagcttgatgtcgtagaaagcacatacatggactttggtgtcagagagggctgtgtttgaagtctggcctgtatacataaagtccatgtgatgatgggcttgctatttaaaatctctgcaccttagtttcctcatcagaaaaatgaggagaattcctactttgtaaacatgcctcaagcattcattgaaatggtagatgcatgcaactcttcttcaaatccaatgtcatcaattatgagaaatgccatcattgtgcatccctaagagggaaagaggttgtcaattaaactatgccatgatttcttagcatttgtaatttttattttatatatttggaaagagataggcacaggcacgatagattgatgtaacaaccatgtgaataggtaggtccgtggtcacaaaggccctgtaatacaacaccaattataaggtgcattctgattccagacttgtggaaatatttaaaaaattctgaatcttatagtcagtggaacatggtggtacctggcacacaatagaagctcaactaaatggagctatggtgatcattgtactagccactgcacaccaggtccaatgagacctgcattggactgcatgccaggtccaatgagaagagtatgcccaaaatagtgacctgcactgcccagcgctttgtaggcaatcagtacatatttgttgaactcatgaatgctgattagggttacatctgagttgtaccagttgtggaaggtgttttccaaatacccagaatccttgatccctagcttcactgttcccctatgtaaggggaggtttttggtttcttgatgtggtaattgcctccgttcccaaattgcacttctgagttagaaagcacttaggcaaaggaatggttagggggccatgtaagcaccacatttaagccctctagcaggaatctgtgattccctgaaatcgagagaactgactgagagaaactgggaagtgtttgtatctggcataaggccatcatttggcactgatattacaaaagtgtagcagaatttacttggagttcaaggtgaagaagcaaataatggcataaatctaaaagtctgttggctatttctctgtaaatgaggatgtactaagaaaagaaagcaatcgctacaaggcaccgagtagagaaaagaactattatatggtaaattaggtctctgtacacaacccacacagaatcttttgtgctctgaaatgccttgcttagctacatggcctcatacaacagaaacctaacccaaagcaaacttctaaaacatacatgtttcttttaaggtcacctaaaaccagacttttttgtgtcccacattgaaaattcttttatagaaaattcatgttttgattgttaagaatagacacccagaatttttgcctgagcccttctcttatcaaacaagtcatttattaaattgatgcctcataataagattctctgcattcagagagcaaatagtccatcaactgtattaacacatttatcattaccataaaaaagaagataatgcattgcatgttctgctaatttcactttttatatcatcagccttctggcattaataagtaaatatcacactgtatcagaaaatataacagcactaagctacatgttggtaagaaaagagttttactaaagaaaatattatcctcccttctgggaaagagaaaaaaattataagatatgtaatatgtgtcatctttcaaaggctttttttgtttgtttgtttctaaaaaccaaagccatggatgagaagagaggagaagctttgcctccaacctttacatttctttcatcatgactttctttgcagttgttagggaaggcccttcccttgggatgggttttcatttgagttaggtcatttgtggggagattcgtgcaaacatgttcggcactcccctagggactctgtctttataaaagaagggcatattaccttgcttttgcctttgcagtcatgatgcaattctctcagtttgcttacttatattacaccatgagcattttaaagtcacgttaatgaagtttatattagacttgcttatattccacagggaagggtcagtggcagtgtgtcaaatgcattctgttcttcaggccgtgataaacaagatggcatctttcaaggaagttcagtgtgcctttgaattagatgcatctttgaaactggttttaaggctgccttatgcaccaaattttacaaacagacttctgggacattagctaaatttggagtagtgtgtttaaactttcttttagtaacaagatttgtagacttcctgaatctcgagagaattatgagttaagactctttttcccgtgaagaaaatatttgttactctgtacattaattttatgttaattaatttacagtttattaaatgtacttgaataggttcatgtatattcattcaatgcttttccactgggcaagaaatttcactttggcatatgattggctggtcgcactgtgtgctgaaatctgcaggccagccttaatatccaggatatttttacttgaaatttttttcctggatccagatcccaaaaagcaacaaatgaaatagtacagttaccaggaaagtttaaaaagcctggggtaagttgtgttttgcatgagcatctcctgtcctggtgttaatcaggcacacacagcagcaatagaaggcatctgagtttcattttcccaggaccatcaggggaacagaagcttttatactaaaaagctttttattacctgattggtataaatcaatgattagccatcctttttgtttcctggatatgtacaagggtctaaccaatgtacaataagaaattgaggacatttgtgtctatttttatccagtctgttttaatcaaatgatgacattatcttttcccgagtttaaaattacaaagtttttaagaaaaaacacacacacacacacacacacacacacacacacacacacccccaaagctggcataactgtgaagagtcaagagccaaggaaagaggaattaataccaaaaagggtgggatgaaattaagtcaagaagtaagaaaaaggcataagatgctgagaatagagtaattagaagcattaactagcaagagaaactaggaaatgccatacatcaattgggataaaatatggaacagttaaaggacacaaataggaggggaaaatggcacccagcataccaaattacaaatatcttctgcacaatttcttgaacctataagtccaaccaaggtaatgagatgaaaagcaatcgttgtgaattgcttggaggtgctgtttcgccacctcatcttacatcattaaacttttggtcccctcatgaactacttagataaacaacagtgggcagctcaacatttatccaaataaaccagaaagctaccacgataaaggaaattgagtttatagacacagcggactcttgcctaatagacgagagtaatgtgtctaatgtcgaacatcaatctatatttcaagtatagtatgaaggagggcctcgagaaacaacttatgctacaaaatcactttgcactagaggtggtttatcttctgttgtgtctaattgatctccacgtaattcagctacaacccttgctactgaaaatgatgtaagagatggaaagactgaatgtggctgttggttctccagagaccatagcaagttgggggttccaaatcgcctttgtcttcaaatgtattgtcgttggaatgatccttgaagccagagagcaagtctatttattttttaatcaagtgagggcattcatgaacgtcttcttttcaatcctgatttgtaaaaaaatctacataagggagaattattttataccagacccttcccatgccttattttgcctaacttcatagtgtgaagaaagatccagtagtgatattttagattaccctgcaatgttagttcccaatcaaattctgtggatttatgaactgcctgcacttgggagagtctcttaatcccagtggaacagggtctggtctagaccaggacatagatatgctgaggccatggctagtggtagtggggacttgggagtggagcagtgaaagagaagggaagggaggtcagcccccatttgggatgcacgcatgcgcgcgcgcgcacacacacacacacacacacacacacacacacacacacaccactatccccgctgaccctgcttcaaaaatgccaatcagaaacctcttttaatatgtgcacatcttaataaagtatctggacggatggatttggtttgactttcaggaaaccaacttctagtcctgcttccaaagatttaatctttcacagtgtttgcatttgcacagatatggatgccaccgtttctttttcctcctctctcctaccctatacactgcacctttaaatcgccttgggggaaatccagatttatcctgctctgtcacggttaattttttttaagtcatatacataatacaaaacaataataaagttaatttcattttaggcttttaaaaaacttaccagtctgtggatctgtgatttttttctgactcttgtccccatcccctcatccccatctccaccctcgcttctttgggtggaaggttgttgggtaaaggtgctgcctaaggtctcatgaactctgccatgtctgggagaaagtgtctgtatttcttttctggggatgtgagtgctgattgcatggtgttgtattcttttcttcaaaactatcaggaattaagcctttcggaaaggtcagctgacccacagtgatatccatattgtagtgaaacaccgatggcttgttttatgccaaaggtaaataggagagtggatacaatgaaatgatctgtgactaaatgcatcttgaaggaagaaaaagagctgtctgtcgtgtttgtatgactaagggatttcttaaacaagctgtggaccccacccagggagaatgctgtcaaaacatgaaaaaaaatacagagatcacacgaaagccaagtctgaactctttaattgcatgtctgaataccttgctaattttgcccacgccctttgtaattctttattcataacacactaccactgtctcacccctccccaaaaactttatcgtacctgtgtctcccacaattccacaaagcaacaaaaccaaaaaaccagctgattgagaagatacccagattggactaaagtggctcttggcttgttatcatgcccttcaaaagtcacttaccagggcagttatacagtaggattttgttggaagagctggtctggaatctctctaggtagaaatgtatagagagacccccaacatgaaaagtaactaggtatgaattgcagaaacatagaaaaaattctttgtgttgtatagataatggtgtcgagtgctgcctaatttgtcattcatatgataggccaagtggggtgcagaccctaatgacagagagtattttttgtgcagaggggaaagtaagtaccataagaaaaagcaagcatgcacaagacagaaaagacaggagaagcattcctttgtgtcactgtagtatatatggtatatattcctgggaatataaaaagaggaggccaaatgcctagctagagagaattatagtttccatcggcttctacagaacaaggaagaaccacatgcccatcactggcttcgtgaaaaaacagaagttcaagcttcatgggcagttaggaaaatcctctgacttagattaagccagttcttatgtttccactggatgatgaggctacagttttagcccatctgttcacagccctgtccccagcatcctaagagactctatccatttatctttaaaagccaaagaaaagagcatgttgtgagagggaggaataaagctggtagcccagaaaagactaccctaaagctgaatgggaagacttaacatcgctaccctgaaccacatgactctggaagggtcctgaggttctagggcgcgagggttgtcatgcggtcttgactgaaggttttccacatgtgcatatagattctccatgtagaaaagaattttgatttggggctttaatgccttcgaatgcacattgagaataacactgccatgctttcaccatagccttggaatcctaaaataaataatagaaaaattgtgatttaaaatataattccaaatactaactggggcccgctgcctagatgagtaataagcttcaataaatgtgtgacaggcacaaggctcttcagtatgaagagtagtgaggcctcagaaatagaaatagctttttcattacatgagggattatgttcagcctgactgtggagcctgttcacggagccacagctgcatcttctgcctgcggtcgtattaaccagtaatagtaaaacagtgacgtgctgcctgaaacagcgatttattttagagaagagagaaaggtcgctttctcctgcttaagtcaggattaccattgtttactacacactttcccttaaacttctatctgtccgtgctaatgagctgcaatttcagctgggttccacctgggtgcctgccagggatgaagaaatcaggatggtttggggtcgtggttacggctgttttatttttactcacctctgctcatcaacaggcccaagcttatctctttttgaagattgtatgaagttttattttttaatttcaagctcactcagctatctgagtttttcccaactcaggaactcacaaatcagcacatgtactccaggccttcctttttctttcttttttttttttgagacgtagtctcactctgtcacccaggctggagtgcagcggcatgatctcggctcactgcaacacctctgcctcccggattcaagcaattctcccgcctcagcctccccagtagctgggattacaggcgcccgccatcacgcccacctaatttttgtatttttagtagagacgtggtttcaccatgttggccaggctcgtctcggactcctgacctcaggttatctgcccaccttggcctcctaaagtgctgggattccaggtgtgagccaccacacccagccaggctttccttcttcaaaggagtgagatgtgtattggagaggctgatgtgacctcggtgctacgccaccctgcaccttggcgaccaaggagactatggggtcttcaaagatgagtttcagtcatgatctgagaaaggttagggggctcagtatagaagggcactcaacatgagagctgattatcaatttgagatgggttctcttttctacaccttgacacagaattcctttcttgacacactgaaacgaacgactcactgaaaatatctacttcaaggatggttgtttacttggctcagaagacctgatttgtagtcttaacagttcctcatttgaagggctagctgggtattcaggtagttcagtgaggaaaccctgaatttagtttagaagttaggttcaactctcaacttcttctaattgagtgcttttgggaaagtcgattaaatttcctaagccttcattttttttcaactgtaagaaatggttgataaccgtaatagcgatgatacctttttcatagtcactctatgtaaagtttaaagtagggcttgatattttaatattattgttctttgttttaatattattattgttctttgtgtattcattcaagagaaactatgcagagatgctaagttacaattcagcaattgagctattggagttcagagaagggagaaactcccaagggctggaatagttgaggataactggatggagaaggttctaggccgacccagacctgggaagatggttagaaactgaactaggaatgggccaagaatcattccagatgggggaactagcaacaggaaaggtaaaaggagaagccagaattaatagggtgttatgaggagagggacgcctgctaagaacagtgaaaaacagtggagcaagaccagatgatagatggccttgaaatctggcaggaggtttaatttgattaatttggcaatagggaggtgcttcaagttcataagcgggagtataatatgataaaattatgacatgatatcatgtcagttacctagtagatgctccataaatatttatttgttgattgattgaggattcaggatagattgggagatgggacaggagacagggagactcctctgaaggccccgtcaataatcagtgggtgtgtgttggtgaggccctgatgaaaggggaagccatggaaatagagcttcagagttaactgcgagagatttctttcaaagaaaagacagatttgtgatacaatttgtcttgtgtcgactatcaagacaaagaagacagaagtacctaatatggccttaaggtttctctgttgtcataatgggagaactgaaaaattaaaaattaacctcatatctttaaatcaccactcacttctctaaaagcatggttggccaaaacattttttattggtatgtaattctaccaaggctggccagaagccattcttttttaatgcactcagtaaatctctgcacggtttctttattatgagagggcctttgatccaataaaacccatcaagaccccttctgaggcattcactttggattttgtatggaagtctatagagaaaaaggagagcagaattgggtaaaaactaaactctaaaaggctaacaaaattcctccataacgtagtgcttacatgtagtgcaaattctgcgaaccaagaagagtcattggaatatacattaagactcagcatacccatttataaacagaaaaccaccctccgggacttgaaggcacttgcctgtacaaatgtggcatgtggtcctgggagtctataccgttgccctttttgatttggggcagtgaagcttacaaatgaaaatcttgaaagaagaaacttgccttttgatcagttggttagaggcaggtttgaaattatgataaatctgctacatattcattctatgagcaggtttaaactctaatgcatctgcctgtatatctgcaaatgaggctgacttaccgtaccaggctgaagggtgagatggatgaagttagttatgggtttatggattgggcagagagggctagacatcagggaatgtgcctttgccctcctccccccgccctctctctccaccacactgaagtctcgatttattttctgtgtgttaacatttgactgaagtgcatgaaataccctctcagatgctaggagcccgaagtaaagcatcaaatagcatgctcacctggggaatttagaattagcctccaaactaaccaaagtaatctaggccccaaagccactttagttcttgctattgggattgcctgtgaggatgagcctaaatgtggtagataattatgtctctttgctttctttttatcttcatcctaactctcatctttcaagtctcctttctgctgcagagtggcaggagctaaggcttggccatgaagccagacatcccatttctgtggagtttttgaccctgtgccatgatactggtctttagggaattctacatcggtaaccatttctaagctcagttaggttaaggccatggtcagacccttgctgtcttcacttcagcccacaagagaggcaataccgtgatactgtgatgaatccacccctgaagcctgcagctccctcctgcttccctgccatgagagataagttactggagaggaatgtcacatcttacggaagaattaattttggagtgcattcccgacaagtctatagttcaacatacatatggggagttattttcaatggcatttaaatgtaattgacttatcagccaggttagaataatcataggatagctatagtgttattgtctaattgtggtcctatagctgacaacgctctgaaagcctctttaaaatataaaggaaacctgcccttgggaatacaaagattgtgtgagagttgtaagacatccaggagaagtttaaagtggagtttggaataaagtgaacaggctcttaaccatgggtaaaattgtaagagaacagcttacacggttcttgcaaaccaacttgtcatttctcaagtgtataatgaaataatgtgtatgaatattttcatgcagagcagcctctccctcaagttctgccctcttcagagcttcataataatatacaacagcatcttttagaacagtgttttacaatctccagactaagggctcccaaaaagatcctgagagaagtgtaaatgagtaacaactctaagactgcatttttgtaagtaaatgatgatgaaggataaggagagatgttcatggggaaaagccctgaaaattattggaagtcgtggagaatgagagtcaaatgcaaacactcctattctgcagctacgctgattagcagatcttttatagtttccgtgtgggagatgagcaggggcttggcaagcactgtccgtgtattaggaacgaatgcccctccgcatattcaatttgggggcgttattaaaaaatggaatgaggctccttctcaggctctgcttccttttcataactgctcttgcagtgatccttttggctgtaatagcactttgtgtgaaaaggatggatgggaacccgctaggtctttttacagaatatcaaacattttgcccattaagctgacttgatttgaagaggtccttggcacagattgatgaaatagtccaaatattatcactccttgttctgcagtccggatagagtaataaccagtcgcctcagcctttgctcattaatgaggtggtcagggtcctaagatgtgcaaagttatttctttttctctcttgctattttgcacgttatgcaggattacaatgctgtgggaatgatgtgcagatggtctccagtgagactcacccagcaagattctcttcttgcatcaggattctgcctttttctctaagtcagtgcgccctcacatcagccctgagaacatttatttggcagtgtctggagatgtttttgtttgtcacgactgggagatgctaccagtatgtagcaagcggagaccagatatgctgctaaacatttttcaatgcacaggacagcccctggttaaagaattatctgatccaaaatgataatagtgccaaggttgaaaattcctgctctaattgatttataattacatcttcagatatattttttcttttttaccacttgaacgaaaataagagcttatattgccctgtatagctcatctttggctctgtgtccctcgttcctcttggtgattctttttatgtccatggccctcagtccccttcacagaaacaagctgtggcattaagttccaaaaatttattgactgaactggtcagctctatgcagcgtaaacagggttcaactgaagaggtataatgaaaagtaccgctgaatgtaaatcttcctaaagcatgacttgctggtttttctctgctttaaaaggataataaagtcaaccatttatgaaaaacctactatgtgcagaaacttcacatttaatatctgacctaaatgtcgcagtgactcagttttcctaattataattagagaaagaggttcagagaggccaaataacttatgcataggcatgcatagtcagtggttaggatttggaattgaaaatataggtctgtttaactgcaaagctcacgttctcaccactatgtgtattgccatcaacttgtaaatatatgcttgagtgactttgactttatgtgttcacatcccccaagccccagtatcctcagaaccgcccctaataacaatgtttctaaaaaaagaaatgtacagtccctctgatcatccaaagactggtcagctccccatcagccttgtcctgagagctgaaagatgacacattccttagctagtactccattgtaaaacaatccatgtcagggcacgtgggaagatgggaaacaggttgaaggaattgggagataaaaagaaatacacttcaaaactgaaggtgaggccaggcacagaggctcacacttgtaatcgctgcgctttgggaggccaaggtgagaagcttgcttgagcccaggcatttgagaccagcctgggcaacataatgagacccctgtctctacaagaaatatttttcttaattagccaggtgtggtggtgcacagctgtaatcccagctacttcagaggctgaggtgggaggatagcttgagcccaggaggttgattctgccatgagccatgatcatgccactgcactccagcctgggtgacagaacaagactctgtctcaaaaaaaaaaaaacaaaaaaaaaaactgaaggtgagggggcaattccaaagtccttctcaggatgctcagccaaggcagtgtttcagttagggatacctttcagctgtaagttatcaagaacaactgaaaaaaaaaaaaaaaaaaaaaaaccctaacagtggtttatattgaggcttgatttcctgaccttactagctagatgtccaaggttggcaaccctggcatcgtttctgctgctcagtgatgccatccaggacactggctcttcccatctccactttgccattcccagcactttggttttatttccttaggtttcctgcctcattgtctaaggatgtctgatgcagctccacatatcacatccaccttcaaaggagggagatagaagtggagaaatattcaaattatttgcccctcttaccagaaaaagtctaaaccattcccagcccccaacacacacttacacacacatacacatcccagcaaaattttacttaaatcttattaatcagaactgtgttatatgtctatcccttgtttcaaaagagtctaggaaaggttttctagaccctttgaagatgataagggaaacgagggttggaattgtctgatgccgccaaaaatcaacagtgtctgattagagtacttgaatattcaaaagccaagtttcagctgggcacggtggctcacacctgtaatcctagcactttgggagactgaagcaggcggatcacctgaggtcaggagttcaagaccagcctggccaacatggtgaaaccccatctctactaaatatacaaaaattagccaggcctggtggcacatgcctgtaatcccagctacccaggaggctgaggcaggagaatcactggaacccagtaagcagagactgcagtgagccgagatcgtgccactgcactcctgcctgggtgacaaagcaagactctgtctcaacaaaacaaaacaaaacaaaacaaaacaaaaagccaagtttctgcttttctggaaatagatgcaacagctacttctgggaaatctctcttacatacttgtccagggtggcactctgaaggagagtgtattagtttgcaagggctgccatatcaagggaccacacactgaggggcttacaacacaagcttattgtctcctatggttctggaggctggaagtccagcatcgctgtgtcagctagtccacgctctccctgaaagcactaggaaagggtctgttctggacctctctcttggcttctaggagttctttggtttgtggcagcacaactccagttttacatgatattctgcctgcctttatatctgtccctgcgtccaagttttccctatttataaggacaccattcatattggattagagctcaccctattgagctcatcttaacttgattatctgcaaagacctgatttccaaataaggtcacattcacagctattggaggttagaacttcaacatttgtgaaggaggggggcaattcagcttattcgtaatacaagatttttctaaattcttctttatatcttaatagtaatggcgatagttaatatttttgagcatttactacatgctaagcagttcacatagatttttctcatttaattcttactaccactacatgggataggtgctattatcttttctatcttacagaataggaaatggaggcacaaaaatattaggtgaccttctccaaattatgtaattagtaagtaagagggccaggtctcagccccaagtgcgctggcctctgagtccttgcatttaattatcatctagactctcttaaccacagctatcttcatctctggtataataggtttcctgctcatcaatgccaaataagggtagacaagttgatttccttaaagcttaaaaaaaaatttttccacaaaggctttctttgctgccttagaaacgcaaataaaacacttcattctgcactaggcgtaatggtttcctcttattcaaatgcagggccatctgtgcaaagtattttatttcatcattcattgaagttcacttaaaagatgaaatcacccttaatggaacaatgaaatggaaggattcccaaactgaaggcaaatgacttgaaaatgagaggctgtggttcctgcccgcaacccctgcccagggtctcatgagtgacagtggttctgttctgacagccccagagatgaagaagggctcttggggagcataatggcgccatttccagccaagcagttcatgaggctgaagtgctgtttccatgctgtcctctggcctggatcagccgctgggagcctggcattgatctgtgtagactggtgaagcttcatctgctttgcaggcattgctttggctaaacaagcctgtaactgatccctcttgctataaaccagcctaagtagcctcttaccatcagccagtactctgctaccatcctccttctatagcaggaccacagatggaaaggaaagctgcttcctctcaagtaaaggaccgaagactgagggaaattttgctttttgtaggcaatagcacagtttccccctttcctcctgactggagacagacagtgcaggaaatgatgggaaaaagcaaatcatgctttatgtttgagaggcacctcatgactctgtggtggacagcaggcattattagctgcattttacaatggcagaaacaggcctgggcaggggaaagaacttgtccacgacacaaggctagcaaacagcaggtctaggcccagtacccgggtagccagactccaaacaatatgctctttccacagtgacattcggcactgcagcagagaacgagaataaagtgcttctgagttgaactgacagaagcttctagaatcggaaagagaaagaatgccgcaaagaagactaaggcacttattccatgtgctgcgcctcaaggagaagtctgtttagtttgggagaccagagtgcctcaaatggcgtctccccagtggctttcttgagtttgggatttgtccacttcatgattgcttcttttctgtggtgggtgtttcccattccttctctgagtcagcaaacagccatgagaaaagtttcctcccgtttttctcatcctcattcctgaggataaaaaaacctctccttcagatcagaagggaaggcagaatgatagtagctaacacatggtgagcattaatgatgcttcaagttgagggctttccttgaatccctcgtttaattctctccgtaagaagaattgtccccatttggcagatgggaaaaccaagtcttagaaagtttcagtaacttgcccaaggttgcaccgctggagagaagcggcacaaacttgaaatcaagaggcctatattcccctccttctgcactgttaacctgagctgcaaccagggacaagcatgcacctttccagagccttggttcctccatcataacatttatgcaacactcactctatgctggtcactaggctttccctgcatcaacacatttaaccctcacaacaaccctatgggattgtactctttttatctccatttcacagatgaggacactgaggcttacggatgttaagtagcttgtccaaggttgtacagataggaactgccctaatgaaacacccgtgcactgaaccataatgctccatcacctcccatggggagtccccaacgcccttcaactctgtcttactatcattccattattttatctgacaaacggtatatattttttcttcctgaaagcagcagcttcatagtgagttcctgcaacatttcaaggagcattcattatcttcattttattcccactttatagatgcagaaactgaagcataaatcaaataacttgctaagagtaaaacaattagtgaagagcaagagtggcttcaaagtcagacctgccgaattccaacacccatgttaacgtaggttctgtggagctggcactcagaaaccacgtctactgcctcttggccttgacctcgtatgagcagtgaaatcataatccccaagcaccttctcagtgggaggtgaaggaggtagcttgcttggtagctaacagcaaaacctctgaaatcggatagaatggcgctggaatccccactcttccacttactgactgcatgactctgagcaagttacttcacctctctgaaatagttttgtcatctataaaatggtaataataaatgcacccatctccaagagtcattgcaaagattatattagatgttgtatgcacagctttttgcaaagtgcatggtacaaagtgctcaatgattgttagaagagattagagttgacctcataggatcaccacactgagccacccaggatgggactcaaccttgcaatgggcttcatctcctagaaggcaccctgctctggtccttatgatctgcactgaccagttagcagcctctcttgcccctcaagatttcttcacttcctttgtactgagtcagctagagggaccactcatcatttcaccaaagtaaaaggaagtagagacaattgatgattgatgttagaagcaggggacaggggtagaaagcatgtgggcttcagatctgttcagacccaggtttgaatttggatatcacttaaacctccctaagtttcagattatcattttagagcagcagcatgaggataataatgttcacctttgcagagttattaagaataaacaagaggaaaattataaagtgttgtgacatgtaataagacaatggctattatttttagattggccaactcgtttgcatggagctcttcgtgacagaccattgagaagtgacctgagttccacaaatgtcctttgctcactttatttggcactgtttgtgtggtgaactttccccactctgggtgtggctggtcagtctcttacagtgtgtggctagcagatcacctttgaataacatctgtggctatttaatttgtactggggaaagaaagaagtattacaaggaaagcaggctgccccgttgggatgctcaaggcccattttcttgcacttagcctaggattggcatctcttggtcaatgtgggtcaccttcctgagaataaaggggcttcattggctcaataattatcccaactgttttttcagttgtggctatttgagaaagaggtttcatatgtcaggagtacaaaatagagactgacttcatcgatctttatgccatttttgcccttcatcgttgatgtcatttgactcttcaggccccccttctcccgtcactttcttcttgacataatagctttcttctgttccgtccccatcttcccatctgctctttctcatagctccctcttctacacctcgtactttccggcctctgcacttccactgttgggcaacagaagagctgtctttgtttaagcttaaactttatcttctggcaaaatggagaaattaactgcctaccagcatctcggagttggttgtggggttcataggttcatacgtgttaattgttttaaaaattctccttactatagcaatgcaagaatcactaatctttctctctttccctttctccctattcctcttctcctctccacattaagtctgatttttttctctctctgaatttatccagcttacataatttgccttttcattttgtgaatggagataatttgtgaatagaaattacttccaaatgtttcaaaaatattttctaagcatttgctttaacatggtgttgtgagctcttttttttttttcctctttctttttttttcataaggaaataagtatttccagggaaatgagctttagggggagaaaaggattgcatttcactctcttcttgggtctcttttgttgatgacaattttgagctggagtaactgcagatattgacttgtcgaccacctggggtggagggggacagttttattcagactcctgcccaggaagtcccaggaaggaataggataggagggaggagagaggagagggtaaatgaattcagaaaatagagctagcctggaaactgatgactttttaggtgagagattccctacatcaatattttaattttaagacacattcttatacttgggttgattctggggtgcctcctaaggacagactttgtcctttattcattaattcagcaagcattcactaaaaacttccttctctctaagaccttagtgatgcagaaatgggtgactgaggtccctgtccccgaggagatctccatcacacacagagaaaatagatgtgcacactatcacttataacacaagaccaaggagaccacgcctgtgctagcatggaagtgagcacggggagaagaaaaggagtcgtctgtctgttggtatcagagagtactttagaggggagatggcatttgatatgtagctagaagggtgcataggattttggcagaagggaaagaggggagaaatacctttcaggaataagaacaccaagtgcagtgattaaagcctgggaaatcatggtgagtagaatgccacgtatcattaacactggagcaaaaagtatacaaggatctagggtattgatggaaaaggtattggggagaaggacagcatgacaacaagcctttcatgccataagaatgtgtatttggatttgattcttaagtgactcaaaacccgccaacaattctgagtggaagagggcatggagccgtctggcagccccatgcagaatgaagtgatggggtgaaaactagatgagagccaaggaggccattccaaagcccagaaagaggagactgtgaataaaacaagaacaatggcagggcaggcagagaggagaggagacatgagggagacatcatagaggttgaatgtcctggtttgatcattgactgaatctggtgggaggggaaaggagacatcaggcataattcagtccattgatcagccttttgctcgatactggacagagtaacctggagccagcccctgggaaaaaggggtagagggtaaaagaaagtttcctgttcctataatgtacaatgaataatcagctgcaatttcagtggatgtcagctgggctagatgatgctggagtttctgggacaaaagatgcacttcctaagttattttcatgcatgtaatgaaaaaattagaagacagcagaattgggtttaataaactttcctatttttaattgccactgaatgatgttttaaggacaataagtccttagaggaaagaaaaggctttaaaagcacccacttcttctcttccattgaaatgacatgtttcacctatgtgatgacttaattgcctaagagcaaggaacagtggaactacagataaccttagttgggctttagagcagggaatggatttctacctatatggcaattatataccatgttctctgagggttaggatccacactgggcttcagaattgtgcttagaggggccagggtttagattgttaggatttacaatcagcatcaaattgggaagagaatgtcgaggatgtaggtcaatatcagtcaagttcatttagacctcccccgacccaaatatatacttgccactttgctacaaaagacaaggttaggggctacaaggtgacacccgagacttctttagtggatatttagagttcgcccattctccagagataagaaagaaggattctccaaaacccagacccttagacctcaagcgaaggtcttggaatagacagtacccacattcctgctgtcctttgcttcttgtggaagttaattttgtgcttgtttaacatttttaattggcccaacatgctcctgcaaggcatttttcagtcattctgtgtttgacttcacctggttatgattgtttcctgttttgggtttttgacgtcgtcattttatcttgttttcatgagagtatcattccctgctcactgagagccatttgatttttcagcagcttaggtggcagatcttgaagacggttgcgtcttcaccttggggagtgtctttcagtgattcgtggttgggtagggtggaacctccacccgccggcttcccaaactgatatgttggcttttctgaacctccaaagttgctaagatacagtgtgtctttggaccccttccaggctgtttccttccacactcacagctttgacggaatatttcctctgcctgatatcgttagaaaggtgacatgccaaaccaaagttagagccgttacaagacatttctttgagtgcagtttccttggttcacccgttcatctgctgtgctggaagaaaaaagtgaaatcaaaaaagctctattaaatagatgtgccaaggaacgaggaaaaaaaagaaaagtttcttcaacttttatatgctcagaattgtctcacaagcatatttttgttcctttcctctatttaaaaattgataacctagaaagtcaggagcaggctaggaatcgtttgtggcacaaaagtggcacctactggtaagccttggcttaaatttgaagtttagatttgtgcatgaccttgaccaaagttatatcctcctgagaatgcttcctaatgattttctatgtctggaagggcaaaccctctttagatgtataaatattaaaaagcacttcttaggcatgagggcactggtttcagggctacagaatgactttttcagcttgtaattaaaaacatgtactggataactaaccagcagcagtatttgcttaaaggagcaaatgatttaaaactgattgggttgcacaccaaagtggagtgacccatggtggctgttcttacctctggtttctcgaggcatccacccagctccccgaggttcctcaagtcactgggttcttgaaacccacagccttcctttccttgcgtgtttggagtttttgctttatcctggtatccacgttttgtttttcatatctttactctgtatctgaatatttattccacgttttggttttcatgtctttactctgtatctgaatctacagaactcacactcaagaaaaaccatggctccccctgttacagtgcacactcaagtttcataagagaccccaacactggctgcactcagcaggtcaaacaatcattttcaaaggaccataagattttttaagaaacagactgtcctacatatttgaaatcttttttttttttttttctattttaaaggcagattccactgaatgctgcaaaagtaacagaaatgattaggaacagagttgtgacctatccaatttcaaaaaagaaagggaaggggtgagatctaccccctcctaagtggtaacaggccctttctgttcatcttctcatctaattgtctaaacaatcctacatcacaagatactgtcatcaactgcattttgcagatgggaacactgagacctagagattgtctagtgtgatataacaattaagtgatcattttaggaatctttctcattttaaaatcaatattgtactcctggtggtataaataaagatgacctttgtttattcatttactcatccattcattccaaatattcattaagcaccatgcatgagcaggcaccgtgccgggggctggggatgcagcgcagagaagagcagccgggagctccgctcctctggagttttctctctggtatcactccgagagtctccacatcccaatttgctctctgctctgagggtctttttttaacccctaggggagaagttgacagattgtgaacatcaatagttattgaattggttttgtcccaaggcttcttaaaaacagttttcaacgagtgccaagccctaactgtctcccaaatcctactgaaagaaatcagagcaggttatgttttcattgtctagccacccttggccatgaggcgctgcatccggctttttctctggggcccatttttcgccacaactcttcagccttctaccactcgggttaagttttgctttgtgcatttacaataagtgcctgccaagcatgagtgttgcaggattagaataaaatagtgggggtgaaggaaagcagattttttggaaaccggtagaaacactccatgaaatggagcattgtaccaaactcagcttagttatacaaaagcatgtatagtgtttctttttatttcccatcttaacgggaggaggcagagaacagtggttacagaacaactttagaatcgttcctgattgtccaaatggtttttttacccctctgagattggggactcaggggcagccgtgtctctcacgcctgcccattctgccccgctcgaagccacactgcagtgttccatgtccatctcgcctgcgctatctaggcaagggtgcgtgtgccaggctattaaacaccccacaccccactcccctgtcgttctctaagcaatggaagaagtttgcttggccaccacagctcgggcaggagggacttggattagcccaacagcttttgctactgtcagcatgcagcctaatagagttggaagacagggttctttagaggcactggttctgacaaggaaagcttctgtaatcttgcctttgtttagaaatatgaacttcgaaaccctgctgcagagagtgtcggcagccacgctgatgcgaggccttgggcaaattcatttgaattgctttgaaattggatattcaaaattcaataaaaataagccagcctgatggtacagctgcagcattccccccatccagctgggtaagccgtgatgatttccaggccgcggactagcaaagcccgagtgtgatgggaagatgagcgcctgagctgccagagaactctctctctggcagcctggcccgccgacggctgcctgccagctgacttgcagagcagggctggctttggcactaagtggctcctctcactggcctgcccaggcggggatgcggggcctgcctcagtcatggccggggtccagggggaggggatgcctcaagggcaaatggatggggtgtcggaaaaacaataaaatcacaacactccagttgtttagagagcagctggacgtcccaaacactctgccacagatccagagccatcagacacgtaggtgggtttaattaaattgtatgcagatgcaagcaaacctcataatttgcccttgagcacacactactgcatttgcctggaaagggggacatgacatcccggagggtgctctcttgccacctgccctgggagctccctcttcatcattgtttatgtggaaaggcgattctgctagggattttaagagaagaccattctcactttcctctaagtctcaagcagtttgatctctctgctttgtgatggtgtgtcacaatcatgcataaaaactgtgacgtatatataagatgtatacatatatagagagagatatttatacacatatataaacatacatatgcatttatagatggatagagagatgaatagatagaccgacatatacagatagactccaaattcaagaagtatgtcttattacccctaagcaacctcaattttaataattgggctcatcataccccatgcatgagttcaggcacttttctttgttggaatttgtgcatatgtgaactgtcttgagtcagattccaggagaaatatatccattagccttccgattgtcgcacctatgccacctacagtaccatacctaaagaggggtaattggagctcctgcgtgcagggacattgtgagcagcccactccattggcctgtgttacgtatcgccagccactcaagggccagccatgaaatttaatttggagttttacagacacgttctgaatccgaaatctcaataataactttccctttgctcagccttttaactgtgaaattcagttggggagtttcgaagcagcaggtaatgtcacagcactccagagggattttgccagaattctactaaagtgcttgcaagtgtcatttccatatttaactaatttcagtttttaattagctccatgtgaaaaatgagagttcacgctgagctcctctgtcagcacagacgcttgtttcctttctaggatctcaggacaattaagaaaaaaatagttgatgctacagtaagtgtgatcatgcatagctctctcaagccataacattgttccctgacagtaagaaagggccactgccagggcccactcgccaggctgggaaagagcagtttggaagagggttttacgtgcggatttgtgagtccttggttctgaatgattccttagctgcaaaaagtatattcttgtccctaaattctccaagatgacctgagattaggttttgaaagaatgctatatgaaatgcaaagatgatgttactctaggaaaacaggcttcctccgtgttatctctgtgctaaactccagcatccaggtgcttatcaggtcatttgatttcagattcgtaaggcccttggcatacaaaagtaacttctctatgatttaagtttcaaaatgcagtacacacatggaaatttattaatcctacattcaaagtgtaaatttaccacttgggactcacatgcaaatggaaaactacatggtcttcaaaaaaaatgtattgggaggttctgttttgcataaactgaaaaatatttgatgtgatcaggtttctgaaacaattttgaggaagccaaacaaatacaggccctgcatttcatttgcatagcatccatgctaatggcatgatttgtttaaaagaaaagattcattaaaagttttgagaatggttaaagtggaaaagtgtttgacacttccctatagtagcaattcttggaaattggtttggaaagtagaatctttttttttcttcatatatgttagtgttgggtaattgttctctgttgacaatagacattaataaatgatgtgatagcaagaacacttggtatctccaacagagactgaaaattgaaatccaagtagcaagaagaagtttaagtattaggtttatgtggctacattgggaaatagggtaggatacaggtagggtttccttccatgttctcttgactaccatatgtgcttgggttccaaagagcaaacacaactgtgtggttcaggtatgagattagaggagcaggtgtcctgtggggttgccagaaatgccgccattgaagatgtgttggtataagtggaacatgaaaagatggaggcaaattcttgaacatgaagagaccacccacaagttgtttaaactaaaataacttccacctgagctgcaatggctagcaataaaggcttcattggccagtgcgtcctgaggttggaattaagtctctctgtgtgggagagggcctatttgagctccaaaggcggaactcctatctccctggctatgaagggggctcacttgcgatggggaactgggaaaaacacaacttctattaataataagttgtctgtacaactctctggggaagatcatagttgggagtgcttatatttctttgctcttctcaaggtatgatgtaatttctttgctcttctcaaggtatgatgtcaggtgggcctcttcttggcctcccaggaacagcagctccagccacaagaagcctgtccttccctgaggagatttgacccaccattcctctgagagttggggacccctctcacagtgcaaataacaggcagaagcagtgtccacctaaacatttattcactgacgtgaggattagcaattagccctctcatgatggggattagctcaatagaactgtgggaacagcacacactctggagggtgaagttaggatgagcagcagaagagatgccgacttatggaggcagagagaaatcctgaaagtgatagtatttttagggcttattatgtgaattttgagcctgatagctgagaatggaaaccatggatttgtcatcagaggcacttaaatcatatgtggtaaattatccacatagctattaatttatacaacaaatgtttcctggtacaaggaaagagaacaggctctagaatacaggctgctgggtttacatcccagcttttctacttaccagtgacaggagcacagctatgttacttaacctcactgcgactcagtttcctccctgtaaaatggatacaataatagcacttatctcataggggaggttataaagactaaacaagataattcttgaatagcccttagcacagtgcttggccaaaggtaagcactaaataaaatagatttttactgtgacaggttctgcttacaccacagtgaaccaaacaaacctaggttttccccttccagaatacataccagcatacacagataaaaccaaggaaaattaatcacttcacaaccattccagggtctatcagcctcccaatttctacatgaaataagaatatcaaattaggaggaatgggaccatgtcagcaagaataaactaattagctaaaactacttattaaaatgataatccctccacatggactaggcgcttgcatgtgcacctgtcaggaaataagctacagacacacacacacacgtgcatgtgaaatgacacagaagcacactccccacgctgtggagagccaaggtaccgtcacccactgagacttgactcccgaccgaggtactgatcatggggctgtggggcaaggactctgaaggtcaactctgagatcattggcacttcattaaggagtctgttctaagtgcacagggctttcccagaagaggaaatgcagcctcccccttacatccaaacatactgcccagaagcccctagaatggctttttgtttctctaacactgtcagataattcacacaggatttttcaggcatcatagcttctgctagcagactggagtacacaaagaaaaaagtgctcagctccaaatcttgcctggaactgacctcagccctggactgccttttgtgtatcccaaatttgagctccgtgtttttgcctctagctttctggtgccatgttctgggccatgtgagtgctcagggttcttttatggatgcttggtactgaaaacatcactcctcgtggccagaatgaaaggtgttgtctaaagaaaagtcaagttgaactgtctggttcctctactttcggaaatataatggaacctcagctttgcgtggccctatcttgtgttaaagattctaacagagaatacatctctatatatgttttgtttactgttttgcttttgtttctagctttattgttttcccctgtgtggaatgttccagtagcaactgtttgttcttcctgtctaagaagtgtagcacataggtactacggcagatttatgtggtagtaagaagacgtccacctattgctttgtgtaataaacttccttccagaaagaagagaaaaaaatggctgtgccctaactgcagagcaagtttagtgaggatttacgagaatcaacaccactggcacaaatggagcttgcagagatctttgggttccaagttttctgcccattctagagaggagcagaccttagaagggtggctatggtatgccttctatggagggcactagcactcagcctgagagacagggttggaccagccagtcagccttctgccgcctctctcaatatcacatgtctctaaggagctttggcaagagtagaatcacaatttgatcctagctgaagttcctgataaatcctcaggttccacccgggaatcactgtggttgataaaaagaggagtccatatgctttacacacgagacagccaggcagttttgacactttgtggaaagtgtagaggcttgatatggattctcttctaggcagagacccatcccagcgtgacacagagaaggtgctcaggggcgattctaggcatgggcagtgcttttctccccaaagaactctacttcttcaagctttaaacaaggtgtagtggacaccaaatgaagaggagtctgcctggctcacaccagttcccttggtgacaggttgccaagtgtaggatgcccagttaaatttgagtttcagaataataatgaaaatgcttttaatataatatatcccaaatattgtgtgggaaattcaaatgtaactggcttcctgagtttttatttgctaagtttggcaagtttacttggtggctgtgtctgtatccaacaccctttttgggtccctaaatcgagcagggttgatgttattatcttactttcctcaccatagcaactgtcaaaaaaaaaaaaaaaaaaatgggcttgtgacctcagctgagccaattagagtccttaactagggtccctaaaagtgaaactgggaaagtggagctctcttttctcctggtagcccaagggcatgggaatattactttctgtgcccatggtcctccccttagggataaaccctctcttaatttggccaggctgctataacaaaatgccagaggctgactagcttttaaagaacagaaacttatttcttgggtctggaggctgggaagtccaagatcaaggcacctgcagattcagtgagggctcgatttctggttcctagatggcaccttctagctatgtcctcacatggtggaagagactatctagctgttttatagggacaccaaccccactcataacctaatcacttcccaagggctttactgcctaataccatcaccttggttaggatctcaacatacgaattctggggagggatagacattcaagccatagcaaaaaccattggtcagctactctttcactttcacaacctgccttcatagccttcaaaacaaaattcctctctcctgcttaaggtagaacaagctgaaccctaaggatcctatgctagtatgtagctacccagcccaaactcccaagtttggcatgatggactaaagaaagaggaattcaccctaggaatgcttatagacagatgtttacaatcagatgctccagccacaatatatccttggtggatccgctggctttgggcagccctgtgcctgatagtggggaaggggtggcaattgctctgccaaactgtgcacctgcttcaggtcagtacctccacagtcagggctgaccagaacatagagaagggagccttcctgtcatgccactttgagccactgtctaaaatatcttctgtctgaaaatatctgtcatccttaactggcaccgtgcctaaaatttccacctttagagtttatatgtttggcttaaatcgttagtcttccctataattgcacatccattaatgatagaatgtgtgatgttgtggggaggatgtggatgaattaataattaatatcaagatccaacggattttttaaagttccattgatgtggctgatagtttggaaagcagagttctgacagagttggatgggagtcctggaaacctctgatgtgatgggaaagcattcatacaagaggcactgctgagtttggaggggggcactgagtctctctgatcatgggtcacctggagcaggcagaatggacacagggcaggtactggatggagaggaggcatgctgagaaagaatgtccctgttttaccatgttactttggcccaagtctggttctggctctttttttttttttttttttttttttttttcatctttccaccctggcttgaatatctcttttccatattgcgtcctcccagctgcttctgacacactacctgtatgggcagagacctagtgcctagacctggagggagatgtctgggctctctcacctcctccaccttcatagaaacagacaagaggagcttgttccttcccttcatgttctctttcattaattgctgtcagccaagccttgtgcaatacctgtggttctcaaacttgagcattcatccgaatcacctggaaggctcattaacacacagatacctggaccccacccctgagtttctgatttgcaggtctggagtatggcccagtaatttccatttctaataagttctcaggggatgctgattctgctggtctgggaactacagcccgaaaccatcggcccagacagtgagctttttgagggcaggagtggtctcttcagaatcattgtatccccagaacctagcacaacaccaggcacagggttgaaggttaggaaatgcttgttaatggagctctatgaagctacacaaggctttaccctgttgcagcatcaaggctaatcatgtaaataccctgaattttcagatatcggattaaaagaagaaaatactattgccatctaatgtgttttttacacagtggcatctccagaatacatacaggaggggattaaaggtgccagtctgggtggaaaatgggaggttgggggctcgtcttaaaactccacttgcataggaaagaccctgtttttactgagactctttttgtggtaacttcagagaaggttggtggaaatcatttagaattttcctactcaccttccttttccaccccaactgcaccccccgaccactgcttagtgtcaccactgatttcacatgtgcatgaggtatgtgtaccaggtcagctgatctgaggttcctctgtcaagcttcaccacaaaagtgcagcttcaagagtcagtgcagtgaggtggaagtgaatgggatcggggatctgtgcttttcaatagagatgaatgtcctctctgccaaggtattaatctttccaggtctccataacctcttttgtaaaatgagtctggagaaggtgaccactaagtattttcctatatttcataatttctattattttaattcaaaaggcaagccatctcaaatttaggaatgggctatttgcttgtaacctagctatttggaatttcagagatttttctccagacagaccatattccttctggacagttcacacaataattgctctttgtcgggttcttaactgtgtgtcaagcactgagataaatgttttgcatactttatttcattgaatgtggcaacccccctgggaggtaggaagttttatgattcccattttgcagatgaggaaaatgagggtctgggaggaaagaaagaaagacagagggatcgagtaagggagagagagagggaggaaaaactgaaggaaaagaaagagggaaagagggaggaagggagcaagggagggagggaggggagggaggaagggagcaagggaaggaaggagtgagggaggaagggaggaaaggaggaagggaaggagggagggaaggagggaaggaggaagggagggagagagggaggaagggaaggaggaagggaaagaaagaaaaaagctttcccaaagcctcacagctactaaaaaccaagactgggacctggacctgaagccaggtctgctgcttccaaagctactctaatcaccatagtctattattcctacaaaagcctagtttacccacaatgcacctgaaatgtagagtctggctttggagggaagtaggctttcttttttctgccactttcagtataagagacagaaagcattgtagtcaagtgttctgagccagagtccccaagttcaaagcccagctctgccactactggcagactaatcttggacaacatacttaatctctctctcccatagttcccatagttaagctaaaccatgtgaaactggtgatattctaccatatttaatctccaaaaaggggaatttcatgtctaaatatttaaagtgcttattataacagtgcatggcaaacagtaagcactatattcgtgttagctatgattcttactgaaaattgccttgagagtttgccatatctggagtatagtaggggctcaatagttgctggtgaatttattgaatgaagtagaaactgggatgcccaggaaacatctggggtagtctgggctatgaagaccctctagggctgggagaaaggcaagtagggcaggggaggaggttaggactcttagatttgaatagctttgagactctgttagtattgccctggaataaggcaggaaacctcaaagcgagaaggaccgatcccataggtccagccaccctgaagcagtttttgtcctctggcttctaaagaagcaaagaaaaaccctcaaggcagaggcagtggggagttaggtcttatggtttgcttgtgtcttgctttttttacagctagaaataatgagaaaaggcaggcaagggagagcctcccttccagcctttcctcagccgctggtgtttttccttcctagaccactgtgtgagaggaaggggaaaatgcagaaataatggtggatctttagaaacagaaagaccaatgttagaggttaggtgtaactgagcagagagtaatatttacccaggtatggtagtcatatcaccatatggctatgtgtagcatgtggacacacttctgtattacaatagttatgttcatttcaatgtgtcacaaaaatcttaacacattaagctttttatttcacagatattactttgggatgaggctaaattgattaaagtttttaaaaaatagattgctattttttctttcttttttcataatattccttcttgcatgtataacaactcatgggttgcaaaagaggatttattttttcgtgcctgtctactataagtctttgtccacaagtcaaacaaaagcaaacacaagtgctaaaaaggagactgattttaaaatgtagttaagaaataacagtctaagtggagcttagatttcatgaaaaccatgaacacagtaaatgatgactatggttaaggaagcactagaaatgcagttaggacacatctatgtattcctggctctggcttttagtagctaggtggcagtgggcaggttatttaatctctctaagtctcagttttcttatgtgtaaagtgaggatacttgctacctcaaaggtgatttttttttaatgatcaatgagaaatgtcttaaaagcaggtataagaattcagtagacactgtttatgactattatcattattattagcctggcacactcccagacctcagttaattgtagttttttagacagaagttttcaagccattctttcattcaaataaatagttcttaaacactactgtgttctaaagcttatgctagctgtggggacaaatttgaaagaggggaaggaagacctactctcacctctcaatgtgttcatgcctcaaaatttggagggggaggtcaggcatggtagctgtaatcacacctgtaatcccagcactttgggattctgaggtgggcagatcacttgaggtcaggagttcgagaccagcctgaccaacatggtgaaaccccgtctctactaaaaatacaaaaattagccaggtgtggttgtgggcacctatagtcccagctactctggaggctgaggcaggagaatggcgtgaacctgggaggcagagcttacagtgagccaagatcgccccactgcactccagcctgagcaacagagcgagactccgtctcaaatatatatatatatgtgtgtgtatatatatatatatgtgtatatatatgtatacatatatatgtgtatatatatatgtatacatatatatgtgtatatatatatatgtatacatatatatgtgtatatatatatgtatatatatacacacacacacacacaaaaattaatcaagagttgtggcacgtgcctgtaataccagctacttgggaggctgaggcaggagaatgaatcacttgaacctgggagggtgcagtgagccaagatggcgccactccactccagcctgggtgaaagagtgagactccgtctaaaaaaaaaaaaaaaaaattggagggggaacaggatggtcaataaataggtaattaccagtgtaaagccataaactctgtaagtggtgtggttataaaatatccagggaaggccaagcgtggtggctcatacttgtaatcccaggacttttgaaggctgtgatggaaggatcacttgagctcaggagttcaagaccagcctggcaacatagtgagaccccccaccccccgccatctctactaaaaaattaaaaataaaaataataaaaaataataactttaactgaccaggaatggtgacgcatacctgtagtcccagctacttgggaggctaaggtgggaggatcacttgagccaaggagacagacagctgcagtgagctatgactgcaccactaccctccaacctggatgacagagggagaccctatctcaaagaaaataaataaaaaataaataaatagtatgataaaatgtccagagagcatgcaggaggagatcagcttagaaaaatcctgtcagccacagtggtctaggacctcctctgtgaaatgtgttcagtataattgaagaactgaattaatttacatttaaaaactcaaatgatataaaatactttcattcagcacatttttattgtttttgcaagatgatgtttcactttaactgttgaaaatttagcatctgaattgagatgtgctgttaactataaaatacaaaccagattttgaagacttagtgcaaaaaaaatctttttactgtctcattaaagatttttatgttgattttatgttgataatattttggatatattgagtaaaaagcatagtattaaaatttttttacttatttcatgtggttactagaaaattttacatttcataagtgggccaggtgcagtggctcacgcctgtaatcccagtactgtgggagcagatgacctgaggtcaggagtttgagaccagcctggccaacatggcgaaaccctgtctctactacaaatacaaaaattggctagacatggtgatgcatgcctgtaatcccagctactcgggaggctgaggcatgagaatcccttgaacctgggaggcgcagtttgcagtgaactgagatagagctgctgcaatacagcctgggcgacagagggagaccctgtctcaaaaaaaaaaaaaaaaaaaagtcataagtggcttgtgttttatttctattggacagtgctgattacagcagaatgcaaatgacattcacagtagagaactccagaagatgtggacatttcagaagagacccaacttcggtcaccttggacaattctttctgacagatctagagcaaagcttaaaggatctgagggcaccgattcaaaggctgtttctggggctgcaggagaagagaagtgcctctgaggtttcgtcctaactacaggaccttgctagagttgccagatttagcaaacttataaattaaaacccggcaaccctagaccttgggtatgtcatagaactgcaacaagcctcggtctcttcatctttaaaattgggataaaaaagtaactgcctcgtgagtgtcctgtaaagcttaaatgaatcaaataagactagtaggagatgcattgagaaagtttggcctaaaagagctaagcaatgaaaacaaattggggaactttccaaacgtgcctatctttctttagctctgagcatgcaggtcagggagagctctcccaggccagtgttaagggagacaccagcccctacctgggagatgtattaggttaggcctggcttggggatttccatggagttaggatccggcatgggatcataagccataaggaggagggggacacataatgaccatgtcgaatgtcactctgctgtcattgcaatgccttgtataagccagaaatgccacaacagtctgcagtgctgttgccggttgacagaatcatgtgcctttagcaccaaagaaatgtgtgtgacttgagtgtcacataaaacccttaaaattagctctcttgggatgggcgtggtggctcacgcctgtaatcccagcactttgggaggccgaggcaggcggatcacctgaggtcaggagtttgagaccagcctggccaaatggtgaaaccccatctctactaaaaatacaaaaattagctgggcatggtggtgggtgcctgtaatcccagctacttgggaggctgaggctagataatcgcttgaacatgggaggtggaggttgcagtgagccgagatcgcaccattgcactctagcctgggcaacaagagcgaaactccatcaaaaaaaaaatatatatatatatatatataatatatgtatgtgtatatatatatatatatatatatgtatgtgtatatatatgtatgtgtatatatatacgtatgtgtatatatatatgtatgtgtatatatatacgtatgtgtatatatatataaattgtcacaaattcaaaataagtctacttgtatcacttatctaattgcagatgaaaatgtagttcttttttatagatgcaagtagcttacattccaaaaagaaattatcctcccccaccccaccccagattagctctttcctcataagaagctgaccatactgacattaagcatatcagaggctgaggaggactaccccttgcctgtgttttcattccctgctacctaatcaggccctgggagatagaactaatttttttaacgtgatgtttctttccatcagaatcaagttttaaatgtttcaggttagctatgtgaaatccacttaacttaaaaccatttgcaagagagatcaaatccaatttgctaatacaggacttttttttatttctgagtttgaaaaaatcttgagctaaccatgtcagaaattaaaaattgaaaaggactctggcagcctccccatgtgcctaatttggctttgctgaacaaatgaccaaattggaatgagaattacatacaggatttgctcaacatccttacttcttcaactcatttctcactcctgaaaaagtaccaagtttgcatgcaggagggaacatatctatattgaccacaatggcgtcaaaccaggtagaaatagaaaaatggtgattttagattctagctgtgaataaacttctacagtagaagatatttgtcatagaaactcaatttaatgaatttaggatcagaaaggaccataatggtctttttttttttttttggctaattttattaacaggttattttgttcatgccctaccttgcaaagagtagtaataaaaatattaagcgggtaagaggaggaggcttctctgaagtccacctcattttgtctttaataaggcattacattgcacacagacaccagaattctctgtctttctttaaggagatggaagaggacagtagagagagcaccagagagtccaaagatcaaggttcaaatcctggctcagtcagccattagctgtcatgaccctaggcaagtcatttcacttaagtagggctcagggtcaccatctgtctatacagcaaaagtctggaccagatggcctttgaggcccatcttaacagtacctctgccattctaatgtgacacagaaaaggaaaccacagaggtttctctgaaggagggggttcaggcaaatgagagaataatacctaggtgaatagaaccccattcttcactgatgcttagtgttgagctgatggttgtcagtggatggagtgatactcaagagcttcaggtgtcacacagctcaggttcaaatcccacctctaacacttaccagctgcgtgttacttcagcactctgagcctcaatttcttcatctgcaagatgggaaagcattatatatctcataaaattcgtaacaattgcttatcacagagcctggcacatgcaaaggactcaataagagttagccatgatcaccattgttacaaaacaacccaagacccagcaggaggtgagatgtttcttgagtgcctcctgtgtgccggttacccccacccagatcctcaccacttttgcaccttctccaccctataaggtcagtgtgagcaagaaaatgtggctaagagcacacacttggctctaaaaccagctgccccacctaccaaccctgtcaacacctttatgcctccactccttcctccgtaaaatgggaatcatagttcttacctctaggtttactgtaaagagcaaatgaggtgagcatatagagggcttagaacagtggttgacactgagtcagtacgttacaaaaatgttagttgttatcatagctaaggagagtgaagctcagagaggtaaatctgtttgcccaaggtatccgcttatgcatagttgtgcagaaatgtgaaccctgattgacatgaacctggcatatatatcccagagatctgggatagggagatccttcctcccttatacctggttcctaaggcccctcctggcctgttcccccagtttcaggatggagatccaggatagggagatccttcctcccttatacctggttcctaaggcccctcctggcatgttcccccagtttcaggatggctgcctgtgggctccagagttcagatcagagggctcactgggagcagtttgttgagggctgctggggacttgggaagggaaataaatcccaaccctctcctcccttgcctgcagccactgaggggagaaagtgccctaggaatggagtatctcgggtgtcctaattggcacactctgacccccttgcctctcctccttgcagaaggctatttttcacgagagagttctttctctttgttccagtgctcattgcacatctacggatcgatatgacatcttatcctctaaaacattcataatgtctgcttcctaggattctggtggccgcgtgccacgtgcagcctgcgtcttctttcctttgtagtcagtggtctcaccgatctgcccctctttaacggggctgctggttgccgttctttgaagaaagacaaatattgtttgggttgtcaacagtgaatgacaagctcggaggggagaaagatccatttaggtgtagatgtgtgtattgtggggatgtgtttcgttatcagaaaagctcttaaaatcccagaccatgatttatttggtgaataaaacctaccgatattatcattctctaaaggtattttgatcacatgggtcctttcttggagaaagaaaagcttttatttcttaaccaggaaaaaaattgcagcaggaacggggtggtctgcggtgggaaacgacactctgtgcggctaatggctccaggcttgtgtttatctgcatgaggctgagctgacttggtggacaataggatgcctgactagcattgccagtcaggtgcattcctggccaccccgcacaaggaaaagaaagtggctgtgagcacatgtgtctttcttatgtattgatctttccagtgatgctgagagctagggggtgtggttagaggtcacctcggcacaccagatgccacacactcgcagtgtcaacagcacccacctgcagtgcacctgcagcagcgggttccaggagacaaggggagggacgctgccagtcggggagccccacgcatcctgaagctgacaggagccccatttgttttctgcaaacacagcaattgattaatctcgtaccacctcccactcactgtaccatcctgagcctgtcatgagaatagattaattctctggtctttccctgtggattcttcttgtctcaagaacacactgctccctgatcccagagctgcctcacgcaactatcaccttgttctcatggcagacacaaaggaggggacagaaagccttgctacttttgtgagggactagaagtaggaaggcagcagacaaaatccctgctgaggacagttttgggactgtagctggaagatttgagttcctctagagaggtgaatgcaggtgagtttctccaatgccccctctcattttgatgatcttgccacgattctgggattgtatctgcctctcatctttcctcttctttgtaattcctgagccataagccttgcaaccatttggagctgcaagctggaagtcggacagaggctagtaagctttcagaacattctcgggagataggtgcacaaatcccattaccgttaaagggatttgtgggtgtaacttccatgcagtgctttgaaaattcattccactcagtgtattgcaacactgtctgggaaaaataggagaaatcacttcaccaaggtggttagaaaaggatttttggtaaccctttaagatttaaatttttaaactccttttaagacttaaggcatttccaagaatgttatcccacatagttttgtttgcattacttctttcaggctgaaggtaattttggcactgacagcattcctaaaaataataatacattgcagtgggccccctcctctttgaggaagaggcactgcactcaactgcatccccaaaggatgacaagcaaactgacaagggaaaaaacaccaaacatgttgttgactggcctgactggcaattgaagttgccgagcagatttattttacgttgacaatggtggttcaagttaaatagcaaactagttgccaaccaaggacatattcgtagagactaatggctgcttacaaagggaagtgtgtattcatgagtgagccttgacaatatttagtaagtaagtgattctatagcctacctgtcctgttcggtcttgtctaagtagtggttcacttggaaacctcagagggccgatgtcctccagtgagaactctgaatggagtctctaggaggacagtatgggaatttagaactctgactctgaagttgcatgtgtctgggtctaaatcccagatttcccacttactggctgaattgtcttgggcaagtctcttaacctctctaagctcctatttctttatctataaaatgtagattatattaccacctaatccagtgagaatgaaggggaaaaagtaaacgttcatcttcttcaaaatccagtgtcatcccttctcttccaaacaaaaggcaaagctcctcaaaggcaactactccttcaccctgcccgtcccttcacccaccactcctccttctcactaactccactccccttcggcgtgctcttccccagacgtcagcataaactgctttctcaattcctttatgtctttgctcaaatgttacctatcacaaatgccatccttgaccagactacattaaatgaaaaaaggaagaaattttcaatgcatcccccacctgcgagtgcctctgaaccctaaacctggcttttcacttatgtgtttagtttctacacctgcctctagaatgtaggttccatgacagcaaggattttgtcttgttaaaactgctttactcctggtgcctaggacacatctgacacccagtgggtgtttagtaaatatgtgctgactggcaaattatgaatatatgctgcatgcaaataatgagcccaatacctggcacatggtcaaaatgaacgttaattgtcaccatcaccattgagtagacttattcacatgtgttaattttcactgctgattgcaaaggggcctttgcaggttgcctatgcaagttcagggtaagcagttgtgcatgttagccctgattattccactgtggttctctcctcccagcagtggcacttttggaattggtatatttcccccaggagccccgacattgttgacttaattggctggtgcagaggcacggagacccagccctaaccctttctgtcatcctacctggtctctgaatgagctctgccatcatctctaaggcccttgtgtatctgatggcatgctgagccccaagacccagcaggcatggctctctcctcctgctccctgagctctgcttggcctgcagtcttccattttcaaagggaaagcccaatctcctcctcgcgttatgtatcgacaagtctgatctttaaagacaccccctgctcctgggggcctgctcggcaaacacagagcatccgtggcctccatgtttgccctctttgacaagcaggggctgagcagctctctgggaagtattgctgacatattgattgactctcttgtcaggttgatcctctgccagccaatgaacacagaaggttctaagtggcacccagcagggcccacacattccctaattactatttcatacaacccccattccaagctgccacttttctggccctataatctccctgtcctgtggttgctggagaatcctcagttactcgcaacgaaccctgctccctttctcgggtgtcactcccttgcagtattgcctttggaacccacctggcacaaaaacacagcaacttcaataagaaaatatcacaccctcactccacgtaggtctgtttattatccttactgaaatcggggatctgtgtgtggtcccaccatcctgtcttggttcccttcagaatgccaagaaagttttctccaattagccggagggatactctcagagtttggctgcctattgtgttttaagtggctggcttcccagctgccacctggatttcatgagtttccgctcagagcccttccccatcccatccttagtgacccatggagcccgagggtctctctgaagcggagcctgtcagatcatgatgaattgtacattttggctgtcagtgagagggaggaatgttagggagagggcctcccaaactcatttcacttttgacccccagatgatttggaccaggccttttgggatgaactgctagagcattcaaggtggggcgggagagggaaccaccccagtgcatccaggatctcttgaggagaccagcatttatttgaaatcttgagatgaagcagcaataactctggctactctgaggtttctcagctttctttttttttttttaactaattaaatttttggtagagatagggtcttcctatgttacacaggctggtcttgaacacctggcctcaggcaatcctcttgcctcaatctcccaaagcactgggattataggcgtgagccaccccatccagctcagctttctaagtctggttctgagagtaaattaaaattggaggtatgatgatatcacatttacagtgctgttttttgttgttgttcatagaagcaaatatagtggcccaaagtatgtgctaattctctctggctgagtttcagaaaggaccttaacccaataaaacctaaagggatgcacagagatttgctgtataaaaatgccatttcctagtttccttataggtgaaagtatcagtcaagctagcctcagacaggctgctgtaacaaacaatcccaaactctcagtggcttataacagtaacagttcatgtcttcatacatgctgtattctatcactggtcagccatggctgtagcccacgtcatcttcactgaagacccagaatggctatgtgataaagtatgtgctgaattcaacagtataaagaaatctaacccctctcgggaaggggtgtggtcattcaccaaccccaatgagattattatgagttttgaaacaaagaagaggtttgctgagactccattacccatagaatctgtaaccagatcactatgaaatatgaagcagatagccacctcccacagtaatttccttctgattctgaaatccctgttctcaaacttcacagtcaatagtttcctcatctgtgaaatggggttgataatagtacctacctgtgagtcttaagataatgcctttagaatgtctactatggtacctggctatagaaaaggttcaatgatggtggggcgcggtggctcacgcctgtaatcccagcactttgggaggccgaggtgggtggatcacgaggtcaggagatcaaaaccatcctggctaacacggtgaaaccccgtctctactaaaaatacaaaaacaaaattagccaagcatgcgggcgcctgtagtcccagatactcgggagggtgaggcaagagaatggcctgaacccaggaggcagagcttgcagtgagcctagatagcgccactgcactaaaagaaaaggttcaatgattggcagcaggtgttgatatgctgatgattaaaatatccttccctttgcaaactagtccatattgctaccagcactgttttatcccatcttctatgcctctgattatgtgttttttaatttataagcatataacatcctacaatccaaccccccaaatctgccccccgtgtatcattatctattctaataaatattgatggagtgccatttatattcaagacactgtcagatcttttgggggttgcagatgtgtaacctctctgtggcccttaaggagccattattctacctgtacagggaaacctttatgaaaggtaaagggagagattgattgagagactgatttctcagcccaagccatagagcaaatcagtagcagaataagaaatagggctctcattagtcaggaaactcatttacttcacagctccctggggtctttatcctaaggacactttagtccctccccaccggccagagagagcatctcgttttcttactcaagtgagagagaaagaatggctgattaaaaaaaaaaaaaagtgccaacaaaaacctatttcagacgctcccaaaaaacaagagaaggtggttataccccagatataattctcacttatttacttaatgttcagttcaacaacagaaaatatgcccaaacttgagtttcatttttgttgcattgcttcttttggaaggacaggtctcatgttcagcagatttggcttttccccttctccacctccatctcactttcttatttttcttctcactcctgggagttgtctgagaagttactggtgtactctgaccctaaccctttccacctcatctgtagttttcttattttcaggatacttttaaaaaataaaaataaaaagatgccatggaacccaaaacaaagaaaaaggtgggaaggggaggcaagagggaaggcatccttggaaacagaggaaacacagttgcagggatgtctcttcctgttcagtaacattaggggattgtttgcttccttttctcccaaagctgatggttgcaatatgttctgcaccttacagtggcaagattgagtgctataagagcagagcagttttgacaagagtttgagatgggatgttggggaggttgtcatctttgcctgatgggacccaccactccttccatagacgtgaaatcaaagctttgttaggcctgggttccagcggcacctgcagtacctgccagtgtctgtcttaagaccctccttgaaagaaccgcacctccagtgcagctgcagctggcccaaggcgagcttcaataacccaatagtatcatttttttaaaaaattattttaaaatagctaattccttggctcccttcacctggtaattacaaatcagaagctatcgttatcttgaagccaccatgattagttctcatttcctgacctctgtatagtgaaaatatgtcattatttgaggcaatggaatctggtctcttcaagtgagtgacctacatataacggacaaactgcaggagaaaattaggtgttaccttgatggaaagtgtacagtaaatgtcacttactcttattactatttatcatctcaagaagttgtaacagtgggcctttcactttagaggaaagaaaacatggttctaagatggagaagagtgtaagtgaaaagcagacacacccacacacacacggacaccttgccaccttcatctgtggccatcaatctgagctgtattgtttgaagataggtttttaaccttaatagaatgcagtctgactttacgtggtggtaggcatgcagaattaattgctgtgtgaacaatttcctaagcattgttaattgtgttccctgcagataattgtttctcccatccccacatcagactccaaacgtctccctgtcaacagccctttctctcctgcggtggtaggaatgtagcaacagtgtcaacctgtgtccagtggaaatgccagacatcgtttggatgagagacatgcaggggaataaattccttacttattctcaaaggaagcatctcttagataagggctttgaaagaatacaggtgtttagggtttgcttttcattccactcagtagaaaaaactcaccaagaaccatcagggatagggttgtgttaagtttgctaaactcatggtggggagttgacacaggcaggatgacaaggaagaccagaagtttgtttggaggcctggggtgcccatgggagtcaagacttcttcagacgtgctcagttccttagcaaagaacaggcagtatttcagaactctgtttcattccatactctgctaaagtgagagcgacagagacagaaagaatagtaatgttttcagaaaaggaccccattccaccatcaaccccccaagctttttctacaatgtgctgaaaggtatccactcatcatgaagaggagtggaaaggaaaaatattctaaaagtttgaaatagttagggaggtgggccagtaccactatagatgctgctggctgcactgatagttcagagcaggtaccagcaaacaggtaccagcaaacaggtactattcgggtagcctcctttgaagctgatttacttgtgagtgtatagtttggggaaacaatccttgtcaatgcccctagactaacagtctaaaagcaactgtgtccagagtgtagaaaaggatggatgtggtagagcagcactctttacagtgattcgaaagggccattttcccctccatggtggcaccgtttggaagatctgggctgtgttttctcctccctcctccgctcactgtaagggatcctctccccctgagactgtgagcagcagcgccagaaggggagacctaaccacccaggtctctgctttctgtatttagctaatccctgtggcctggggcaagccatttttgacgcagcttcctcaaaaggcaatcgcttggaaaagggcacctggccctcccccttgacatttgcattgctgaattatctattcatattttcattactttgtctctcctgcagcaatgcatctgctcggactcaattggcaactccagcctgcagatgggcacacctttaacaatgggataaggaccggcttaccaggaaacgatgatgtggcaacaatgccatctggaggcaaaggtgaggttacagctgctgcttgccctcttgaggtcacaggaaaattctgagctctcgccagctggttcaggttttctaatccaaatcttggaaggtatgccaaaagaaaaagaaacggggggaaaaatcattgcctttcataggtgcccccattaaaagctgtttgctgttcctgtctgttagctgtgtttggctggatcactcagagctggcacagtgcctgctcagagcaatgtgcatacctatgctatctgcagcaactggcatggtccagagctacttgaaagcatcccagggcctgtgcagaaacagcagccacagcagcagctggagtggcagcagcagcagcagcagcagcaggagaaagtcctgcctaatcagaaggcagagagcagcaggcagcacatgccatcagactgggtccctctcccaggagacatgcagcctccctggggaggaagctgcctggcttggcatgaaagagaaaggctcagagctgctgtgctttgggggagaatagaaaggagttttgacaactcggcaacaaagcttctcttctcagaacagtgaaggggacaatagaaatgtttattgaagcaatcaggcaactgtatccttgaagggaaaaaaaaaggtgctaacaaggtgctaagaaggaggagagaaaacagaaccatagggtgggggtgggggagactggagcaattaagacagagcagccaatggaatggttagccaggctggcacgcagtgagatatgcttaattcgggatggaaatcgcaagggagagattgtattaaaggatttctccaacatgcaaatttccattctgccttttagcatctatagccacttcacccccacatttcggaaacaccctacagggatatttcaaagaagggaaaggaagcagcatttattaggcacctattgcatgccaggcttagcattgtataactttaacaactttaaaggaaggaaaaatctctctgagaaactcaggaccagaaggtatagaaacttactcaaataggtacaaatttggactcagagttgtgccctgtgcatctttgggcaggaggttggagctttccttcaagcagtcattttccacaaagaagattccagaattcatctgcccccagaggtgcacattagtcatcctgagatgctaatgctgcttcaattatcctccccagagctgtcctaatgctttgaggatgacttttttgtctttttatccagtctttaagaatcgctgtactcatctgtcataatcataacactaaattacctttaagtaagcatgaaaaagttttatctgaggatgaaattatatgctttccataatcgggtaagttaaactagacctaaaactgaaaagtatattttgccttaactgaccatgttctgccttaactgaccaaaaagcccagagccaaatgtattgacctcagatttgaaacctggtcacctccagtacttgacactgtctgctccttcagttttatctagggcaatggttcttagtcatagcatttttgcacccctagaggacatttggcaatgtctaaagactattttgattgtcacagttggaaggggcatggcaggcatctagtggataggggtcagagatgctgttaaacaacctataatacacaggacagccccctgtgatgaagaattatctcctttcaagatgacaatagtgctgcccttggaaactccactttatggggtctccgtcacgttttatccataaatgtcctttaatctacaagtcagcacctcatcccttcagaagaatgcataacacacatgtgaaatgaatatgcatattctatcattgggcacagagaaattgtttatatgtgtatacattctgaaattatatgccaatgcttttcgagtagtgtccttcataaatgggaattagtgatctctactggcctccgtaaattaaggtcaagatcaagcactcctcccatttgtgataagcctctatttctacctctgctccccaccagcttttgcatcccacacccatagaacaaatcttaagagtacaagagtatgcgtctctaaattaacaaatgaagaaacactttccattgtgtctttggaaagaccagaatttttcccctcctgtgcaacatgcttttgaaaatgttgttgtagaagtcatataacattactagttcagatattttccaaataagttatgtgacagacaaaatgttattttgtttttttgttttgttttgtttgagacagagtctcactctgtcacctaggctggagtgcagtgatgcaatctcggctcactgcaacctccacctccccggttcaagcaattctcctgcctcagcctccagagtggctgggactacaggcatgtgccaccacgcctggctaattttttgtattttagtggagacggagtttcaccatgttgcccaggctggttgcaaactcctgagctcaggcaatcctcccatctcggccccccaaagtgctgggattacaggcatgagccactgtgcccagcagagacagacaaaatgtttgccaaatcattgtccagtgaattttgtcaatagaatactcaagaaaaaagtgtgagaatttaaaattgcttagagatgaaataaaatttgaaacttaaaaagagatcagatctcttcttaagtggttttaaggtttggcttataaaatgactaaaatgttttcagttctctcacccatgcctatttcttttatcaaaagtgaccttgggtttgaatttgtatacccagtgacctccgcgctccccattccccaattctatacatttagataacctgaatcaattccaatcgacttcttttccagtgtttcaaagagacaatcaagatatattggcaataagttaattaaataacaccgcctcctttttttggtgtaggatattccttcactccaatgttttaaccaagatacaccacacattgccaaggaggataatctcattaagcaattactggataagtatccagcagaagcaaattaaatgtaagcaaaacacaggcatgtgagtcccatctaagatggcacatcgatagagatttcattacctggtctttaggagtatttacattcctcaggtttgggaacaagtctaatagacagggcagcctacacactctgatatgttggtggaaacaaagcacttgattaattagttgggagagtacattctttggtctttgcctttccgttttccatttgttgttgttcgagtcttatttttctttcttccactctccttcaattaaaccttaacatgaattgttgctggctttcacatcaagaagagggaacacacagtctgccagaatcactcaccatcttgtgtgtatttctatgttaaaaggaatgaactcatacatcttcattacaagggcatggagaactttctctgtagatctgggattagataagccttgagaaagacgattcaatacagtattctgacctggtcagataacataagggaattcagtttgattggccaggcccagggaaagcatacaagagattttaaagggcgcatcatacgtacccaatttgtgcacagattttaagaaagaataaactatcaagtatagaattgcatggatcattctcaaaacctatcactcattttagattcaagttgtcctctatatcaggggtcagcaaactacatctcatggaccaaatctggccagctgcctgtttttataaatcaagttttaatggaacaccaccatgactattacctgttgtctatggctactttcagaataaaatggtggaattgagtgggtgcaacagagactatatggcccaaaaagcctaaaatattcaccatctgaccctttaaaaaaaataaaaagtttgatggccactctgtatcattgccaatcccatttccacttttctagaacttttcctataactatccaagttataggagtccagaagaggaagatcaaactcccaatacatcacttcttcctacttgaccaagccctagttataatatattcttggtaactttgcattggaagatgcactataatataggattttggagttggtctggtggatacaaacaccagctccatcacttagcaactgtatgactgtaagtgggtcatttgttctctcccaacctccagttcctcatctgtgaaatgcaactccctcataagcttgctgtccatcataaatgagatgacccttgtaaaacattgcatgtggcatcaggcatgtaataaatgatccacgagtcttagttgttgaaactgatgtcatctttacatctctcagctggtccatttaacaagtttccatggcctgtcacatcttttgagaggctatattttccaaaggtgaagaccaaccaggtgcagtggctcacgcctgtaatcccaacactttgggatgcgaaagtgagaggatcacttaaggccaggaggtcgagaccagcctgggcaacaaagtgagacctcatccctatttttaaaaatataaaaataggccaggtgcagtggctcatgcctgtaatcccagcactttgggaagccgatcacgagctcaggagatcaagaccatcctggctaacatggtgagaccccgtctctactaaaaatacaaaaaaaaagttagccaggcggggtggtgggtgcctgtagtcccagctactcgggaggctgaggcaggagaatggcgtgaacccaggaggcggagcttgcagtgagctgagatcatgccactgcactccagcctgggcaacagagcgagactctgtgtccatatatacacacacccacacacacacacatatatatgtgtatgtatgtgtatatatatatatacacacacacatatacacacatatatatgtatatatataaaataaaacaaaggtgaagacggccttcagaatatgaagatagacaataccacttcacctttttcctttaccttctaagaattaaccaaaccccagatgaggatttcttcccaacattggcttgatgaggtcagtaggaagcaggtcttcctattccaaagggccaatgtgtacaccaagttggcccctccacactgcattatttgtctcactggagcttgagttccatcattgccagcctgtctgttttaagccctaccattctcggtttataactcagctgtaaacatttatttgtgcctggagcacatttccttcctaccctttgaaaaaaaaaattagaatttccagatggtatgcaagttggaaaaaaatggcaaagactgttattctgtttagaaacatgtttttctacacttgccctttcagcagaaacttcataatgatttttactagttggcttaatgcgtggtactaggagccagattagcagggaggttcgtaaattcttccgctggctctcatcagcctctcaatgaacacagcccagggttttaaaatgatcacttccctatatggggcttttccaaagtcggtgaagttcccagaagggcaaagggtcattatgtttgagccaaacacccctttactgcacgtctactggcaaatataccaacatcctaactaccaacccaacaactcccctcatttaggaggccatgctgttctacattgttgcagatgggtactacttacatgcacttatactggtggacttttgcttttgattgccacccatagccccattctaaattgcatagtttctgttgtacatagcatcatggtggcttgacatgggcattaataatgagatccaatttccctttctgtgcatttgcccatatcctcactggccacacttctctttcagaattgacttgtacacccagatatctggtctatgatctctaaatatgtacctgtggtatacctctgatatgttggcccttcatacccacgggtatccacagattcaaccaacctcagattgaaaatatttggaataataataatacacaaaatgcaaataaaaatgatagtataacaactatttacatagcatctacattgtattaggtattataagtaatctagagataatgtgaattatagaggaggacatacatgggttatgtgaaaatactacaccattttatataaagagcttgagcatttacagattttggtatccacaggggtcctggaatccataccctgtggataccaagggatgactgtgggcctgaatgcagtcagcataggggttagccacatgggttttagtgtctgtcagacgtgggttttgatcatagatctaccagtaaaaagctgggtgaccctaagcaagtcacttatcttccatgaacctcagttctctcatctgaaaaacaggaaaaattgtaagagtatcaggagattacatggtgattagcagccactcaataaattttagctactatcaataatagtaaactaaactaaatattaatgcaggagcaagttcatctgaagagtcataggtataaatacttgttaacgttcctagcggcaaagagttgactatttttatctaaagcaacaaattgaaatttcaaaagatgtaaaagccacatgtagtcccaagagctgaaacattttctaaaagtcattattgtgtgatgttgtgaacaccatcacagaagcagtgactttcaggatgtaattgcattcctaaagtatagccagccagcagcagggtgaaggctgatgggttgctgatgtctcagctgagctgtattcttgggcagtcaatctaaggtccttggaagaatcttttcacttatctgttggttaaacagaaccctcagatggttgtcctgattcccaaataaatggaaacgaggtgtaatgactgtagcaatattctgaattcaattttatttgcaatagataaaaatatgtgaggcagaataatctgcaaggcagatttatgctgaggtgcctccagagttcggttaagttaggaagtattaatatgaggcttcatttccctggtatgactatgagtccattccctttatcacttgtttggggaatagtttcactgtttctgtaaatgaattatggcaacattttctgaaatgattagctcctaatgtagctatggaaggctgtcattttgctcaacatcagtcgtgtttaactggttgaaattttaggtacatatttcagaaataggtaatagtttcacatttacatgagcaatcttccgtggagttatagagttggactatcctgtaaaattgatcattagaatgttgcctctaaaaacccagaaatctcatctctaagctaaagatgaactagccagaacaattgtatcttaagcacgtgcttcttagggcaaaatgatcatcatgacacttttcattgtgcagctcttggatagactgaaaggtttgccatggaagccccaactctgggagacatgaactggactggttcctgcatgccagggtgccaggcctagtcattgcctagaacccaaggataccagtgagatcctcacagaatgattacaggatgctgtttaatgcctcttctcttgatgcccctaattcaatctcaaagtgaattcataggacgctggacaacaggctgcctagataagagataatgggaatacaacatacaccccaactctgatgttgaccaaagaatacctactgttatagtcaatgcttgataaatatttattgcatggaagtatgaatgaatggcccacccaacattgcttaggacatttcttaatcattgttaaataaataaaatctggctgcttttcaataacgcagactgcacagagttgcccatgtgagaagcagctagaccacacaccaacaccagcaatttgcagagaatgaactggtgatgcagttttctctgaccatcgtatcttaatacatgtgacctgttgtctgcccctcccagtctgcagatgtactggtcactcactgtatattgatttcagctgctctggaaaatgactgccagttttattaagggctactccacccattggccctctttcattaatagtgcctacagcaggcagcctgtattttttattaggccatcacaaattcaccccccgcaactgaaaaaaagtacttacagctgattttaggtagcatcacaacagacaggacagaaggacgtagagcacctacaatttaggtacaacatgcagaagcaccccaaaatacagatgagtagacagactcagagagggcttttgattagcccaaaggcacacagctggtagctatcagagctgggattcaaacccaggctgactagctccactgggcaacattgcctccttaaggtctcagaacttctcaataggatattcagctagaccttaaaatgtctagctaggcattagacattttaagataaagataaaaatcttaactactttgtttccttgctgtctgcctctcagtgatgtcttgtgagggactcaccatattggtggtcctggaacagctggcatggctcagggaagcccagcttcaagtccttcttcatggaactcagcctggctttgatgctgttctttttgaccttagagaacaacagagatctgtcctcctggacatcggcccagaaatttgacctccaggaatagagtcactgagatggttccccatgctggctgcagcaatttacagaaaaacaccttttctttttatctctttggaggcagtatttgtacatttttctctttttcattgtttttaaaattacaaaagttatacacactcattttcaagatttttaaaaagtatataaaaaacttttcttttgctatcatgaatatttctctaacaattgacaaatttgaataaggcctatagattacagtcatgcatggcaaaacagtgtttcagccaatgattggccagatattcagtactggtctcataagattataatggagctgaaaaattcctatcacctagtgacatcttagctgtccaaatgttatagtatagttactttttttattaagttagtgtagcctaagtctacagtatttacaaggtcaaaagtagcatacagtaatgtcctagcccttcactttcactcaccactcactcactgacttaaacaaagcaacttccagtcctgcaaattccattcatggtacgtgtcctatacaggtgtaccattcattttttatctcttataccatatttttttactgtgtcttttctatgtttagatacacaagtaccactgagttacagttgcctacagtattcaatatagtaacatgctgtacatgtttgtaacctaggagcaatagggtataccatatagcctaggtatgtagtaagctacaccatctagatttgtgtgagtatactcacaccactatgaaattgcctaagagtacatttctcagaatgtatccctgttgttaagtgactcatgactgtatatatatagagagaaagaatgtgtgtaaaaaaatctatatatgtacatatatatgagtaaaaagtgaaaacccctctttccaaaagtgtaattcagttacacacctgaagaacttaatttgaaagcaaacactagcttgtttaacaatatggatatcttctgttaaataaatcgagcttgtgaaagtgaagtcacctgttaacaagcctaaaagctttctaataactcctcctccctcctgctgaccccctacccctgtcgcctcgcccaacacacacacacacacacacactcactcacactcacacttcttcatagcatatacccagcaatgatcctcctgacccactctgagaccacaataggctaataaggaatgccatttaagatatctttgggtctgagacactctaatatagatatggacattgagactttgagaaatacacctgcctaaaactagctagctgcttagtaacaaggatggaaattcaacataatcattcatttacacctgttccttccacaaacatttcgaagtcattaagtcatgactaggactcttgacttttggttcttaatctaaggattttctcaccatatcacacctctcccagtttgtttgtttgtttgtttattgttaagattttacacaaaaggcaaattaagcatttgctcatgactcttcaaaaggatccacaagaaaagttatttcaatagtaaatttcatatagagcttctaaaattttattttatttaataaataaaattcagtttacatgttgtcaggttctaactgaggtctgaggggagtcggtgggagagtggtgggtagctggaaaaaccctcaaagaatcatagacagtttcaatatggctttactctctctctctctctgggcatgagtgagcctgggtgcgagcctggttgcaagctggatgtacagcatcagcagggtagttataccttttacagacaatagtggctcccagccaagcacaagctcacatgagtggttacctaatgcgcctcacatggcataattacataatgagcggagttgtgcgcctgtgctccaaacttgctgagttatgcgtgacaggatgtctccctcggcctagaccgcagcacatccattttccttacacatgtagattttcaaagtaaatctttgttaaggctctcactttaccctgtcatcacaggggttttgttacaataccccaccagatggatttgtagagtttgatccagttcaataagcatttatagatcacttacatttgccaggtgcaaagcttagagaacctagagatgaatctgcatctctgcctgacctcagggagcacagtgtccagagacagagacttaggaaggcatgcaaaatcaagtacaatacctaacaacatctgctgtgggctgcagaaaagcataattgctatagaaacacagagaaaacaattttgtctggctgaggacagtggttggggtggtattgtaaaggaaagtagaactttagtgtgaaggtgcacttgacctgaaccaggccctgactcccagttttaagcttgtccccataaatgaatctattccagaaaaataagactcttgatagagagctagatatatacaaatagacatttagacattcatgtatattgcatgtgcccacactattttttgtctcttagagaattccttactctgcaaagaaagccagatgctttcccacatagtttttcatcctttttttcattccatgtaagaacttagcaattatttcatgattatttcatgttaggcactatactaatctctcttttgtgtgcttctacttgttacaccctccaaggcagttagaactattgttcccattttacaaaaaaaaaggactggaaatccagagaggttaagcaaattgctagaggtcacacagcataaaagaagcagagccaggattcaaacacagttctatctgacttctgtacttcatcccccaggtgcactcccttatttagtgaatgggatgaggaagcgaggatctaaaaccctaaggggcactgtgactactgaggaagtagcctgtgctggctggtagtgggagctaatttagtcagtgtcctgaggccagggtgtaataaggaagaggacctcactgctataagaagcactggggctccttgtctgaatttctccagaacagctgctccctggagacaagttcccttgcacatctccagcatctgcatctggcttgatatcacaatccattcaggtttccacagtagattagaacactcgtgggtgctgatttcctgcctctttttcatatcctgtcattaacccagcaatgccggaaagcccaacagacataaaggaaagccaagcttattaagttaaagatgaatcatgtttttaaagttttctttttttatttataatgcatttctttaacttgttgccatgctgattgctggggtttcttttggtacctatcagaggcccacacactcttcttccccaggcggctctcttactatgtcccttccttactcctttttatattattatattccttctttttatttatatcctttttattatatcccttccccaaggaaggggtatcaaatgcagcattttaaagtaaaatttagtttccagtttatagtaatgagagctcctgatcaacttgttgtgataacaagtgtttccccctggacatgccattgttttagcaaaacccccaaataaacaacacctaatttagggttagggccttacaggtaataatacttattttgtgccagaaattattctaagagctttacacagcctaacctcagtaaaaccttataacaatcctgtgaaataaatagtgtcccatctatacacatgaggacactgaagcagagcaagatacatttagccagtatcaaagttaggatttgagccatggcaatttcagcccagggtctctgctcttaaacatgatgccgtattcctccccctgcaggtaagtaatcagtatccattagaaaagttagccaacatttaaaagttcatgctgggtgtggtggctcacagaggtaatcccagcattttgggaggccaaagctggagaatcacttgagaacaagagtttgagaccagtgcctgggcaacatagtgacaccttgtctctacgaaaaaaaaaaaaaaagaaaaaagaaaaaaactttaagcagacagggatggtggtccatgcctatcgtcccagctaatttggggggctgaggcaggaggatcacttgagcccaggaggtcagggctgcagtgagctgagatcgtgccactgcactctagcctaggcaacagagtgagaccctgtctcaaaaaaacaaacaaaacaaaacaaaagttcagaatgtttgctaaataaaccgtctagtccccatctgaaggtctgaaccactcaggacttctggctgtttattttatttttaaagatgagatgtgaaggaggcttccaaacttcctttcggacctcattccctacttttattatcctagaagtcaaagggttattcttaagatcgaaaccagtgtttctcttgctttattttaagtccctgctggcttcgtattgagctgcataaaaatcaatcacctcatattttaaagaaaataagagggaaaaactttatatcttcaaatcactctgtggttttcttttataatttagacatgaaagaccttcagagaccaaaagtgtcatctctccattttacacatagagaaactgggaccaagagacagtgtcagacaggctcgctcaccgtttaggccagtctttagcaattttctcatttctcaggatcatctgaaacctttgcaatatctggtggccaaatgatagataaatatttttagaagagttagtccttcacagaatgtcgaggggagcatcctggccccatcaggctgaagaaatttttggatctacaaggtcacaaaagtgatcgggggttccagaaatgaaaagactcccctcaaaacaagaatgacctcagttctttctgttttatttcagttggctcagcagttcttaggaatatagaagaataatattttatatttcttagcaagttcagaatcgatttgaaggaatcacaaatggcctttatactgagactttttttccccattttagagataaggaaaatgaagctctcagagattgattaacttgcttttcttgggcaactgctagtcacgctcagcttttccttaattctgtggttgcaagggaaaccacacttggaagtatagggggtgctgactggttcattgtttttaagaactccactttaaaaatagatatttttggaattcctattattaaagttctgaaggatactgagtgtgggcaaccaatattttcaacataagcaattttaaataatgcaacagagatgcattaatataaatgaaggagagatgttgtttctctgcggctcttagacttctccctctaactcaagatctgcttgagtttcaagtcttcattttctactgagttgttttatttattctgggctgatttttgttgaaaatgtcagagtatatttgtgtctagaaagaataatgaaaggctacaagaattaaatttggtgccaaattaacatcaccctcccctcccctgctgataagttttacatcccagtcacatttgggatagttggaagctttacatgtatttatcaggctccagatctgattatatttgatcagtaaagagtaataacataattttagaaagcattgtgccaagatttcggatgccctggggtgtgcatttatagctttgttatttgaaacctaaatgttttagctgtaacttaaaaagaaacttgccatgagtttaatcttaatattaaaacaacaacaaaaaaaaacctggcatgtaattaaacaaatatagagccaactaatctatacacgtcattgactgctgtttattccttttttttttttcagtgccctggtcgttgaaaaacagcagcatagacagtggtgaagcagaagttggtcggcgggtaacacaagaagtcccaccaggggtgttttggaggtcacaaattcacatcagtcagccccagttcttaaagttcaacatctccctcgggaaggacgctctctttggtgtttacataagaagaggacttccaccatctcatgcccaggtatgaccatgtttgatgtaatcaagcatttaaaaaaatatatacgtatatatgtgtgtgtgtatatatgccacttcacatccactacaatgcctataattaaaagatggacaataaaaatgttggcgagaatttggagaaataagaacccttgtacattgctggtgggaatgtgaaatggtgcagctgttgtggaaaagagacagtttttcacaaagttaaatgtagacttaccatgtgattgagcaattccacttctaggtatatacccagagaaaattgaaaacaccattttcttacaaaaacgtatgtatcagtgttcatcatagccttatttatgatagccaaacagtagaaccaacccaaatgtccaactggtgagtggctaaacaaaatccgatatagccgtaccattagtcagatatagaaaggaatggagtattgttacatgctacaacatggatgaactttaaaaacactatgcaaagtgaaagaagccagataccaaaggccacatattgcatgattccgtttatgtgttttgtccagaataagcaaatacatagaaacagaaaggaggttagtggttgccaggaactgggaattggggctaactgccacggggtttttggggggtagtgatagtaatggcctgaaatgaggtgatggtttacccaacatagtgaatacactcaagccacagcattgtaaaatcacaaaagctacccaccttacagttattcacagtgtcgtatgaattttatctccaaaaaataaatgctaatatcccaacctgatgaaaacagctttactaggtttaggggttaatcactgggtactttctgttcagatgttctggttattggattaatttgttaaaatatcactaggagacatctcagtatatatgaaaagaataatgtaacataaactaaaattcagcagatgtttctctgtggctcccctgtactaagttccttgggaagtccttggcactatgaaagtgagattattcacagcattggaagtgaagagattggattacattatggatttcattattttttctctcattcttcccttagtttgtcgtggtggaagttctattattatacataacacctggggtaaattaacacctacctagtttggttttcttttccaataagaattgtatatcctgtgaaaaaaccagtgggtttttcctgccttgtatgccctcaaatccaggaagaacataaggtacattaggaaaaaacccaaaacatgcatatatccagtcaaagctgactttgaaatgtgttggaaaggcaattcatctagaaaattcaattggaagaacttaaagctataaaaaaacccattggcaaatgcaaggtagtcaggctacaatttctttacctttagctcatggcagacattgctaatcaatgacagcacttttccttactgagcccagtgcacacatacctcccatataactcttaaggcagccactatcaatcgaccattgttggctctcaagatgaaactgatttgcaatcccatctttacagcctaaaatgatcaatataagaactaaaaggactatttcttttttgagcagggagagctgagctgtgtaggtttttatgatcatacacagcccgtgctatagggaccaatatgtaatgtggtaatcagtgagtcctccatccatccatccatccatccatccatccagaaaaaatatttatagggctagacactgattatctggagatgagttaacacagcccctgaccaagcagaactcttgataacagaaatcatatctgcttgtcaaagagattctcatcaagacaagaagaggagttcagctgaaaggaatccctggtgcatttctgtagcttctggacaggctgcaaggtgctgttctaagaagttatgcaaattgttaagtggtgtccttgaccttcaggctccactgattctcttgtagcaaaatgaaggatttacagtagtgaaatccactgatcggcattattgaggtaactgtgagcatgaatctgggcatcgctgagcataacttgcctctcaaccagttgcatgcaaggagctttgctaagaaaactacttcttccccacattacccccaaagctctgcttgcccccttctcttgcatgctccaggaaaccagaatcatggaaaagccaatgatcatggcaagtcaagttggtaactctctgtaactgagtggtagtggacagcaggcagaagcatactctacctggcttccctgctgttctgacattcaggactcaaatcctcaatgacaatgtcttttcttcctttgtggctacgccacactgtccatctcctgcctagactgtgattgttctagtgattgtcctctcaaaatagctccactccagagacagccccatcgcacatttcaagggaagggaaatgaataggcatgggctgatgtgtgctgaggtttcagtccagctgccagtttgaaagttcactgtgtgttgaggggtcaagtaagcaagccaccgtgccgatgcttagaaattcgcaagacaggtacaatataggggcactgttttccaaaaagaaagaaagaaagaaaaagactccgtatgtattctcacattcattcgctgtcattacatgcattcatgtccatttgatgaactacatttcctcaaggagacagtgcttagctctttgcggggataggcgactgacgtctcgaactattatagaatttctcatttttattggtatatcctatcaaggaacataagttctatggggattggcagtctagccaaggtgactcatttgagctggaaaaagagaaagtgaaagaggtggggtgggggtagaatatgaaattctattggctgtgctacgtgaaatagttgtttaaattttattgagtaccatgctctgaccaagagcctacaaggtttagtatccttgtccaaggatattacatacctgcttaaatttcccaagaatcagagtctgtcccagctgactttttgaaactggctttttatagagatacagagacaacattgcataggagaaaatgtccagaatgtagactctgccacacattaaccaggggaccttgagcacgtcccttaacttctcttaacttcagtttccttttctacctatgtaacctgcttcacaatacttggttgtaattacacaataacaacaaaggtaagatgggaaaaccctttgtaaacgaaagcgcaatagaaagctatgatatatgagtgttctattatacttagaatttatgtgtagccctggcaaatcctgtatgtagataggcaattatacaaatatagatttttttaataaattaatttctagtttcttcttctttctaaagaaaaaactacatttcattgcagaaaagttttacaaacagagaaacaaaagaaaaaagtaaaaacactcctaatagaaagcagtccccttttgctaaatgtttatatattatttttgttataataaaatgtatccatttcagtgaaaaaaaaaagaacctagaataatggtagcctcaaagaacaaaggtttttttttttttcttgtttatgctacaccattagtggctttcaaacaggggtgattttgccctccccgactcccaccctggaaacattttacaacgcctggaaatagttctggttgtcacactgtgaggaggttgctactagtacctagtggatagaggccaaggatgctgctaaacaccctgcagtgcacagggaagccccagcacaaagaattaacattagcttaagtgctaatagtgctgaggttagaaaactctgcttcgcatgtccctcttaggttaacaagaactttgctcaatgtcaacctcattcaaggacacagacctatgaaacttctactatgaggaacaagaaaaggagtagatggagaattgtgtaccaattcctacagaactctgcttggaagtcacacatatcatttaagcacttcttatatcaaccaaagcagtcacatcataactttagtggaggaggacataccatcagatggtgtcccctggaaggagcaccagaaatatcaatgaagatccctaatgacttaaacataaaacgttatgagacctgtcctagtggcctttgtgtgcatcctcaatccttttcttgaaaataaacccttaaggattttatttatattcccaaattgtcctgaaaatgtgtaccaattacactgctactcaccagcagcattgtggaaacgcccattttatttacttgaacacttgcataaatgtaatattattgtttctaaagctttgccaattttaaaggtaggtattatatattgagctttaaatgcagcagttttgacttcatgcattgcatttttaaagacacagacagaaaaaaaaagtcaatctgagtcattcttagcctactaactcaaattcttatggggatggtatgtgtacagtggaagcctaatgtgccttgccagatatctgaaatcctacaaactgtgtcagatttgctcagccctggttctagaaaggtaacagacagaagaaaaagaataatctgacctggctacagtgctaggtgtcaaaggaaatctcagaggcagttgcagcaagtcagaatcttgggcggttaaggcagtgagcaagtttgcttgacagttcatcactgattgctactgatatgtcaagccaagtaaaatcctttgcaagaacaagtcaataattggcagattaggtacatgattaaccggagacaacaagatgcagttaccacttgggagccctgctgggacttcaccttctccacaatcctgtttagcaaatattaaaaatgcctatttcatcactcagaccgatggagccaggaggcaacttaaaagtatacgatgggcttacagctccagcaagttgattaaaagagattctagggattgaatggcggtaagacaggagcagatgctggtaccccctaatgctttatgctgagaggtatctatgggatgggaagtaaaattatccacacattaaactcattagccaatagggaggaacagtttaagagaccacaaattgtcccatgatcataccaaataaatgcaaatatggcagattgggcatatgtggaccaagataaaatgagttgagccaacatttctatttgtccttatcagcggaattcccctaatgacattttttaaaagcagatttatagatggtgattagtggtattagtctttgccagttcaggtttattccttttcatttcagatcctcatttgaaaatgaactctgtctttccttgtccccttctttcttgcctaagtaagcaaacctgcacatggtttcaattagatgtgggactaactgtgttcctgggatgctggggtgcctggctgtttggagctccttggctctgtcatcttgccactctctctttaccctctcagtgcccattgactagtcacataggctccactgggcctcacctttcacatggagctgaaatgtggaggcaatgccagggtttggctgtcagcttgcatagcacatcaaatcgcgctttgcagaagcccctgatacgaagtttcatttcattttggaggaagccagatctttacaggcatgtttttcagaaccttcctttccaaaggagctcgagctgtagagaacgattgtgtgaaaccaagagaaccttggtttcttctgaactggactgaaagtgcttttggaaaggactttctggacagaccccttctggttagctggtggcatcctaacaggagacaggaactgaaactgccatctgagtcagtgggcaccctcctggacagctactgagcagagcaaggagaaatctcatggcatgcttgagtctggaaagagaaccggtgtgaagggtgcacaggagggcaccatggatgttttacaagaaggacaaggcttgagttcatggaactgagagagaaggcagcaacagagaaaacaggaatgagttcagacgggcagcaccaaatcacatatttagacagaggagagtcttggaggtgctgtaattcaggagtttgcaaactttctaagcaaaggacctttatcctcaagtgaaatcttatatagaaccctgtatataaaaagacgaaagtgatagttttgttaccatagagtttacagttcaaatccatgtttagtattatcatgttaatctctgtatatgtatgtttgtgtattaataaatcacatgtataaatatatatgtgtggatatatatccagagggagagagagagactaaacccatgagagtggtcacctctaggaacagtcaagaagaataggactgggaattaggttttaggagtacttacttttatcgaaaaaaacatactaaaggaaaggcaagtcccccatcccccaatctccaacatacacacacacagactggatataattccacaaaatcttaacatttattcatttgagtggttgtaatatgggtatcttttatacttctcttaatttctgtaatctctgtgtgtttgtgtgtgtgtgtgtgtgtgtgtgtaataagtgaatctgtaacaatgttgagtctattttcagtaaaacaaagagaggatacagatgacacctgtaattccaatcactttctcaagattccatttatatactttgtgtttttgtgcaattttgagaggcacgtcccttgccttagatataaaaaaaggggatttgcacccaagctttgaaactctccttatttgaaaaaaaatcaccattatgggacatattacacattcatttggaattccactcctgattttacatcctgaatcaaacatgtgcctctgctctgcctggcatttcgttgaacagtatccatcagtgcaattgcttgtatgactttatctgagcagacacacatcggcctggattcaaagaaagcctagtacagatctttaagcttcctgataaacgacagttacagaagttcaatgtatgctcagagatgttaggaaaagctttattccaagatctttgcaaaaattaatggcttctaaaatgttcattgaagcccctctcagtaaggatgctttgtagggaagctaaagttgttctgagacaacaatattcattaatcattcatccgagctcttataaaaatgtcctgcactcagagatccctctccatttaacatgatgtctaaacccacttggaataatagccagcactatctgagggccacaatgtaacagggactgattgttccatgtgcattatcttgttttatcttcacaacaccatatgagctaggtagcattagtggcagtccccttttacagatggaagaactgagacagaggttatgggctcaaagctgggatgtgcatctagcagccagacaccttcatcttctttctctctggtgctcagtcatttctaggagcatctacagtacaacgtaaacacaatagtttacggagtaaaattacacctgctgccaaaaacaggaattttatcaagtcaaggagaatggtggtggggatcttcttgaacgtgtcagaggaaagccttggtaaatatggatctggctgagggtagcacagttaaacacggaggcagagaaaattaacaaagaaggtgataagatcggcacatcaaagagggtgattataaaaaacgtaaagagagatcctgggaaatttgatgaagatatcccatctgcttacagaaatgctctttttgattatgttgcacttgtcaaactaagtgatgctgcactgtcctgtgtgtttcattgattctaagatgcataaaatgctcctcttttgacatctctaaaaacagcatgtgttttgctatcgatgaagctgatagaacgaaatgtgtgcttacatgtttttgtgtacgtatgaaaattcagtgttcattctcacaactagagcatagttgcaaatataacctgaatttccctaaatatgatataaaataaactttttggcagggtttccttttccaagataaagttctaatcaaacatttttccattcgttaagtgtattcattataagtggcctcttacgaattccagtgattcccagataactagatcctaccatataaatcaagtcagtgtggggttgaattataatttttaaaatatctaaatacttatttagaaagtaaactttaggccagctgtggtggcacatgcctataatcctggcacttgggaaatcaaggcaggaggaacacttgagcccaggatatcaagaccgccctggacagcaaagtgagacttcatctctaccaaaaaaaaaaaaaaaaattaattatccatgtatggtggtatctgcccatagtcccagctacttgggaggctgagatgggaggattgcttgagcccaggaggtcaaggctgcagtgtgccctgattgtgccactccagcctgggcaaaagagtgagatcctgtcagaaagaaagaaagagagagagagagagagagagagagaaaaaaagaaagaagaaaaagaaaaagagaggaaggaaggaaggacgggagggaagaaagaaaggaagaagagaaaagaaaaagaaaaagaaaccactgtggaagtgctgctgttacagaaagaaggaaaggaaaggaaaggaagggaaagggaaagggaaaggaaaagagaaagagaaagaaactgctgtggaactgctgttgttccagacaggaacagctggagagcctgggcagaaggagtgtagaccagtccaaactatctgactctgaactccagcctccaatacttccaagctgtatgaccttgggcaagtcattcagcctttctgtgcctcagttacctcatctataaaccagaggtgatattatgtgctcagagcaatcaatattggatgtaaatgaaataatctttataaagcacttagattcatgctggcacatagaaatggtgtaagctattattattatggtttcaaagcattcatgacacacaaccccaaacaaacaaaacagatttcaatttttttaaagataacttttatttttgtttttctcattataaagtaagacatggtgatgataggaaaaacagaaaacattaacattttttagtatattttccagactgttttctgttcacatatagtcatcatttttataaacacaggatcataccacacacaaactatttttaccctgagtctttgcttaataatagatggaggacatctttccaagtctgaatatttttctataaactcattttaaatgcctcaaaatagtccattgtcttgaataaaatttttttcaagcaatcctcctttttcaatatgataaatcattctacagtaaacattctttcaggtctatgttcttatattttttaataatttccttgtgatgaattcttggagtggaattgccagctcaaaggatttacaatacatcaaggtgttataataacaataataaccatgagagcagctcacattaattgagtgcttactatgagccgagccgaactcacagtgcccctcaggggtggggacttttattattcccactttgggtatgagagagcagaactcagagctgaaaacttgtgcaaagttacattccagcctggtgaaaggtgcagctcatgcttcaagagaagctgcgcagtgcctgtgtttctgttcctcgttagggcttgggaagtcattttgtgactggacacacccccagtttgctccctcttcttggtgatatgtttgatatattttcacagccagcccacattgggccctcctattgatcttgggaggacaaggagccaaatgtgacatttgataaaccattgctaaagacaattagatgggaatgtgcagtaaataagaaatcacatcagcaaggcactgagaggtaaaacattcattcttctggccctatggtgcagcctttgtgcaccttggaatagccttgaaatgctcatcaatttcgctgaccttgaccccaaggctctgtgaggtcaacattatggctcgcttggtcttcagagcaataccttctacccttctcttgggttggatcaaaaggcagcatgatgagggcatgacctcgtgagaagatgaaatataaaatcaatccattcatgccctcaacaaatactcattgaatgtctgtactggggatacagtgattaaaagcatcggctctgcctttaaggagatggagacctgacaagttaagaaatgatggcaacatcaagtagggagggtcgtgagatgcagtccagagtggaggataagagctgacactctacgatcatcctggtctgggtttgaatcttatctctcctatgaagtgtttccggatgagtctctagatttagtttcaacatccagaaaatgaggactatacctcatcaggctgttgtaagaataaatgagataatgcccaggaaatggtaagcaccccatggagatgaatcaatcaatctaactggcctacaacacttatagcgcactctcaggtagcctagcaacaaggcggctctgcagggggaacagcaaggatgctggccgacaccaatactgatatgcaaactgcgcttcagctggttgtcgagactctagtatagactgcagagctcagagtcttcctcctcagtcaagtgattcctgtctcctccccatccttctatgaatatgagaggtagcagaggtttggggtgcctctccaggggacacagtgcacactgcatctacctgtgtgcagcccaagcacagctcttcatgggatgggagatttggaataacatttaccctgctagcactatgctcttgtatgtttcctggagccactaccgtatgtcatttacatgatctgttcctgtccctcacataacatgttcaacaaatatcagctattgttattactagagggttggatacaggaggcttgggagcataaaagttggccaccacttttaacctgtgagggattttagggcagcctcctggaggagaggctacacaaggtgaatctttgagggtgagttaagcaggcaaggagaaagacaagagagggcctttctaagcagagggcaaaccaagacatgccttgttgtgtgggctgtgttgaagcttcatttaacaattgaccgaaactctgctttgctttagtcactcttcgctaatggggacataccttttccttttagaacacgctccgacagagcaagagtgacctaggggggcagcccctctggaagtttaatggctgtccctgtgttgagttgttgcatatttgcagctgtgtacacaactccagctaggaacacatgttacataaaagccctcaagctatgggttacccttctaactgggaatgcacactttcacgtacctggggaaaatcttgttgaaaataacagatcgagacttacggtttctaactgtttcccctgttctcagaaatttcatgtgagaagggtcaacattccctgaaggagaccctgtgttcagacagatgcacattctgccagaggcaggccatcacgttgtattcagccaacatttactgagcacctatatgcgacatgccaaggggctgcagccagggacagggcagagctagccctgccctcatgtggctagtggacactagcaccaatgcctgtcctggaatttccagggaactcgttcacctatcaggaaatgaattgtctctgcctttgtttggcccagcctcgttactgtttctgttgggaatcccattctgaaacagctctgagaagggctgctggaatgtgccaaatattcatagtgatcatattaccttatccttccgttgagacactttacccttttctattcatttttcatttcccctacatcacccccctcccataccagagacattcaaaatatactcctttggaacttgaaaaccacaattttaggcttgatatatggagggaggaaatttggcagaacccataatctgcttatcttcaaccagcaaaccaccaaagcccctgccaaccccagagggccttcataggaaccaggaaacacaccaggcaagatgctttcctattatgacaaaaacaggctctggtctcatcttttcagcctctgaaaccctccactggcctcccgtcatgcaaagggaaaaatctgaagttgttctagaatatcagctccagaaggacagcagctgttctattctctgctgtgtctccatcactcacagctttggccgtccaccgtaggtgttcagtaaacagctgacagaagatcatctctgtggctggccagtccctctgcagtctggttaaccaccagtctcctcctcactccctggactccaccacatcagctcacttgctctccctcagccctgtcaagctcattctgcctccgaacattttgcaccggatgtcttctcttcctggaatcatcccccagatatttcaggtggctccccctgacgtttttactcctcatgcctccataagccctttcctgacaagcgaatctacaacagaatcctccttcatgctttatgctttatttttcttaaatcaacttaatttaggtataatgttaaaactacccaatgtacacttttaaaaatttatttcaacagattttggctaacaggtggtgtttggttccgtgaataagttctttagtggtgatttctgagattttggtgcacccatcacccaagcagtgtacactgtacccaatgtgtagtttttttatccctcaccccgcttccaccctttcccctgaggccccaaagtccattgtatcattcttatgcctttgtgtcctcaaagctcagctcccacttatgagtgagaacatacaatgtttggttttccattcctgagttacttcacttagaataatggtctccatttccattcaggttgctgtgaatgtcgttatttcattccttttaatgtctgagtagtattccatggtatatatataccacattttctttatccacttgttgattgatggggatttgggctggttccatatttttgcaattgctaattgtgctgctaaaacatgcaccaatgcacacattttctaagtgtccacttggatccctaaaatctgaaaactgtatccacctcagtaagcaccaccacagccataatagaggacaatgccaccacccaacagatcccctgtgccccacaccaacctcacctccaggcccaagcaaccactgatctgctttctgtcactggagattagatttgtctccactagagtttcatatgcaaggaatcacgtgctcttgtgtctgccttctttcactcgcagaatgtcagtgagattcacccatggtgttgtttgtatctgtattagtctgttctcatgctgctaataaagacatactcgagactgggtaatttataaaggaaaggaggtttaatggactcatagttccacatggctggggaggcctcacaatcatggcagaagccaaaggagaagtaaaggcacatctacatggtggcggcaggcaagagagcatttgcaagggaacttccctttataaaaccatcagatctcaggtgacctattcactatcatgagaacagcacaggaaagacccacccccatgattcaaatacctcccaccgtctccctcccacgacacatgggaattatgggagctacaattcaagatgagatttgggtgaggacacagccaaaccatatcagtttctgtggcttattccttttattagtgagtagattttcaattgtatgtatattccacaatgcgtgtgaccattcacctgttgatggacatttgggttgtctggtttgctttatttttattttattttattttattttattttattttattttattttattttattttattttattttatttttgagacagagtctcaatctgtcacccaggctggaatgcagtggtgtgatctcggctcactgcaacctctgcctcccaggttcaagcaattctcctgcctcagcctcctgcatagctgggactacaggtgcaccccaccacacccgactaattttggtatttttagcagagacggggtttcacaatgttggccaggctggtctcgaactcctgacctcgtaatccacccacctcggcttcccaaagtgctgggattaccggcgtgagccactacacctggctggtttgctttattttttactcacagctctcctccctccctgacattatattcccccttgaaaatgtcagctccaggaggacaggaaccttgtctgtatcattcactgctgtatccccagtacacagagcagtgccaggcacatggtggttgctcaatatttgttgaaggaacaaatagttttacattcatttgcccttgcaacataacaagcttgagagccatgcttcagatttttctatgaactccaatttagggacccttaggccttctaagtgaaaccagatgttggctggggctcccctgcccatcagagactgggctgaggttgactgtaccctgtggtcctgtgaatacacacacacgtgcaaatgagagaggcgggccagcaccccctactggctgcctgttcattaggcttattgagaagactaatacactggattaagagtgtcctctttgaagctggctgcttgggtgtgaatctcagccccaccacttactaactgttgggtgagctatgtaacctctctgtgtctcagtttcctcatatgcaaaacaggaataatttgtattcagtagggttattatgagcatgaatcacttagagcgtgcctggcctcattaaatgttaactcatagtagcatctgagcagttagcaagcaaaaataagagaaaactacagtgttcactaaaatttccaaaaggcatttcctgaagagattatgtcctttaagtagctgtgtcaccttgtaggtatacccctcactctagatattatttccttttggcctaaatctttttcattcatgcaataaagatctttagtgagtacccactatgggccaagcactgttctaggcatgggggatgctgagttcagtgaaacagacaagtctcccactctttttttttttaattatactttaaattctagggtacatgtgcacaaagtgcaggtttgttacataagtatacatgtgccatgttggtgtgctgcacccattaactagtcatttacattaggtatctctcctaatgctatccctccctgctacccccaccccatgacaggccccggtatgtgatgttccccaccctgtgtccaagtgttctcattgttcaattcccatctatgagtgagaacatatggtgtttggttttctgtccttgcgatagtttgctcagaatgatggtttccagcttcatccatgtccctacaaaggacatgaactcatcattttttatggctgcatagtattccatggtgtatatgtgccatattttcttaaaccagtctatcattgatggacatttggcttggttgcaagtctttgctattgtgaatagtgctgcagtagtcatacatgtgcatgtgtctttatagcagcatgatttataatcctttgggtatatacccagtaacaggatggctggcacaaatggtatttctagttctagatccttgaggaattgccacactgtcttccacaatggttgaactagtttacgctcccacaaacagcgtaaaaatgttcctatttctccacagcctctccagcacccgttgtttcctgattttttaatgatcgccattctaactggtatgagatggtatctcattgtggttttgatttgcatttctctgatggccagtgatgatgagcattttttcatgtgtctgttggctgcataaatgtcttcttttgagaagtgtctgttcatatcctttgcccactttttgatggggttgtttgatttttttcttgtacatttgtttaagttccttgtagattctggatattagccctttttcagatgggtagactgtaaaaattttctcccattctgtaggttgccagttcactctgatggtagtttcttttgctgtgcagaagctctttaatttaattagatcccatttgtcaattttggcttttgttgccattgtttttggtgtttcagtcgtgaagcccttgcccatgcctatggcctgaatggtattgcctaggttttcttctagggtttttatggttttaggtctaatatttaagtctttaatccattttgaattaatttttttataaggtgtaaggaagggatccagtttcagctttctacttatggctagccagttttcccagcaccatttattaaatagggaatcctttccccatttcttgtttttgtcaggtttgtcaaagatcagatggttgtagatgtgtggtattatttctgagggctctattctgttccattgatctatatctctgttttggtaccagtaccatgctgttttgattactgtagccttgtagtatagtttgaagtcaggtagcatgatgcctccagttttgttcttttggtttaggattgtcttggcaatgtgggctcttttttggttccatatgaactttaaagtagttttttccaattctatgaggaaagtcattggtagcttgatgggaatggcattgaatctataaattaccttcagcagtatggccattttcacaatattgattcttcctatccatgagcatggaatgttcttccatttgtttgtgtcctcttttattttgttgagcagtggtttgtagttctccttgaagaggtccttcacatcccttgtaagttggattcctaggtattttattctctttgaagcaattgtgaatgggagttcactcatgatttggctctctgtttgtctgttattggtgtataggaattcttgtgatttttgcacattgattttgtatcctgagactttgctgaagttgcttatcagcttaaggagattttgggctgagacaatggggttttctaaatatacaatcatgtcatctgcaaacagggacaatttgacttcctcttttcctaattgaatgccctttatttccttctcctgcctgattgccctggccagaacttccaacactatgttgaataggagtggtgagagagggcatccctgtcgtgtgccagttttcagaggaatgcttccagtttttgcccattcagtatgatattggctgtgggtttgtcataaatagctcttattattttgagatacatcccatcaatacctagtttattgagagtttttagcatgaagggctgttgaattttgtcaaaggccttttctgcatctattgagataatcatgtggtttttgtctttggttctgtttatgtgatggattgcatttattgatttgcatatgttgaaccagccttgcatcccagggatgaagcccacttgatcatagtggataagctttttgatgtgctgctggattcggtttgccagtattttattgaggatttttgtatcagtgttcatcagggatgttggtctaaaattctctttttttgttgtgtctctgccaggctttggtatcaggatgatcctggccccataaaatgagttagggaggattccctctttttctattaattggaatagtttcagaaggaatggcaccagctcctctttgtacctctgttagaatttggctgtgaatctatctggtcctagactttttttggttggtaagctattaattattgcctcaatttcagagcctgttattgttctattcagggaatcaacttcttcctggtttagtcttgggagggtgtgtgtgtcgaggaatttatccatttcttctagattttctagtttatttgcgtagaggtgtttatagtattctctgatggtagtttgtatttctgtgggatcgatggtgatatcccctttatcattttgtattgcatctatttgattcttctctcttttcttctttattagtcttgctagtggtctatcaattttgttgatcttttcaaaaaaccagctcctggattcactgattttttgaaggattttttgtgtgtctatctccttcagttctgctctgatcttagttatttcttgcctcctgctagcttttgaatgtgtttgctcttgcttctctagttcttttaattgtgatgttagggcgtcaattttagatttttcctgctttctcttgtgggcatttagtgctataaatttccctctacacacggttttaagtgtgtcccagagattctggtatgttgtgtctttgttctcgttggtttcaaagaacatctttatttctgccttcatttcgttatgtacccagtagtcattcaggagcaggttgttcagtttccatgtagttgagcgattctgagtgagtttcttaatcctgaattctagtttgattgcactgtggtctgagaaatagtttgttatcatttctgttcttttacatttgctgaggagtgctttaattccaactatgcggtcaattttggaataagtgtgatgtgatgctgagaagaatgtatattttgttgatttgggatggagagttctgtagatgtctattaggtctacttggtgcagagctgagttcaattcctggatatccttgttaactttctgtcttgttgatccgtctaatgttgacagtggggtgttaaagtctcccattattattgtgtgggagtctaagtctctttgtaggtccctaagcacttgcattatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgctatttttttgttttccattttcttggtagatcttcctccctccctttattttgagcctgtgtgtgtctctgcatgtgggatgggtctcctgaatacagcacactgatgggtcttgactctatccaattagccagtctgtgtcttttaattggagcatttagcccatttacatttaagtttaatattgttatgtgtgaatttgatcctgtcattatgatgttaggtggttattttgctcattaattgatgtgatttcttcctagcatcgatggtgtttacaatttggcatgtttttgcagtggcttgtactggttgttcctttccatgtttagtgcttccttcaggagctcttgtaaggcaggcctggtggtgacaaaatctctcagcatttgcttgtctgtaaaggattttatttcttcttcacttatgaagcttagtttggctggatatgaaattctgggttgaaaattcttttctttaagaatgttgaatattggcccccactctcttctggcttgtagagtttctgccgagagatccactgttagtctgatgggcttctctttgtgggtaaccagacctttctctctggctgcccttaatattttttctttcatttcaactttggtgaatctgacaattatgtgtcttggagttgctcttctggaggagtatctttgtggcattctcttcatttcctgaatttgaatgttggcctgccttgctaggttgggaaagttctcctggataatatcctgcagagtgttttccaacttggttccattctgcctgtcactttcaggcacaccaatcagacgtagatttggtcttttcacatagtcccatatttcttggaggctttgtttgtttctttttactcttttttctctaaacttctcttctcgcttcatttcattcatttgatcttaaatcactgatactcttttttccacttgatcgaatcagctactgaagcttgtgcatgcgtcacgtagttctcgtgccatggtttcagctccatcaggttatttaaggtcttctctatgctgtttattctagttagccattcgtctaatcttttttcaaggtttttagcttctttgcgatgggttcgaacatcctcctttaggtctgagaagtttgttattaccgatcatctgaagccttcttctctcaacccgtcaaagccattctccgtccagctttgttgcgttgctggcaaggagctgcgttcctttggagaagaagtggcactctgatttttagaattttcagcttttctgttctggtttctccccatctttgtggtttttggtctttgatgatggtgacatgcagatggggttttggtgtggatgtcctttctgtttgttagttttccttctttctgtttgttagttttccctctaacagtcaggaccctcagctgcaggtctgttggagtttgctggagatccactccagaccctgtttgcctgggtatcaccagcggaggctgcagaacagcaaatattgaagaacaacaaatgttgctgcctgatccttcctctggaagcttcgtctcagatgggcatctggctgtatgaggtgtcagtcggcccctactgggaggtgtctcccagttagtctactagggggtcagggacccacttgaggaggcagtctgtctgttctcagatctcaaactccatgctgggagaagcactactctcttcatagctgtcagacagggatgtttaagtctgcagaagtttctactgccttttgttcagctatgccctgcccccgaggtggagtctacagaggcaggaaggcctccttgagctgcagtgggctccacccagttcgagcttcccggccactttgtttacctgctcaagcctcagcaatggtggatgcccctcccccagcctcgctgccaccttgctgttggatatcagactgctgtgccagcaataaccgaggatccgttggtgtgggaccctctgagccatgtgcaggatataatctcctggtgtgccgtttgctaagaccattggaaaagcgcagtattagggtgggagtgtcctgattttccaggtaccatctgtcatggcttcccttggctaggaaagggaattccctgaccccttgcacttcccagatgaggtgatgcccaccctgctttggcgtacactctgtgggctgcacccactgtctgacaagccccagtgagatgaacccggtacctcagttggaaatgcagaaatcacccgtcttctgcaatgctcacactgggagctgtagactggagctcttcctatttggccatcttggaactccagtgacaagtctcccactcttaagtgttggagaaagttcatatccaaaagggggaagattaattctaaattagtaaatcagtagcaagtttttttttcaaagaatcatgagtttttgctgaggttggaaacaagaagaagtaatagacgttttttaaaaaaataatttcagctttttttttagactcagaggtacatgagcaagtttgttacctgggtatgttgcatgatgctaaggtttggtctacaaatgaccccatctctcaggtagtgagcctagcacccagtggttaaccaacagtaaaaatcccagtagttttttaacccttgccccctccctctccgccctctctaatagtccccagtgtctattgttccatctttatttccgtgcatacccaatgcttagctcccacttataagtgagaacatgtagtgtttggtcttctgttcctatatttatttccttagaatgatggcctccagctacatccatattgctgaaaaaaatatgatttcattctttatgactgcatagtattccgtggtgtatatgtaccacattttctttttccactcttggtaggcacctaggttgatcccatctttactattgtgaatagtgctgcaatgaacatatgagtgcatgtgtcattttggtagaaggatttgttttcttttggatatatatccagtaacaggattactgagttgaatggtagttctgttttaagttacttgagaaatttccaaactgttttccacagtggctgaattaattcacattcccatcaacagtgtgtaagtgttcacttttcttcacagccatgccagcatgttgtttttgactttttaatggtagacattttgacttgtgtgagatagtatctcattgtggttttgatttacattttgatagaggtatttcagttgggtagtcagggaagccctctcttaggtcatgatatttatgcaaaggcaggattaacaagaagcaagcagctgtgagatcaggagaaagaataggccaggcagagggaaaggctggtgcaaaggccctatggctgggatgagcttggcatcttccaggaacagagagaagagcagtatggctggaaaacatacaggtagagtggcgtttagggaattgggaaggggccagctcccaaagccacttacagaccaagtacagccaacacccagcaaagccatccagacctttccaggcacccttttttctctgccccagtgtgatgtctccctgtcctcaggccagcctgctctgcccaggtctgaccctagcactgctaagttcttccttcctccttcttatccgctcagtggcattgtgaggggccttaacaaaccaggccagccaccagatatgctggcagctacaactaggttcttggaaaagatggatgtgtcccccaaaattgttaaaactcatgcaaatccaacttcaaatccttgcttggccaccaaccaagctcaatggcactggatccattccttaacttctctagaaaccactgttctcttctgagatgagactagggttttggggaggatgaaatgtgataacacacatcagcatttgctattatgcctggcatgtagcaagtgcccaggcaaaaataggctcttattttttattacttttgctgctgctgcaagaggacatgtaatgaaagaatcaagaattccacccttgtaagataaattctccccagctgctgatttcagggaaccctgtttgtttcctctgtagcttccatctgcttgattcttgcctgtggagcctggcatgatgagctgctacagtctggaaatgcagatgctgtttcctgtccggaagctcaggggctggttcttatagtggcccgagcagtggtgcctgcagctgggccgattgcatttagttaagtgactcagatactgtaagtaggaactgagcagggagtcctgaaaaagacaggcaaggccacactcagggaagccagcccccactggagctgtcattcctcccccttccctgagcactcagcccctttgaaggagagcaaagaaattgtgctgagctttaatgaggaatcagctgggcgcactttgccacaggcctggctggaggcagaaagaaatgaacaggcccccaggagtgagcgacccactgcagctaagtcattcccaccatctctggatgtgaccagagaccctgtggtcatgtggcttcaagcagccctagctcacatgtgccacttccctgcaatcccaccaactgctgagcgtgccctgccatctgaggtagaatcaacatcagacatcgtcaggaggccagcaatgctgccagtgcagagtgaggggagtggcaggcttccccgggaaatgtcagcatttattgcttttcccattcgtgttgaccctcagcaagaaaatgttccaaatagcatgaagtcatcccccctttttggggggtcctggacccagtaataacatcttcccgaagggcaatgagtctgtctttaaccttgccctctctggcaggtgtgtatcaatgtggtttctagaagcatctctgggctgcccggtccctgcctgtggccaccttcccttctgggaaagtaacagcccccgctccacggtctaggctctgctgctctcctcccgctcctctggaaacccactaagttatcttaattaccattcctcctcagtctctgccaagaagtggggagatttataattggatcagtcaaatatttgctatggtttatttctttgcctctcgagctctcgtaaaagttgcattttcatgccactttggggtatgactgatgactcaaaggcacagccttcacattgcatgccaacgtgggttatttttcagaggccagggaaaaggagagaactgggcggggagaggtggtgtttactttgggttattgtgctatcatcctctgggtggctgcaagagacacaagcggctttgggaggcaaacttcctcccgcagccagccggtgcacagacacatccttctattgggatttggtcatgtgcctcctaaaccccttccagagcttctgcagacctaatgggtaggaccactacagagtaacctctttagtcaacgaggcacagtttggtctcccaaagcatccccatgtcccgaattgatcacagtgaggtcctagaacagaggagccagatgtccccaatactaagcctgagttatcaattcccagtgttgagggatgaaaaggaaactctggccagggcctgagcttttggaaaatgctctccttctagtgtcagccagtctgccaagcaagctggccaggctacagcttaggaaccctagagagcagaggctcccctacaccagatggcctccttgcaagccagcttctcactggcccccagtctccctatcctggaaggcagtctccatggctggctcagtttatcctccctgcatttctagcctctagcccttgcccaagttatagcagcagtgaatgatgctgtgtgatgctgcttgacacgtgttaatctatgcatagtgaccctatgtgcactctagagcactttgagatagaaaggaggaacaagaggtataaactgggacactcctgggtaattgtgataaacaaacaccctacacataatagagtggaatttgaccaacagaagatgctaccatcttttcctgggtgatcctgtcctgttgtcctataagaaattatcttgaccgggcacggtggctcacgcctatagttccagcacttcaggaggccaaggcgggcggatcacgaggtcaggagttcgagaccagtctggccaacatagtgaaatcccatctctgctaaagatacaaaaaattacccgggtgtggtagcaggtgcctgtaatcccagctactcgggaggctgaggctggagaattgcttgaacccgagaggtggaggtttcagtgagccaagatcaagccattgcattccagcctgggtgacagagcgagactccatctcaaaaaaaaaaaaaagaaagaaagaaatgatcttgaggaccatttggcctgacctgggaaggaagaagggcagtagttctgaagtccttactcttcaccaccctaccctgcagatgaaacccctgtcttcctggagtttatgttcttagtagaaagacaacacacataaaaataaattatatcattttagggggtaataagtgctttgaagataataaagcacaataaagggctacaggattgagacacatcagacaccatatcatatcagagtcaagatcttctcccagagcccctggctagccgattcttccttaaatgaaaactgccctctgtgcttctgtgcagggggactctgaggagccagccaaaatagatgtcttctctttcccctgaaaaatgcctcttcttagagtaatttactgggctggacggtgagcactgccactagtcctaagccatttctgtttcccttggctggtcaggcggttcggcaagagatgactgatgcccaaattagtaatgagcaatggccccacacaagtaatcaccttccccaaactcttcctcatggggatgattacttggacccgaaatgaagtagatccttctcacctcggcaccaaggaagttacagccattcctctggctgacagcaatttgtagacatgggtctttgcagttggacattttcgaggttgctaaggaacaaatgctttgattagaaaggtctccaaaagcagcatcagtttgtcatatcactttaaatcatttattttatcccacaaagacagctgtgaccaatgggatatggggtagagagaagctaaacactcatttccttgagaaatggagaaaatttcaacttctaagcagcggccgtcaccagcgccccacgtgtgaaactagaaccacgcactgctcgtccgtaatcattatgatttgcaagtaggtgactcatagtccctaggtacttaataaaatggttgttatcttcctggccctgccctaagcattatctcatgtcatccttataacctccctgaatgttaggtgtgattattccctggtatgaaaaccaagaagaaggtaaaagtagatttgcccaacatcaaagaacagtaagtgacagagtcagaattcaaacccaggtttgtctgatggcaaagcctttgtgtttaagattatagagtcttttgttttcagtgatcacatttcaggtggaaaaactagcgattctgacgacgggaaaggcacattaggagattcctggagtttcattctgtgaagttcgtaaaaggggttatagttgatgtctgtaacccataaaaacctttttatggaagggaaagtggagagattgcttaatcctacagtggtggttttcatcggctaaaacctacactttgaatgttctctggaagtcagcatgcaagtgacttttctatgcagtgattttgcaagagttcacaagattagtccagttctactggggttttatcgattttcttgtcaacaagtaagaaacactggtgtcctctttgccttctccttcatcatctctgtccagcccatggtcaagccctgtcacctcttccttagaaatgttcctccaaagttgtcccccgcttctcattcactgtcctgatcaaacccttttcacctcacccctgggtttctgcaatcacttcctaattggtcctcctactttcattttttctccctttagaatatctcatatccttcctacaaactaattccttaaaacatccctttcatcacatcagtcactgctcaagagtcttcaatagctcccacttgcctgctacagcatttcatctattatttagaacaggcctctcttgggtcccgtttgacctccccatccccttatcctggtaggcttagttgaccactctgtctctcattaatcacttccatttctgaacctggtttccactgaaacaaagttaaactttaattgctggtttatccaaggctaggcactataagggcatgaacataaacaccaagccaatctatgtctaaatttttgcttggccacttaggagctgtgtgactttagaaaagttgcttgacttctctgagcctcagctttcttatctgtaaaatatgaatgtaaataacaccaagataggtaccaaatcagggtttcttcaagaattgaataaaatgataataacgatcatgacggctaacatgtattttgtgtttgctgggtgccaggcactgtctaaatattatctgaatcctcacaacaaccccataacatagatactcttattttcagtttgccaatgggaaaaccaaggcacagacaggagaagctagtaagcacctcattcaggattttctcaggctccatagccctcatcatagcccttctgctgtgccatttctcctagtaaatgatcaataaaatggtagctggtaacatgggttcataattccttatctgaaactctcaggaaaccaattacattttggaattcagaatttggaggattatggaaaagttatactttgcatatcctctgtattacataatgcagagggggactggagcaacagcatataccactccccccaccacacacacacacacacacacacacacacacacacacacacacacgatgcacacatacaaacaaaaagaaaaaaactttgggttaaagctctttggatttcaggataacagacaagagattgtggcctagagtaataaaagtattaatagtagcaataattataaagcataataaataatgactgttattattgttacacattttgcggctcttgttttcctggataagttcatagcaaaatgtgctacaaaaaaggtctttctccattaacaaatgggttcggggggaaggtaccaggtatgggaccacatccacaccttgtctcatgcatggtactctctctccttttcccagtatgacttcatggaacgtctggacgggaaggagaagtggagtgtggttgagtctcccagggaacgccggagcatacagaccttggttcagaatgaagccgtgtttgtgcagtacctggatgtgggcctgtggcatctggccttctacaatgatggaaaagacaaagagatggtttccttcaatactgttgtcctaggtaggtgtggggtctctgagatggtacgccatgaagggaagatggaaatgttctgggcttctctgcagaagacacatcttctaaggtagtttctactacagatgacaaccaaccaggatcctttgtttaggccttatagtgtcacccacctgaaactagctctgattaaatggaaatgctgcttaaaccatgaaaaattcaccaaggatgaaattgaggttaagagtttgggtcagactgcctgggttgagtcctgaccacactacctaagcaaatcacttgactttgataagcctcagtttcctcatagtaaaataggaactaacgtgaatgcccacctcatagggccattgtggggattaaataaaacaaatatataaatctctaagcatatagtagagaaactactggcgattcacatcagctcagaatttttcttaaaaattaagggaacctcaaaatactaataaaaagtgatttttaaaaaaactttaaatcagagaaattatatagacatttaaaaatcatgtttttattcttgagtaggtaaatctcaaagtgttttaattaagtacttatcattttggcatagggtagccctgctttctattagctatcaagagaaaagcgaagtttcaaccaaaatgtccttatacatgcaatacaaagctctaaaagggtcattcacttgaggaagatttcataaagtttttctaccacaaaccttaagtatgttaacaagcaaagaagctgcagatattttcattaaagttatgttattgggatttttaatcttctcctgacaataataattgatcctgggtagaacctctgtgaatcagggaagattattagacccatttcacagaagaataaattgagattcagaaagctgaatctctcgaagacccaggttgtggaaacagtggaaatggcatgggcttctgggtcttgtccactgcccttgtacaacaccatgtgtcccaaaaacttttagctgtagatctcaagattcactggggaagcccccacagggtggcttcttgaagaaagacctggtagctccagcattaaatccaagattttcttccccacatcttaactgggcaattcacttatctctctgagcctcagtttcatcagctgtgaaaaggtaatgaccacgtccaggaagtagagggtgatgtgagtatcatgacaaataaaacgtgtgtggcatgtgttggtggtcactaagtgacatccgattattttttttccttaggaatatgtctagtatcgctctttttctattgattacattttaagaacttttctattggtcccatggattttcctgaggggctccctgactcttcaaagagctatgtaatccaacctgaaattcaggtggcaattcttcatcagtggccacaacttcagaaaggtgtaaaatcatatagagttttggtactgaccatgggattcaagtcaatccttattccttctgctaagcaaagactgaccctatcaaagctggccaaatggtccaaagcaggagttggctccactgtagcccatgggcctaatctggcccactgcctgtttttatgaataaagttttattggagcagccccatacatctgtttacatattgtctatggcagctttcccactgtcatggcagagttgagtcattgcagcagagaccatatggcccacaaagcctaaatccttactctctgtccctttacagacaaagtttgccaacccctactctaaagtcatgtcataaactttgtataatgaaagtcagtggagaagcgttccacagagggaaaatacccagaattaggttaggtaccaacggggaagaaaagtaatagggtagagactagctcacaaaaggaaaaaactagaaacaaatttggaaccagcttgagatgttgagatttttaaaaatctttagtttaagaacatgatgagaaacgacttcctttgtgtcactctgtgtttgaactcaagaggcttgacacgtacgtgacagcacacaccctgcacagcagctggctcagctggggtctacaagaattcagagaagtggttcataacaacaagaacagctatgcatttatagagcatcaacggtatgctagccccagtattatgccttcgtgtctgttgcttcctcaacccatggagtagccacatgaggtagcactatcacaattctctgcattttccaactgaggaagccaagactaaatgcagttaaaaaacttgcccaaggtcacacacagccaggaaaaggtgaaatcaggattcatactttccagagcctgtgcttttaaccactggatttctttggattctagccaactaaatccttttccctctaaacttagcaccttttctggggttcggattatttcccaacaacttctgtcctccttttcctttatccacatggacacaggcattgtggtagtgaaattcccttcccccaggccatcactcaccctggcctgttggagctgggaatagcaattctcccaagaggatctctcttgtctggactgtagctcaaagagcaagtcaaaggtaattggcctaatagttgggcagacatcttgatggagcaatgatagtaattggcctgaaatgcagggaaaagaacagtgttttatttggttcagaggttctcccacacattcctatcatcagaacattctccatcaagagcagccaggagtgctgtaaacccccgtgatgtgaaacagaaggaaaatgttagacaggtgcctaccagcgatcacactaaatatatctttgactcagggaagtcttttgatgtgttttggagagaagcagcctgctttcagaaacaagtttcttctcgagacaacagagcagctttctggaagcacgatgccagcctccacttggataaaatcccatttcctgggcttgatctcacatctggaggccacttcttcctcaagaaaatgtaaacaaaaaggaaaactgataatatcttaaaaataatatttaactgagtgctggagaaaggggattgaaatgtgagctcctttatattttagctttgccacgtcattgtttttccctcagaaactgtgaaaatactttaaatatgagttgttgggaaagttaaatgaaaaatactctttattataatttttgtttattttggattctcctaccctcccacacatgcacacacacagacacacatacacatagacatacacatacacacaggcacacacacacataagcacacttcagcaactatttaccaaggacctattgtataccaagcattgagaatacctcgatgaacagttcagatcgagagcttggtgagagaagatagatgtatataagaattacaggagcaaagaggaagtggtacaaagcccagattgaggaaagtgaggaaaacacccaggagctgagacacaatggtaaatacctcaagtgaagccctccagccaagcaaagagactgtgcaaagatctcgggccttttccatgggactgtggtggcaaagagcttcctggacctttgctgcttgatcgccaaagatgtaagttttgagaacagggagccttgacctcaagaatgtcaatttccaccaaaccatccccagacccagatgctcagtgagaagcaatctctacctagctgtaggaatgacttcaaaaaatgcaagctggagaatgatgttcctctgtttaaatgtttcatttgtacccagaagttccagaatagaacccaagtcatccacatgttctacagcaggggtcctcaaccctagggccgcagatcagtattcaccataatgtcaaatcagtggaagccctcagcttgttttcctgcaactagatgatcccatctgggggtcatgggggacagtaatagatcatcaggcattagattctcataaggagcatgcaacccagatccctccatgtgcagatcacaatgaggtctgtggcccattaggaactgggccgcagagcaagagatgagcagtaggtgagcaagtgaagctttatctttatttacagttgctcttcattgcttgcattactgactgagctccgccccctgtcagatcagcagcagcattagattatcataggagggcaaaccctattgtgaactgtgcatgcgagggatctaggttgtatgctccttgtgagaatctaacgcctgatgatctgtcactgtctcccatcacccctagatgggaccatctagttgcagaaaaacaagctcagggcgcccactgatttgacattatggtgagttgtatagttatttcattatatgttacaatgtaataataatagaaataaaatgcacagtaaatgtgtgtgcttgaatcattccgaaaccatccccaagccccagtctgtagaacaattgtcttccatggaaccagtccctggtggcaaaaaggttggggaccgctggtctacatgtccctggatgatccatctctctgcctggatctctccaaactcaactaatgtcacaccctcccttgtttgctaccctgcatccacattggattcagttcctctctttcccaccccagagcctttgcataagctattcctctgacctggaatacccttccctcagctctttgcttgctggtttcagcttatccttcagagtcacctgcatagagtagagaggccctccctgaacattctctttaagtagcttcctttcgttactccatctcagtatcttattctgttcaaagcacttattgtaatttttgcttatttaatttgtttgtttttttagcttgtattctctattattgtgcaaagctttatgagggctttgcatatgaggggactatatctgtctttgtcaccatggtatctccaatgccttgttatatagtgttttgcatataataagtgctcagttagtagactgaatcatatgtaagaatgtgacagatctgagatcttaccctaattgcaagctagcatgttagcctgacacagtttcatggatgccatcagaagacatgagactcatgggtcagagacaagggactttattactcagagcaatgcaatatccagagtgtcagcacatgttctgttccccaagccccagttccctcagagtaacacctcagggcctccctcaggtcgggtgatgccagtgcatatgtcatgggttgcactgcaggagaaaaatcctgagcttactgaacccgagcctcttagaatgggaagtaagcttgcttattctttgttccagagggagatattgtctttactatactgggtaataagtaaacctgccctttactcaggagagagacactatcgctgtctcccaaggctgttcccaatacagacagccttgaaaagatagttcagaactaaggcagtcaatgcctgtgctctcaagacattcagaaacatgacagacccagggagaatgatctcccagcaccgtgtgaaattgctgatttgctgatctacaaaagcacctaacgctttttgaatgagtgatgaattcaaaaaataaatgaataaatgaaacaaacaggtagccacctggatgcttctcagccgacatttacacagccaacctcaaggagtttcagtctgaaatgttaattgttgttacacattaaggaaactggcttgatggggcctatggtcttttgtctgattttgaaaaagcaaatatactcattgagttttcctcagagtgccagaaaccaactacagtgtggttctggaagatgagagctgagaaaggaaacactgtagaaagaaaacaaaactgtgtgattcgaagtttcaatccagagtgggagtaaatgggaaatcaggtttaaaggcaacacatcctttatcactctcaggtacctccattaggaacaattagacttcacagcctttcataccatgtcaccaggtcaaagtccccaactctccaagggtgatataacatcacattttgagaatagtggcttatactttccttttcatcttagtaatttggaacctgaaagtctaaatgtattttgttttaagacaaaaattaggattatggtaataatttttaaagaatatgactatttctgtgcagacccaaatcaacattaaatagttccaaaatcattcctttgaaggtattacttgagagtacacatagaaaggtaaatcacaagataagacggtgatgcaggttagagccaaatgtgaactaattcattttcatgaaaaataacatccttaaaagctaagcataaaaggacatttgtataaccgcaaacctcctatttaaagaattccaaaatcctgcctaatttaagcagtctatgcatttgggtttttcttttattagaattccttaaagcaaggaatatttttactctacaaatctgaggttaggaataactactcctattttgaagaatcactctctatacctaaggctaaaaactgataccctgcacatcagaccaaatcttaactgagtgggatgatgaaggttggggggtggttgtgggtacagtgtttaaaaacttgtcaacatttaaacgtgggagctttcatagtttttaaatccagactgatagtttattttttctattgttttgttttgtttgtttgttttgtttttgaaattgagtctcgctctgtcacccaggctggagtgcaatggcgcaatctcagctcactgcaacctctgcctcctgggttcaagctattttcctgcctcagcctcccaagtaactgggattacaggcatgcatcaccacgtccagctaattgtgtgtgtgcgtgtgtgtgtgtgtgtgtgtgtatttttagtagtgatgggtttttaccatgttggccaggctagtctcagactcctgacctcatgtgatccacttgcctcagcctcccaaagtgctgagattacagctgtgagccactgtgattgatgagactggtagtttattcttaaaaagtgaaagttacagcactactagccctgcattcctgcctggggccatcacctggagagcactgttcaagctgtcccagtccccaccactccctattctcttccttcactcattcatattgctgaccgatcccctatgacaggcatctgagattactaccactggtctttaaaagtggcaagttactgacggttaaattactgcaccagtagacagaggaaaaggtaaacactacatttatctctttttcagattcagtgcaggactgtccacgtaactgccatgggaatggtgaatgtgtgtccggggtgtgtcactgtttcccaggatttctaggagcagactgtgctaaaggtatgtgccgccacttccctgctatggttggaaaacagaccctccctaggcttctctgagcgggtaacagaagggacatccaagtagccttcccatcaaatcccccgagacatcttgcaagcccatgcatgccagaaggcataagccttcgtaaagagtaggctttgatttatgaccattggccaacgtacctataggagcagggcagttatccttggcactgaggtgtgctgagaagaaagatgtgctaaaaatgagatggtcggatttcctgtaaaagcagaagtgaattaccatcactcctttcttataatcattaacttctatgtaatggaagattaagcatctcagggttagtaaatttcattcattctggccagctacactcttaatctaggaagcgctatttatcttggtggaatcggttttaaattgtattattaatttatctacactgctgtgcacagaatagctggagccctgagattcttgggggaaaggtaatataagaaagaaaatgcttctcacaagaacagagaatttagaggctgcacaccttgcttgcaaaacaccttcagtgtgaccttcaaatggctctatcagaggcaggtatagtgaagagcagagcgtctcacacttttacccacaggcacacacacagacacagacacagatacacagacacatagacacacaagggtatatgtctaaatacaagtaggaaattgaaacaaaactcacaaaatgatattttactccatgtttcttttctatttcattttttattttattttatttttttgagacagagtctcactgtcgcccaaactggaatgcagcggcacgatcttggctcactgcaatctccctgtcctggtttcaagcaattatcctacctcagcctcccaagtagctggaattacaggcatgtgccaccacacccggctaatttttgtatttttagtaaagacagggtttcactatgttggccaggctggtctcgaactcctgacctcaagtcatccgcccaccttatcctcccaaagtgctaggattacaggcatgagccactgtgcccggcctcgtttttttttaataccagttattacccattacactgattttccacccaccaataggccatatcacagtttgaaaaatagtgaaggggcagttgagtgcacttgctgcagagtcaggcaatcctgagttccaatcccagctctgccattgggtatctgacattaagtgactgatttaacatttctgaaccttggtttcctcatctggaaaagtggggagttacttcctaggtttattgtgaggatagtgtaagataacacacacaaagctcttagcagggcacaataaggcctcaaagggcttgactttcttatttaattatgcatacgattttatttatttatatgtttaactaatcttcccgttattttcatgtgtgctttattaaaagaccttcctgccttgactttctgcaagacaatcattaataaagctgctctgtaaatactaaatagtgcctctcctttcccaccctcaccgcaattgctctgaaaaatactatttcaaatagtctcaatatttcaaagatgtgagggttccaggcttacgaatgctgataagtgaagggggctttctgtacttaaagttctgggtctgatggcacgtgcgtgagacttaattcctaaatgacaccgcttacaggcatctcttctgtcacacagtatggtgaaagcttcgataaacttaaaaagaaggcaaggtttgtagttctccttgaagaggtccttcacatcccttgtaagttggattcctaggtattttattctcttcgtagcaattgtgaatgggagttcactcatgatttggctctctgtttgtctattgttggtatataggaatgcttgtgatttttgcacattgattttgtatcctgagactttgctgaagttgcttatcaggttaaggagattttgggctgagacgatggggttttccaaatatacaatcacgtcatctgcaaaccacaatgagataccgtctcatgccagttagaatggtgatcattaaaaagtcaggaaacaacagatgctggagaggatctggagaaataggaatgcctttacactgttggtgggagtataaattagttcaaccattgtggaagatagtgtggcgattcctcaaggatctagaaccagaaataccatttgccccagcaatcccattactgggtatatacccaaaggattataaatcattctactataaagacatatgcacacgtatgttttattgcagcactattcacaatagcaaagacttggaaccaacccaaatgcccatcaataatagactggataaagtaaatgtggcacatatacaccacgaaatactatgcagccataaaaaaggatgagttcatatcctttgcagggacatggatgaagctggaaaccattattctcaacaaactaacacaggaacagaaaaccaaacactgcatgttctcactcataagtgagagttgaacaatgagaacacatggacacagggaggggaacatcacacagtgaggcctgtcagggggttgggggctaggggagagatagcattagaagaaatacctaatgtagatgatgggttgatgggtgcagcaaactattatgggtgcagcaaaccagatgacaggttgatgggtgcagcaaaccatatgtatacctatgtaacaaacctgcacattctgcacatgtattccaaaacttcaagtataattaaaaaaaaaaaaaaaaagacaagatgctgcccgacagctctcagggctctgtgtcaggccagaagccacccgacagctctctgggctgtgccaggcttagtgcactctgtcaatggcagggggcacatcagcaaagtgaactgtggagactggacctcctcctagcgcctccctcaggctctgagggtcactgatggagcaaggagaacagagaacagcttttcctagcggaggctttaaaggaaggaaaatctcagtgtcatttgaatggctttccttgcataatctaattttcctgggagtgaagacattaatgagaagaaggacagagtcggccttttatatgtggctgcaaatgggctgaaccctcagccgcacggcccgtgagctgtaaatgtatattaacactgacacacatcgatgtattattaatcctaaaaaccatgtgtgctccgactgcacatccagtgactggccttttaaacctaagtaccccggccgtttaagaaccctttgctctaaatccatttgcagatgaacgtccattctacattatggatctgtaatggggtgtccatttagctgcttaaaaggactctcggtgtgtgttttgcattcaccacctgcagtgtggcagggcgcacactgcaagtgtgcattagccatggtatataattgatccttgtgaaacaaatattgagtggatgttaagagtagttattcctccatactcagtcgctgctcctgaaatcgggctttgaacttgtatactttaatttagctgttgcacacagtggacaaaattgaagtgtttaaagaataaaattgcttttccccgatttctccatttattctgggtgaagttggttgaagagtgttaggagtaggattctaccttttagccctatagatgtttttcccttagtatttttttaaatggccacagtttaagctacttcattgttaacagagtgaaatttcccctcattctaaagccttctttcccagtctttgatctttcatgtaccacctttattatttctggcaatttcatgggacagaagtattattaattacttaacatgtttcttcaagtcaattcattatagttccatagtttttttgtttttgtgtgtgtgtgtgtgcgttttgttgttgttttttttgagatagaattttgcttttgttgcccaggctggagtgtaatggtgcaatctcggctcaccgcaacctccgcctcctgggttcaagtgattcacctgcctcagcctcctgagtagctgggattacaggcatgtgccaccatgaatggctaattttgtatgtttagtaaagacggggtttctccatgttggtcaggctggtcttgaactcccgacctcaggtgatccacccgcctcagcctcccaaagtgctgggattacaggcgtgagccacctcgcccagcgataaatttattttaaaaagaacaatgtcaaaaccagaaaattgaaaaaggaaaaactataggaaatgttagcgcccccattaaccctatctagagagtaatattttcactttgattagcatccaagccaagtcagcttcttacacacttatttcacatcaagaatgccaaaaggggacttgagcacacataagcctggcgtctggagagactcaagccttgaacacctcaactcataactattggctcctaaaataacaaaattccttgaccacacctgtgggatgaaatgagaaacaagtaaacacaagcacacaggtttaactgtaccaggttcaagtgcaaaaatccaatgattagcactgaatttatttctgaaatgttaagcctatacttccagttgtttttaaataacaatagcttttaagtactcaatatgcatcagatattgtgcaaagtacttaatagatactcttatttgtcttcatatcaatgatatgaggtaaattctattttttttaattatacttcaagttttagggtacatgtgcacaacgtgcatgtttgttacatatgtatacatgtgccatgttggtgtgctgcacccattaactcatcatttaacattaggtatgtctcctaatgctatccctccccgcctccccccaccccacaacaggccccagtgtgtgctgttccccttcctgtgtccatgtgttctcattgttcaattcccacctatgagcgagaacatgcggtgtttggttttttgtccttgcgatagtttgctgagaatgacagtttccagctttaaccaatcctccccactacaattttgtaaacattttgtattgaaatcatttgggacttgcagacaagctgcacagatagaacacagagtttccatacagagcgcacccagcttcccctatgtccacattttaaatttccgtaactcaaagatcaaaaccaagacattaacatccatacaaagccattagctaatttacagacttttcctaactttgccctttctttctcatccaggatcccacattgcatttaatcgtcacgcccccttcatccctttaacctgaccagtctgtgacagttcctcgttactccttgtcttttatgaccttgaccctttagaagagcattagtcaggtattttgtggagtgtctctcggtatgggtctgtctgatattttccggtgattggattgacgttatgcatttttagcaagatgctatgccctcctcagtgcattacatcagagatgcacttctgattttaatcagaaaaaaagtaaaatgtggttgtataagtgagtatgtgtgtgtgtgagtgtgtgtgcctttgttccccctcacacataaggcagagacgtgggaagcctcgatcccattggtcctgcacaatttagcagtggctatgacaagttgtcactcacaaacaacttttgggcttaagaagcagctgactgttggcagggagtaaccctgagccaacagaatgaggtaattggctagcaagtgccgagacaggtgcacctgagtctcctgctccccagaacagggcaccccatctcccggctgtgggccatgatcggtgtccttctttcttttctggtttgtttgtttgtttgtttgtttgtttgtttgtttgttttttgagacagagatttgctctgtcacccaggctggagtacagtggtgcaatctcagctcactgcaacctccttctcccaggttctaagcgattctactgcctcagcctccagagtagctgggattaccagtgcataccaccacacccagctaattttggatttttcatagagacgaggtttcaccatgtcagccaggctggtctcaaactcctgatctcaagtgatccacctgcctcggcctcccaaagtgctgggattacaggtgtgagccaccaagccaggcctgtccttctttcttgataaaaactcttaaaaggccccaagcataaggtcctccctcatcacaaattcgcattcacctttgttccttcactgacagctgtgcccggaattccctggctctgccagtttctgtgactgcaggcagccggcagactcaggccctcctgccagggggagaatttgccacgttagcaagagagactcccatcacatccaagcgaccgggtatgtgtccaagtgacagaaatgcggatttactctcttgacctcacactgcgcctcccgtgccctcagatgtgcagtgcaaatggcagctccttgtcttcttataaacctgccagtctgcatcaggcatctgaagacatccttgcagtgaatggaggaatcagtcagcatgcgtttgcaagagcgtttattccgcagccctcacaatctcgggggccctgagaggatccaatggcaaaatgaaactgacctgccatggaaataacatggaatggatctaacacattgtcctgagtcagtcgaggggacagaacttattcgtacattcagtgaatgtgtgtgatctgcccactgtgagacaggtactgcactaagagccagactagagggaggagcgagggaaccacaggctctgccttctgagagcttctggtctgaccagtttgtattaaaagcaagggggtaacataaatgggagtccaaaatactgtgatacggactttgaatgccatagacattccaaaggagaaaataaggaagtttataaagcaataaaatgtgcgtgttataaatgggggagtaagttcccctggtggtgtctttaaggatcactccaactgtggaactcacgctgggagaggcatgtgaaattcagggacttattatactcacagattctagagagggagccacagcacacatgcagagggctgtgtaggaccagctccaagggattgggttcagccaggcaggtgggagctgagagaaagtgagagctggtggccaagtgcctttattgctgagtcagggtggagcaaaaggcatgggggtattttactggtgcatttgaatgtcagtagatcacagtcagggaaggcaggaaggggaacctggggcagaggccggccttatcacacaggtgcacctggtctcctgggccgtgagagaccgggtcatgaggatgcctgtaaggcatcatgaacatttgaagttttcaaagtttttaaaaaattcacagtgttgtgaatcaatgaacatagccaattagcatcagggaatacggagaaaattccaccaagaagactgaatagtatagaattgcattaattgagcaacttaataggcaagctgttcagatccagggcctcaggaaaaatggcatttctttcctggcaatttgtaacattttccatcaggcacctctcctgtccagcaataattgtgtttactattcaagttattgtttattctacggttttttgttattactatttcccttgcatggttttctcattactttaatgctatttgttgtgggctagaggttttttaattattattcctttcccttgtatttgcttttatgtgaaggctttaacttcaggtgcttcctcggattgtttgtaaagcagccttgcatttcagaagagcgctgaggtgtctgggtttttttctgttttgacactggcttctcagatggcttatttgggctgagcttgaggcctcaacctgcagcagaaaacacaccagagccgtagttgttaggtaatgcgtatttaatagctattagaaatgacaactcctgctgctgaacagctgtcactggaggcccagaaatgccacaaccacgggaacataaagtcttctctctgggggttggtttcagctcctacccagcttctgtggagctttaaaaaagaaaaaaacaggaatcttgccatttttctcccgttaactggcaaatgttcccaccaccaaattcctcatggctacatgccagcactaaaaacaaatcatcatcatcatcatcatcatcagagctggcatttattgagttcttactatatacgccaaccaccgtgctgaacaactacataattatgtcattgaatcatcagtagccctcatttatagacgattatcatccccttttatagatgtggaaaatgaggcacacagagtttaagtaacttgctcaaaatcactgagcaagtaagtggaattgttgggattccaaccaggcagtctggcctggactttcaacactagactagccatgagactgacctcagaggtgaggcataaaggaattttgtctttgcaggcagcttgtgcgatggttacacactagaattctgagtttgaacccaagtaaacttttcaggagaggaaacaggagtttcccaggtagaaagtgggagagccagagtttgaaacaaaagcccctggccaggtgcagtggctcacgcctgtaatcccagcactctgggaggccaagacaggcagatcacttgagcccagcagttcatgaccagcctgggcaacgtggtgcaatcacatctttacaaaaactatgaaaattagctgggcatggtagtgaagactgtaatcccagctactgaggtgggtgagtttggagaattgcttgaaccaaggaggtggaggttgcaatgagcagagattttgccactgcactccagcctgtgcagtggtgagagaaagagacagagagagaaagagagagagaaatcttctgacctcagagcctgatgctgttaccctctctcttcccagccgccaggcacgttccatcaccttcctcttcccaccacctgccaactcctgttccgatgacctccaacaatttctgctccatttttcctctctatccttacagctggatttttctatataaatattaagttgtgggagccactgccctgctcactcggctaccaacctctccatgatggtatttctcctccccacctccagagttctccagagttctcccaaagctcttaggggcatgtcactactgtcctcaaacaccttcagtggctcccagtcacctcccacaatggttataaaagctttggtttaaagacatggatctgaagagattgttaccaatgtgtatttccaggtttctcccccatgccagccaatctgacttgtaggactggtgtgcagctcaggaagacccctttttagcaagcctcctggggggggggtctgatgcaggtggtcaggggccacattccgagaatgaagatcacatttcttagaatgatgtccaaggtcatccacgatctaaactgctctcgcactgtcacctcccactgaggcctgaacactcactctaagttcccagtagtcacccctcataaagtgtgaggccctgcttcttcctctttgctcaggctgatttttcagctggaatgttctcatcaatcccagcctttcctatcaaactgctgctcatcatggaaagccatgctcacaggtcaccacctccctgaagcaccctcagatatgaccctgcagtcacctgggcttggcaacatcgcagcagtggcccctgccacatgccggccatctcctatccaggtggttctcctgctgatgacaagcttccagcagtcccctttgtacctccctgtatttagtttggtacctaggacaaaatatgtgcctgctaaatgtctggttacttgaatagaggaagcaaggcttataaagatgaaatatggcttgaaaatgtcacaagaaccaaagcaagtgctaaagaacaaggttctaatttgtcggatcaatcatgcagcaataaatcagccacctttgaggcatggagggagggcatgagcaaaggaaggaaagaaggaggaatgaaaaaagaatgaaagaaaagtttacagaaaagaaatgccatttattccacaatttacgtgcattatgtcataatagccaagtgattaagaaggaaagctgtagagtttgaatttgctaggtttgaattattgctgctctagttaactgaacccattttagaaaattacttaacccctctgagcctcggttttctcatctgtaaaatggagacaacagccatattacctattacattgctgtgaggtccaaaaagtaaatacatggaaactttgtagaaccatgcttggcacgtattaaatgttagctagtatccaccttcacaacaagcctttgcaatcattcattgttattattcctattttacagtaaaagaaacaaagacttagagaaagtaagctacttccccaaggttacatagcagggccacgtctgcctggttctgaagcttgtggccctgatagccatccaaaagagagatgtggcaggaagaccccccaaatccagggcagtgtgaccactcctgaagtccccaacaataagtactgccagcagctggggctctctgagccccctctggctctgtctcacaatatgctctcctgtctccctttaatagacatcttcctctgcaccgcggagaacaatgacaaagctcttagtcccctccctgagggtagctggtcctccccgtcaccaggaatacttccctcagagcttccttctctctccatgaaggaggctcgggtctcagctgtccttcctgagacagccagggctgcatcctagctccttcaaaccttccatcattcatacccatctccttctaccaccccatcttgccctgaaatcctcattaatgcagacaggccatggaccatgactgctgcccaaaagaacgtccctcagcacactgcagctggatggccagatcccacctctctttcctcccacccctgacctaaagaaacatacagggattctttggcagcaaaggcccagaagcaggagcttgaagcaggtgcacttggtatatgctttgcagacagcaactgagcagacacccttggcaaagtcacttttgataaaatagcgtaagaagaatcgccaccgcctattgaagatcaactacatgctgggcactgtgcaaagggttttaagtgaatcctctcatttcatccttgtgtcatacgtcatgatcgtctccgtttcacagctaaagaaactgaatctcagagagattcaagacccttgcccaggtatggtttttgaactatgttcttacccactggattagtgatacccacactggagcccttgttggaatcatctgttaacacacagattgctgggctccacccggaatttctgattcagtaggtctggggtactagcatcaggattttgttaaatatccaaatgctcaggcctcacgccagacgttctgagtcagaagctgcattctaacagggtccccagatgactcccatgcacattcaagtttgagtctagataaattgcccttgaactttgcttggactgcccaaagagaacagagatcgaggcagtcgcatcacttttgacctctcatccccctagcttgccaggcaggcatggaggagccctttcctccccagtttggaagttgcagtgcacattatttggtggccacgtgcaagtccatgcctgcaagctccaaaacgcggcagctcctgatgtttctcatggcagttgcgttaccaaacagaaatcacttcgcggggcttcagtccgtcagccctcccccaagttaaattgcttctgagattaagaacccttcttttttttttttttttttttcctttttaaactactagataagtagcagagcagccctggaaggcagaatgtctaaccctagggaaacttgtacatgtgatgcacacagagctaggggaatcctgtggtttatgggaaaaactttcgtgctgggaaataaaccagtctttagaaagaggtcagctgggatgggggacagggaaagggtgctttaccctgtcttgtctctctacaaagtgaccagttggaatagttttctcccagtgaaaacagtgataataaaatcctatctagtgatgactatgtgccaggctctgtgcacagcactttacatcattatctcatttcctccctttggaaacactatggggtaagtcctgcagaattcttatcccacttcaaagataaagcaatcgaggctgaaagcaaagtgtccatagtcacacagctggcaaaaacaagggaaggaagaaaggaaattcaggctgtctaactcccgtaagcctacaccatgcccagaaccattctgcctgctgagagacagcattggatgaaacagaccccccatgccttcaagaagcttccatgcttgcgggtaataggacaccaacaacttgcaaattcatcttgatgctccaattacaacaaaagcgtaaacctccttcagtctggacttgagctgcagaaaagcttactgtgtactccgaagaatttaaatattcattatgtaattaatgctgttcagtctcacacacacatacacacacaaaaactgagacttttttaaagaacagcttaagtacttatcgattgagaacttttataactctcaaaatggaggcatccccatatctctacaggtattttaaatgaattgaattaatcataggcttaaaagtctcttgcgatcttcgttaacttccctgggtttaattaaaacatctgtgcacttttaatttatcgattcatccaactcatatgtcatgtttttaacacaccccagcatgctctgcatcatttttaacccgatttccacttaactaaagcaattaaattcaccccggattaattaaagcatccatactttcgtgcttaagtcagcgtgtgcttctttccccacatggctcctgaatgtcagagatttgacacacctgatgagttttttgtccttctggaaattcttccctgaatcactttcttgcttattaatgtgccatttgacagaatgggaatgaggaagttggtgcagctgaactttggccctctgagccggggactctgaccccatctgtcagaatgcaccatctggtttcctctcttcacgggggtcctgccggctcttgcccccactgaaaccaactaaagcgtctgagtactctgggcaggacggtggcaggggttgggggagggctgttcaggtcagagatgagcatcacagtcaggatggctggtgatctttgcatttgtatttcataatcactcctagctctctttccaacttcctctctctctctccttccctacatacacagtcctttattgctctgcccatttaataggtcaggaaaactgagatgccaaggtcaacagacttcctgcttgggcacggtgagccagggagctgtccacagagtgacaaatcatctccctgaaaactagatttgatttgctgccatccactgggatggagagagcccatcccctcagccatggcagcattgggtgtaagcagccttatttttttccccgatcagataagccaaaaatatttctcattatcatttttatctgtacttacttaattttgaaggaagctgagtatcttgtcttacctttattggcaacttatattatttctgatatgtgctttgcctaggttttcattcatctgtttattaatttgctagagttctttgcgtatttcagatatcaaacgttatgctgtaaaacatgagaaaaaaatatttcttcccagagttgcttgtcccttaattttgcttagggtatcctttgtcacagagaagatattaattctttataatcaaatctgatcctctgttccttcatggtttctagaatttatgtcttacatatctccctcccaggaaaataaaattagtctccagtattttttcaaatactttggtagtttttgtttttctgtttaggtcattaatctgtatggaattttttttaactttaagttcaggggtgcaagtgtgggttcgttacataggtaaacttgtgtcatggggggttgttgtacagattattccatcactcaggtattaagcctagcgcccactagttatttttcctgatcctctctctcctcccaccctctaccctccagaaggtcccagtatgtgttttttccctgtatgtgtccatgtgttctcatcatttagctcctacttatgagaatatacaatatttggttttctgttcgttagtttgctaaggataatggcctccagctccatccatgtccctgcaaaggacatgatcccattcctttttattgctgcatagtatggaatttatttttgaatacagtgtgcagtgggcggggggggggtcaaactttattacttttctaccagatggattgccaattgcagggatcttgctagaagggaaactcacctttctgacactggtttgctcagcaccaagctaagtccacaacctcaaaagccagtggggttgccttttgagttttggtttgaggggtcaccgagctttgtttgcctggcctccatgacctaaatattacatcctcaattgcttcaggaggatcaatgcatcttcttttctccatcacttatcctctaccacctaaccaagctactaacccatgtgagttactcatcactattgctgactaactgggatataaggcaaccaactattagtgctattttgacgatttgcctggagtactagcttcaagtattttcacctctcttttccaaagaaattttcaaacagacttcagctgggtgtagtggctcatgcctataatcccagcactttgggaggctgaggcaggaggatcacctgagttgaggacttcgagtccagacagggcaacataaagagaccccgtctctaccgaattttttttttaaattagctgggcatggtggtgcacacctgtggtcccagatgctctggaggctgaggcaggagaattgcttgagtcagggaggtagagtctgcagtgaatggtgatcctgccactgcactccagcctgggtgacagagcaagaccatgtctccaaataataataataataatagtaataaaatgaaataagtataaaacagacttcaaataattttttaaatacattatttgaaattccctctacacatctagtccagcccacaaattatttgtgcagatgtaggcattttccctctgcttttatgactgagcctctccaatatccttaacttttctccacgtattctctttactgcaagctccaagtggacaggtggcttatcctgttacttcccactgagtaaataacactgataattcatctcatcccttacagagaactttgtgggggctgggagggcgggggagcttcagctggatcattaaaatgagctttataccatttaggtgaatctaaattctgtcatttttttgtcatcagcctgttaacttgtcagttattagtggttgtggtaatttatttttcttctgtgggagtcttagagcttccatttactagatttagtaaaacaggaatagtcaatttgtacaaacattttaattaattttacatagaagcttgaatgcacaatgttctgctcccgtaagccttaggaagaagagagacatgcggagacagaaaacgctccactttcatacctgaccaatcacaaccaactccctcccacaccagaaaagactggaagaagaaaaaatgaaatctttccattagtatgatttgacatacgtctggtgattgctagtgtttgtgtgtgcgtgtttgagacctatggcatttctttattttattagcccttgaagtcagattagagattcagtttgaaattttgtaagggagcatctcttaatttgcctaccaagtgtcagccactcctgtgagccatacatgttacctcactgaacccttccatcaatgctgaaaggccattttttgaaggggaaattgggtctttgagaggtgcagtaatcttgccaaaatccacagctggtaaggtacaggtttggtttcgaatccaggtctttctggcatcaaaacccttgctacttccacttctgctccgtaatacttcttggcacagagtaggcagtcagtgtcatttttctataacctgtcataaaaaataatgcagcttgcatgatagtaaaaatataagacttattaatacaggaggttccccatttcacatccagcctcttgaacaaaacatcagcctgacctcagatactgggatgctctgggttgagttatgtctgagaatgaatcagttgccccagagggaaggtgctctccaatgcaggacaccccagccaccactggagggagctcatctggtgtttctgcactctgccccatggcaactggattactataaagtctcgctcctgtgatgagccgccttccacttctttgtatggcataagcaaagcccattgagtgtcctgctttccagtgaacatcacagtgtttttgcattttttaccacactcccagtgagcacgcggcaaaccctgaaggaaggctgcgtttggaaggtggagaactctgtgacctattttttatatttttcactgagtaatttaagtaggtcaaattttaaatttgatttcccaagcacctggttttaaataaaacccattcttaccttctagacaatcctgtttttttctacttgaagtttatgcagaagaggaacagtgtcactatgaataaagaaaataattcggtcaggcacggtggctcacacctgtaatcccagcactttgggaggccaaggcgggtggatcacctgaggtcaggagttcgagaccagcctagccaacatggtgaaatcccatctctactaaaaatacaaaaattagccgggcatggtagcaggcacctgtagtcccgctactcaggaggctgaggcaggagaatcgcttgaacccgggaggcagaggttgcagtgagccaagatcatgccactgcactccagcctgagtgacagagcaaggctctgtctcaaaaaaagaaagaaggaaggaagggaaggaagggaaggaagggaaggaaggaaaggagggaaggaagggaaggaaggaaggaaggaaggaaggaaggaaggaaggaaggaaggaagggaaaggaaaggaaggaaagaaaaaaaaagaaaaaaattttatctatattttttattgattaaaaaagacaaaaattttgcaccttactttctaccatcctccaccttttgggaggaaggaggatgtaataggagaccagtgttggtgatttgatgtaactttctctgccatccgtgacagcccatccaatctataacccttaggtcagagagtcagaaacagcccttggaagctcatttaaatacacgttgtgcaaccatacttctcgctgttttttatttcagtgcagggctggaagggggctgagaagtgatgttgattctagtcttcccaccaggaaataccttcactgttacctagatcagaaatgacaagtaggttttctctggaataccaactctgcctgcttgccggtctcagcctgcacactgcattgacggtttcgaggctctatctgggctcaggggaacaagatgccgtgatcaattagtgatgtctgtagaggtgtgggaaggtagtactatagatcatgtgcacacgcctgccatcccagacctagagcttagcatgagtctcaggaggaactggcatggaacaaacttaactctgtcttaaatccctctcaaaactttaagaaagttcagagtttcttgtgctacttcatatttgcatgttccctaattcttaattgggcaccctgggttcaaagctctttttctaccctctgttagacaatcagcctctgtagcaactctgtacaaactcctctgtttaagcatcctgtagatagagagtatgatccctacatttagacagttcgtctaaattcaatatgcggctttgaagttctcacttttgaactcattcttctcctctggtaaattcataagcataagaattctactgaaaatagcgcccccagtagttatggcaactgtcctattataaagcattttgaggggaaatgacccctcaatcgtatgtcaactattgagatacttacatttcaaatcagtttgcaattaaggtaaaacatgcacttccccagaaaaaggcattgtgtttacagcatgagattcactccagggactgttcttcccacgtctttcataaatggccatttagtgcttgcccgcaaccccccaccactgggaaatctctgaatatcaggaacacaggagaaatgtttacttaatcaagccaccattgataaacgtagcaatggaaggaaatcaacaatgataaacatagtccctgtcttgaatagctgactatatatctttgggaaattagacacgcacagaggaaagttaattaccataaaaactacatagaaacatgacaacaaaaggggattcatgaggctgggtggggcaggtgactaggaagtgacatgattaggtatgccatcgctgagtggcacagggcgctcacccgggttgtagatgtgtgtacacacacatgcagaattctcggaacctgtgcattccaaaccatggataacaccaggagtcactgaaacacctgcatccgtcatttctgaaggcctctaatgccacttccatagccggaggattttaggcccaaatttgaaggcaggttggaaagttaggctctttacaaactgatgcggaaatgagaagtccaagacctgaaggagaccgaccactgaaatcccattcttgatgaactctgaaaggtgggaattggcacatttgaggccaaactgattaaagctgtaggtaatctcctcccagacaatccccactgattttccaaccttcttctcaccaacagatggaagagggtacagctgatgggcgaactactagaaatttcatgccttcagcctgcctgctcccttttcttttttttctaataagtcaagcatatttaatcgttatgctttattacacatgttacactttgaaggaggcacaatgacagtagtccctccttatcctcaggggatacattccaagaccccctgtgtgtacctgaaaccacaaatggtacaaaccctacacataccatgttttccctacacatgcatatctaggacaaaggttaatttatcagttaggcccagtaagagattaacaataataataaaatagaacaattaaagcagtagctgtaacataaattatgtggatgtaatttctctaaattccttattgtaccatattcacctattttcagacagcagttgaccatgggtaactgaaactgaaagtgaaaccgcggatacagggggactacttcatttcttcatggtatagataaaactgaggcagtgagactttcagtggctcagctgtgtctcatccccacttcctttttaataggcataaacttattaggaataagagtcgactgatctgagggtaaaataatcagcaaaatggattctgatctccaataccaacaacagaacaaccataaggacgtcagtgtcgcttagtgaagggtaccacttcaaagttgggccaacctggttcccagccgggctcccctgcttgtgggctgtgtgactggacacgtcacttcccctgtctgagcctcacctgcaaaaatggggaccatgactgtagcctccacctcatagggtgattacgatgatgaagtcatgaattgcacataaagccttctttctataccgtgcccagcacataacaagcatttaattggtggtagctgctgttatcagtagcacttgtgttgtttatctggcaatggttctgcacctgcacagccagagtccccagcctagaacactgtaagccaagccccaaggccagacagctctacctccttagactgccatagcccctcggatgctggcccttcgtgacctagtgctctgtctttggtttgtgcagctgcctgccctgtcctgtgcagtgggaatggacaatattctaaagggacgtgccagtgctacagcggctggaaaggtgcagagtgcgacgtgcccatgaatcagtgcatcgatccttcctgcgggggccacggctcctgcattgatgggaactgtgtctgctctgctggctacaaaggcgagcactgtgaggaaggtaagcccgccggccccggggctaggcagcagtggagggaggcgtttgcagggcctgacctttgctaatgagcccagtcctgggctgcgtgttttgcaagagaagtttcaacattttgcacaaaacaacttcaaactcctttgctttgataaatttctttggttgtagaacaagaaaagcctatggagatggttctggaagaaacgttttgttttactctcctttgtagaaattgattccttttctctttcacctttgtttttctctttaaattgctctctctgcctttgtctttctgtcttctctttccttctactcctcctccccttccttctctttcttttcctcttttgttcctttccctcgccctatctttcttcctcttttctcctgctttatttagtaattgggaattactaaagctattcagagaaaagaaacaagaattcctaagccccttgcctcccttccaaacaaaaagctgtttgttgttattgttgttgttactaactcttcctggtaatctaaggcccgtgtatgtctgtgtaaatatttcagcaaaaattaatatcaatagacagcagtcaggcttgaaagactgtaggttttttatgtcatttagaaacaccatgtagggcaaattagcttggttacttacaattgcacaaaactagaggagagtgaggatgcagcaagagggacgggatttgatggatcctgaaaatctcatcctggcagacacgtaagggcctttcacacacatgggtgaaaatcagggatataataaactgaatctaatctgacaatatggtcagagatcaggcttggagatcaggagagggggacatagaagaggggatacaggaacagggagaaagagcacctctctggaggggatccaaaagcagctgtaactactcctagttaccttgatcagttatttcagataaattattttgtgccaatatgttgggactgacttgcagtagctataaggcaagagaaagctatgctgcctgtcagccttcctgctctgtatttggccttgcagaatatggtctctggttgccatttgattacttgtcaccatataaagaattggccacagctggtaggaaggtaagaccatagaccctctcagccccttgcccattccccaatctctgaattggcttcatcattgtcttccagctgaggctccttttctctaagtccatctcccagtgaaatgccctcacacaactcaaacagcccttttccctcccatgtccccaacagaaatagaagtgtcaacttgcccaacaaactaaggggaaaaagtgaagcccctgcctattctgcatgaacttgatgtaaccacccaagatatccccatagaaaagatcctgttggatgccatatgcattctgtgttcctcatggccaggctaacaagggatctcaggttttatgaggttctcagatgctaatggattcattctttcatcccaacaaccaatggatctccagagttctatacaaaataaccaatcatcacagctctcaccacaaagtaatgacagtgctttgtacttagatacacccacatagggttcccttgtgaaaccccgcatttcatcgtttttagaactatggctaccaaaagtcagcttccataacattattcctctaagatttttcaatatatcagcagtaatgcccttaatggggaccagaagtctgacccccagatcttcacttgctcagttctctatataatttttcctctattataaaaggtagcctccctatgtctgcatcataaagaattgggagtttggatggaggaaatactgatttaataaccctgcttgaaaggttaaagttcttaaagataaatggattgcaggaggcaaagctgcattcgctgaaaacataagagaggccaataatacgacaagaaaggttaaaacgaccttttgcatgcatcatttggagaaaggaaagtgctagggcaacaacattgccagtcttcgaattttttctctccagtaagattatacacagctgtatgcatggaatctcaagtgatttctcaactttctcactatcccacccagtcttatttaaatgttcagagtgaattaaccatccaaccaaacaagccacgtgaatcattatgaaaggatgaaatctcctccgttgatttctgctacccaaaaagaatgaaccgaggtgattcatatgctgttttcaaaataggaaatggaatcagaaagtctggatcagcactttttcttccatttagcttttttatttctgatattcgtcatagtcataacgttcaaacaatttacctgaaatggccatggcaatgaaatcaatagttgccatcccttcgtttttcctgcataaacatggttgtactattaacaaatttgcccaagaaaatgaaaggatgtattcgtgaggtttcattcaatgatgtgtaggggagtgggaaggtgatgagagaggagttgacatattagtttaagtcagccatgttttcatgtcagtttcatggttgagtcatttttcaatgacatttaacttcataaatgtaattcatggttcttcaggggcttatagtacatattgtttgtaaaactccttgacctccttttttatccttagggatagaaattgcattcacaacccttttttgtcaaacctacagagggcccaagactaaatgagttctaatgatttcagctgccagggggctgatgtttcgaggcacatggtacttagctggtaaaggccactgtccccttttaagtgtaacactgtttctatttataaagcttcgtaaaatgccatagtccctcctgcctgctaaaggctctaaggacgtggccacaagagcatcttaggaaatcggaaccaaatttaaaattcatagtaaaactgctcctcttgaagtttgaatttagttattccatccactgctgtaattatatagcacaaagggcatatttactggtatcactgaccagagaaagggttagctcatatttttagatacaataaatggtttttttgatggcattctagtaccggcgctaataaatctctgtggattttcctccttcctttatactataattcaggatagagaagagagagctaatttatctggaagaaaaatgccattttcatttttttagtgtattactttttattatttcatccttctaagaaaaagattgtgattttttttttttgaaagctcctagctgctggcacctcaccaaacattttaaatggctaattataggttaagaacaatttttgaagcaataagccacaagatatttttgtgtatattttgatttttccttactagaaatgggggcagagtgaaaaattagaatttcagaatttcctttattggaacaatataaacatgatgggttctgaatgaatttgttcataatttacagatccccaaatacgattttttttcaaaagcaagaaagaagttgttagcacaatttctgcttcctatcggtcctttctctacacaggaagtgtgtcccatcaatgacaaatgcttatagcacagtctgtccttcattcttgcagcaactgtgtattgaacacctggtatattcccttacctgtgctaggcatgagacaccaaaggccctgcacagacctttgtcttttttgttttgttttgttttttgagacggagtctcgctctgtcacccaggctggggtgcagtggcgcaatctcggctcactgcaagctccgcctcccgggttcacaccatactcctgcctcagcctcccaagtagctgggactacaggcaccggccaccacgcctggctaattttttgtatttttagtagagacagagtttcaccgtgttagccaggatggtctcggtctcctgacctcgtgatccacccacctcggcctcccaaagtgctgggattacaagtgtgagtcaccacgcctggcccgccctttgccttctatgtgttcgatgctttcagctcaagtttacgttcagatgtgctccaccaccctaaatggagcaaatctgaaggtatcaaatgggcttatgtcatcaggagttatactccccgagacaatgaattcaactgtaaagtgataataacaagattatgtaacatcatcataaatatctccaactaataataagcaaccaaaattcacctttgggggagtgtacccctgatttttttttaatcactgttttttccccatgcctgaaacggttttgaaatgacttccatatataataccttcctgagaatatccaaatgggatcgtgagaaatatctcttaccactgaaaattattatttttgcctcaagggagggctgccctttggaaacttcatggaatattgtgatttccagtaagtccaaatttctcaagtctgttgtccctcaggactagttaatttgtggcatggatactctaaataatgtcatatttagagccaatacgtcatcagtattaaaatacaccaatggctgggcatggtggctcacaccagtaatcccagcactttgggaggctgagataggaggattgcttgagcccaggagttcacaactagcctgggcaacatagcaagaccccatttctagagaaaaaaaaaaaaacatagctggacatggcaatgtgtgtccgtggtcctaactagttggcagactaaggcagtaggatcacttgagctcaggtgttcgagactacaatgagctatgatcataccactgcattctagcctgggtgacagagcaagaccctgtctcagaaaacaaacaaacaaacaaaaaaggcattattttgtgccccatagggaaagaaaaaaagacactcagcataaaaaatgtcttaggagatcctacagaaagctgagaccctgaggaattatcatctgaatataacagtgaattatttagagaccagaagtcttacatatttcaatcttggcattgtggaaggagagaaaacaaaattttctgagaatttaaaccataagacggtacgcatacacaggaaggatttaataacactgtcagcgtggtccataaaaacttcaagaatagaattcaaagtggtctcaagctagctgtgcccccaggtgatagaagaagcaatcctttaatctgggccaacaggcctgatttggaagccgtgaaaacgggagaaatatgtcttaatcaagtaaggtgatgatacatccacatttgtctgatccacaaagccatatctgagccctgtgctagaccaccatttctcattcaaaccgtatattacacaaagaaccctcttctccaaatgacattgcatcatttcctgagaatacataggaatacataagaaagctgggcttcctctaaaaggccctatttattcaacccttagattgaatggaggtcccaggtttgatatcatattctcatgcaaaaagtcctgtcctcaagaactggcctttgcagctcgctcctctcctcactctgagtttattcaagttacgtactggatgtatatccactctattaagatggccaaacaatcagacagtgaaacaggcaagaaccacaatgactggactctggctatcagctcatctgattgactggtagaaggtcagtgcctcagccagagatagccatccagtcccctggtgattacctgtaggaaggtgatcccttttggatcattttcacacccaacttcgcctcttctatactgcacatttactaactccttcagtgggtgtgtgctcagagaatggatactaattttagacttagcctaagtgaaacctcattaggaaagtgactcataagtttcattggttttccttttcatcttttgttaccttttgaagtcaagtattagtgaagttacaatgagcctctctacttttctctcttatagtgaggggcaatccagtttgacgacacatgtagaaacatggcatatattcacattcctatcgcagatgctctgatatgattcagtcaaggtcctaatctttataagcacaagatactaaaggtggagtggcatccttctatatctgacttctaatgctgcttgagaaatccccttttcgtttctcttgtatcttcttcaagtttgagatttggtgtttgacaaataagaaggcttttactttttatgggtgtcttcaggtgaccacataagtatttcttgggctactccatttgctagcaagtggatgggaactggtgacccactggtccattcagcagcaagcccatgtctcatggtccatcctccatgggtgattaatacttttattctttggtttttgtttttgtttttttcagttgattgcttggatcccacctgctccagccacggagtctgtgtgaatggagaatgcctgtgcagccctggctggggtggtctgaactgtgagctggcgagggtccagtgcccagaccagtgcagtgggcatggcacgtacctgcctgacacgggcctctgcagctgcgatcccaactggatgggtcccgactgctctgttggtaagccacaaggttttctccttcctctctccaacactcctgccctgtgttccatcccattctcagatggatgggaatctactcttaatacttagctggggataaggggactttgatgaatcacattgtgtctttctcattctcttctcctcaatcgtggagtctgtgatctttgagaaacaaacaaaaaagcactgggttggtaccatcaccgcaaatgcatgaggagcccaggagggatgcttccatttgcattataggttttcttatgtacattccctaaaggtaccagaaaacaaaacagaacatttcagccccagacaaactaaatggaacatcccataaaacagaaaaggggctccctcggggtgctgcgtgaacatgttctacagctctgtaatactccagtgacaggaaaataatgaagtcgcgctgtacacttcattttcctaaaatttagagtatgtgtcttccctccagagtgaccttaaaaatggaacagttcaacagttcaagccagtcccaaccttcctgagaaaggttctgttcacactgacaagtccctatccaagcaagcgatcattccgcccccttcctctgggtagtgagacagctgtcagattgccatggcaatcaggaagggaatagacgtgaagctttgcctacaatgggaaagaaatgaatatttcattccaaaaagaaaaaaaaaaagaagagtcagttaaaatgggctattttggaatgtcttctcagcccacttgactctggcttcaactctgttgctggtggtcctggcaaggccgtgcagatgatgggaggaggcaggggtcctagatccaaaacccagttatgctacagatatgctgtgtgactttgagtgagtcactggccccactccccggcctggtcttccttcacctggcatgccaagccacgcctccctcaatagactgatgaaaggatgaatgtctggcacgtgcttgtcctcgcgtgagaggtctggaataccagagagtgcatatctgtctgtctgcctcctccccaagcacaaaagactttgagctcctttgagaaagaagctgtgtaaatgcagcacaattacagcggtcattatcaccgccaaggtaccaatctgggtaacggggtatctgcagtcatcatgggaatggagcagcggggtccccaactgacctcttgtgcttggtcagttcaggctgtcagtgggggaggaatcccagctgactagagagtcaggatccgtacatggatcttttcaggtgggtacttcccggttagctttgccaaactggttggagtggtctcaatctctagaagagtggttctcacattctagcgagtatcaaaaccacctggaggacttgttccaacaaaatctctgagtcccattcccagatcttctaattcacttggtccaacgagggcacaagagtctacatttctaacgagttcccaggtgatactgatgctgttggtccaggggccacactttgagagtcacttctctagaaaaaaagatctaacaatgaattgatacccagccaaggagagacaagcctccaaagatgacagagctgctgggcctcggggcctgctccaggggtctgggccatgtgcgtggtctggactccatggaaggtttcaccagctgtggtgttgagctgtaatcattgtttttcttccagaagtgtgctcagtagactgtggcactcacggcgtctgcatcgggggagcctgccgctgtgaagagggctggacaggcgcagcgtgtgaccagcgcgtgtgccacccccgctgcattgagcacgggacctgtaaagatggcaaatgtgaatgccgagagggctggaatggtgaacactgcaccattggtaggcaaacggcaggcaccgaaacaggcacatattgctttattttcataaattgtagatctatagtgatggtcgcgcatggcaactggctgttccttcagggacacaagtgctctcccacatttcctgctgcccctccaaatctcccaggggatagggaaggagaaaaatgaggtccctaattgggaagggcttttccttctttccaggattccgagttgaaaggaaagggaccagagcagataagaaaacccctccaaacttgcaatctcagggagggagaaatgcacatgcatgggaaactgtcggtgtctgggggttgcaagcacctcaaatcactgtggtctgcaactctcccctttttaaatcctctctcagctggctggatcactggatccctgcttgctggcaacaaggtgaactcactaattttaggtcaggttagacgcaggcaggactctcaggttccctccgtagcaggtaccacggtaaggtcctgagattccccatcaccaccaccgtcattacatgtctcctcctctggtcccattttattctcactcagccacctctctataaaagcttctggaccaaggataatttaaaggtcattttctttgttaagaagaaatagttttggagtttcttcatttttatttttctctctttttcggcacagttgtggtttagggtaggactatactggattaaacgtacctaatcatccctttggtagagaagctgggagccaatgctgtttggctttgcacatctctcagacagttgggatgacaaagttgtcaacttgagcatcattttacctccggtttttacttttgttatttaattagatcaagcctaggatccatttttatactaagctggttaatctacttgcctgcatggaaattctcaaagacgtttccagccaaactacagtttggccccttgaagttacctttgatcccagccatcaagtttgagaccctcccctctgtccctgcctaacaaccccagtcacagatgggccacctggagtgagagacagggctaggagcttgcgcagggctgattcatgagatcagactcaatttcccatgctgttcatttgggtggttatacagagataaagtggactgactctgtattcgatttcttccggttccatctgattgggcatccgaggggcagcatgccaatcagggccacgaccatagcactgggaccctgctgggacagtctgttggcagtgaattgtttttgcaatctctcgatgacgctccaggtcttgctcccctgcagccgcttttatcctcagttccctgcagagtctgaggaataattcaaaagactttcaggggacggctgtgcacagccctatactgagacagttcttacaatagcttccattcatcaggggcattccttttgctgtactattgcatgcctggtgttatttacatgaagattcccctccccatatctccattgccccaaatcctcccctcaaaagctcttgccaatcatcagcgttgaggtggataatcctactttcttttaattcacacaatccaacctcacctcccctttgctcccccttcccacatctgggggacagaggggcagggttagtgtttccacaatgatgcctgctggctctctcctacctacaatctgtctttactttggaaatagctcacaagagggcagtccagatggattcgagcaggagtcgccaaactacggccagagggccaaatctggcctgctgcctgtttttccatggcttgccagctaagaatagtttttacattttctaagggttgaaaacaaatccaaagaaaactatttcctggcacgtgacaatgatacgaaattcacatttcagtgaccataaacaaagtattattacaggacacccacacccattcactgatgcctcgccagcttccatgccacctgtcagcactgagtaattaggagaccgcatggcccacaaagctgcttgtgtggcccgttatgggaaaaaaaaaaaaaaaggctaactcctgaattgcacaaatcttgatggatagaggggagaaaagcaaggcaggtccacacccccattaagaaaaggacaccaactgtagcttgaaggatctgaggggtctactccagatatcgcagagtgggagtggagaaaaaacagtagatgtgctgaaatgcttccggggcccttgaaaaagagatgggaagatgacaactttggtctcagcagagaacagcaaggaattggccaacaagagaacatagatgtttcggtcaagctagtcctttgggtgagataagttggaaaaaaaggtgtttctgccacttgaagtgtttggtacaggtttcacatctttgtgagatgacatacatgagttcttgagagacattcagaaagtgtaaattgatatgccagctaaagctcccaaaatgaagagagtgctggtccagtatagtctcttgttcagaacgatgatctcctgtgactttagagtttgtgctctgtatgttataaagatctttactaccaaagccttttcttgtgagaaattagggctctgtgtctttattagtaggacatgtgccatctcctcatagttatgttcactgtggttttctcaaaaacaaagccaagcataccttgatcagtgagatttgccattcaaaaaccagagagatgttcatacatgcataattgcatctttagcttttctatctccggcccccagagctgctttggggagttttattcttctagtttgagcagacacttctgtcatttcatttaaagtaaatgccacaatttacaagcccagcatcagttctcctccttggggatactgacagagaggaaatgggggctctttggtcctttccaagcacagcctcaaatgctatattttgaaaatagaaaatacagaaaaatgacatggtaccaagtcagcaaacaatgcatagggaaattttgggtaaggcagaattgtgggagttagtgttggacacttgggttgtctgcgacctgtttacaaaaggtcataggtggttttcttggggtcattgcaaatagtcaactgaacaattcacatcagtccttgtggattacatttactgtactaaaaggatcaaaaagagaaatggggaaaaaagatgaggacacaaggacagacttctaaaacttagtcaggtggaagccccaggatcagtccatgtttggttaatgcctttctggaatttgcaaccaaattatttatatttgaaaatgtagtagagattgctaaacatttaaatataaggtataagacttcaatgttaactgttagagctaacttattgacagactggattctaccaagcaatgactgttatataaccttttccttaaaagttaaatatatggcatggctaaaatctacagaattgtgtagataaaaaatatactttgaatacatatcagccacaattcatgtgtatctttggaatatattagcattttttgtatagcgtgcagtttactcttatgactagcgcagacggcacattgtgtggctagaagaggtttattctttaaacataattttaaaatgggttgttgttcctgtcatctgccaccaccaccaccatcaccccttgttaatactgggacctaggccaggtgcagtggctcatgcctgtaatcccagcactttgggaggctgaggtagacggaccacttgagatcaggagtttgagaccagcctgaccaacatggtgaaaccctgtcactacaaaaattagctgggcatggtggtacgtgcctgtagtcccagctacttgggaggccgatgtgggagaatcgcttgagcccagggaggcagagattgcagtgagccaagatcacaccatggcactccagcctgagtgacagagcgagatcctgtctcaaaaaaaatactggtacctaacatcaaaaggccatgcaaagcctgtaacaccaggacatggaggaactatagaatgtgtgtaataatagatcaaaatcactaagaactatatatagtaaatgtagatcagcgtctcatgaagaggtaaagtagatgttagcgtgtgttaatgagcagaacaattgggcaaaatgcaagaagaagccaacatttgcattgccggggaatcaaggagggatgctacatgctaactgtggactcttgcaattatctcctgaacatgggctacccagacatctgctccgaataatacaaactaacccgcagactaaatctgcccactctgggcacttcccaaccctgagtgaactgtttgatatctgggtagtgagtaaaggctgcaatggttatttcaacttgtgtattttatctatgtggtcctaacctccgatttcatctcagaatcataagggcttgattcctaggaccttgtgaggctgagtgacctgcccaggtgccacaagtcagtacagttttcttttccctgtatcgcactgggcccttctatttttcctctttaattggttggggaaagaaatcggtgcttgtgatgttaataaggaaaatgaatctttacccaaggtaaaaccagccgtgcgatgatccgatgtgctgattaagtgattgtcatcagaagtagacagggtcacagtccaagagggagagtgcttcagaacaatagggaacaggttgagaagaaagtgattgtcagaattaaccaacttcagactgaggacagctgcttctgaatctcattccagtctcattctaagttatgaaaactttttttttcttgtggctattgtccttgaacacttgagctttcatgactctacagtgagatcaagttgagatgaaattagccactgtggagccatccttaccaccaggcctgtggaatcagctaattctctgattggttaattaacctattcctccaggggctcttattagaactatccttggagttcctttttttattttaagtgaaaacctaaagcgatggccttttactgataaagattatggataaacttttaacagaatgcaaaagctgttccattgctgattctcccccaccacccccctataatttggccaaaacatgagcttccttactgcagatcaggagtcaccacatgcccagaagttctttttgagtctgggtcagacagtctgccagaggtttcctatctaatcccagaacaaggactgggagacagacttacagaaacatgttttcacatcactgcaaaaacataaaaggaaagaaaataacggctttacaagcagcaagagtctcatcactggaagcatttgctttcttgtcctagacgttgaagggctttcagcatcagtagaaacatagacaagatagacacaaactacattctaactttatgactcatcattctgtagtttagatggaagcatttttttgtatttttatgtgatttagtaatgtctgctcatgttatgagctcccatcaaaaaagaaaagaggagaagaattcttggtgttttagctctgtggggagacagtgatttgtgtcgtactctgcgctgttcccttactgtttcaggggaactggtttgatggactagcttgtggctcacagtgatggggccaagcttgctgagtcaatagcttgatataaggtattccttcctgacttcaccagagcaaagaattgaacagtttggaactcttgcaacataaactcatggatgagagttaacacaagtaagattccaggctcaaagaaaggggaccatgtaataagagctgttgaaaaacatgggatgcattgtcctaatgtatagtgagtgttctgcacttgagcttttatagagaatccacgtgccttccaagtctgtgactctgggctttcacaatacgcactaaagattttccatcaaaggagaagggaaaacaaagtggttcctggagagctgagctcccttagatatttgtgatggacatctttcttatcacttggtagccaattcattgtggtatcatgaacagtagactggctgatgaaggaggacatctgtgttctagctttgactctaccatatacattttgtatatcctggagcaagtcaccaagccttcccgacctcaatttctccatgtggcaaatgaaagggttggatcacatcattgccttccagggcatgatacacaaacttgagatgcttttcattggtgtacaaatataccttattgaatagtcatgtagggctttttaaaatagatacagtattaggaaaaaatataactagcacatcaaactgatgattatacagctattattgcttagggagggggcaaaagtaggtagtgatattaggcctgagtaaatttaaagaaaaatattaagtaaatagtacagatattgcaaatgtcataaatgcagcgtgtgattgactgaatttagaacacatttgaatgagctgatctctaaggacctgtccatttctaggatttcattacttttgatgcagaaacatatgaatgggttattctaatgcaatcaagcctttctctcttctgtaaggcaggttttcaatgtaggctcccataatatacactaaagactttacattcaagggacagatacagcagagtgctgcccagctgatgaggcattgttgaattattgaggatagtgaatggagcttttgttgtttgtttgattgtctgctcacctcagctccaatttatatctggtttacctagggaatcttttgtacattgaaaaacttccttgcataagttgaatcatcaggccccacttcgtccatttatattttttaataaaaagaaaagacatggctcatccatccacgtctgcttcacttgaatccagagaaatgcaagcatgataacagagtttttaagaacacaggattttgtggcaagacgtggtggctcatgcctgtaatcccagcactttgggaagctggggcaggcagatcacttgaggtcaggagtttgagaccagcctggccaatatggtgaaaccccgcctctactaaacatacaaaaattagccaggtatggtggtgcacacctgtaatcccagctactcaggaggctgagccatgagaatccctcgaacccaggaggtggaggttgcagtgagctgagatcatgccactgcactctagcctaggcgacagagtgagactctgtctcaaaaaaaaacaaaacaaaacaaaaaaataggctcttgtgtcattctacctgagattaaatcctggtagcttttctaacctttatgtgtctcagtttctttgtctgtaaaatgggggataccaaatagcacctatctcactgggacatatgtaaagtacttggcacagtgcctaccataaagtaagagccagatacatgtaagctgttatcatcatcaccatcattgtctagcaccaatgcaggacaaattgccaggtgtggtggctcatgcctgtaatcccagcactttgggaggccgaggcgggtggatcgcctgaggtcaggagttcgagaccagcctggacaacatagtgaaaccccatctctactaaaaatacaaaaaattagctgggtgtggtggcgagcacctgtaatcctagctactcaggaggctgaggcaggagaatcacttgaactcgggaggcagaggttgcagtgagccgagattgcgccattgcactccagcctgggcaacaagagtgaaactctgtctcaaaagaaaaaaaaattctcattagacatttcttccacttccaacctccctttcacaaatttgcttccaatccctcaagaagttagtagcatgtcaaaatcacacccacccacttttccaaacaaaggttgttcagcaacctgctggcttctggttcttacagacaaacataaactgcctctcttacccggaatggaacctgcttattttaccagatggcctcattgactgtatgtagaagaaggaagctggcatttctcaagtttgaggatgctgcctagccagcgtcttagaacacagcatcctgtctctccttttcttacttcttttcattcctcatgactctctattccatgggctctgagcatcaagaaatcatttaggagacccaaatttgactcaatcaagtaccacgcatgccttctggaaaatcaagactctcattgattctgtccccattcagcctgataaacttcacagttaccctcattcctcccacgctgcaatttcttggctcctttggagcatgacccatgtgtaacatctggggattcgttgcaattttttggttcatctcctgggttatctgcagccacacagatatcccagatgttcatgtaagcagcagactttatttttcctcgcaagtttcctgcctaattgggttcaatctttaccaaccctcttttttcatagcattctatttcacgagctcttctttaaaagcttgctgttattgcctttggaaaatagaatgccatcatcttgaaaacctgccagtcaaaaatggggtttattgcttgcttctttatccttttcaccatgcacttatatgcattgttataatcagacccacaaaaggtaaccacatcgttggctattattgaacttttccattaatgggtaataaagaacccacacaaaatagcagctacacgaaatttaagtatttcatcataaacagtctcaggataattagaatggattaaattacaagagaaaatgcatttagttaatcttccctctaattaaaaaaaaaatccctagttttaagtaaagtgttcgtttttaaaaacatattttcattgtaatcagtaaaggagaggcctgtttggtccccagtgataggacgaaacatctgcaaagttgcatccggaaacatctgaatagctaccagccagtgtttttttggttttgggttttgggcaggggttttattattaaggtccttaaagaatgagtctggtcttttcccattgctgttaccaagggattctctacaaatagcctcattccatagtccatggtggcattcctttctgttctgagatcgctgatgatgtggttgactccccttgaccaacatgtgtcaagtgagaagattaactcagcagatgtttatatattctgaccgagctggggtaagagtcaaaatgaaactggtaggtgacgtgagaagttttcaagatagaacggacacgtactccagcccttcatgatgctattccaagacagataggactgaaatcaccctaagccctacgagtgtgtcccacaaataaggaatcattcacatcacctcaccaatttcttggctcatcccaactgcaaagctcactccacactttcatcccaagggcctctagaagtttccaagagtgtcttgcatgctcatatttaacccaatctgattttacaagcttagtcccttcattgaaacctgctgcctgagaaatacacttacagggactcctacagcactgcccctactgccaggatccatgccaaggttgtgttcccccgtgccagcagcaccattggtgctcacgctactgaagtcctgctgtgtttacacagtaaaggagagaacaccacactccccagctttatcaacgggtccaaagttcctttgagaagacaaaccttcactttttgccaatagtggctctcccatacatcaaggttttgtcccagcgctgagctgtcgaacagacaccacagagtcctttttgtatcctcacctctcctcacccttagacaggctctcaacccagggtagtggaggatgcttacaagttctttaagctcagccagtctctgaatcccagtttatactcagtcaggacccctaccatttagataagcggctcttaaagaaaatccttttctcttcatttaggttaagggttgccttcattttgagccagctcaactgcaaatgcaagagcccctgtgatctccctccttcataataatcgcatcccagttggaatggagaggggactgcttacatatcccctagactccaggttccaaacagtttcagcacagctctttgaggccactccatttaatcatgcatgagacccagcaccatgcagtgcaaactgaacatcacaaaaagtacgtcctgccagttcccagagaaagaaagggttaaccaatggtctagagacggaaagccccacataattgctgcccaggaggaattaaaagagctgagaatcctgggctatacattccaagtttagccaccacagcacctggtcaaattagcaatgaagttggttagaggttggcccagaagggtcatctttccaaagctgtaagcagagggagaagctctgataagtgtgaattgcatgtcattatttcaaaaagtatgctttaacttcaagagggattgccagacagccctgtctaggtgtctagaaacaatgccagggagtgggggagtccccaagattacaaaataaccacctcacaagcacagaggaaatgtttgtacctgattttattccaacaagttagccagctgtcaatcaccggtcatgctattgcatctgaaacacatcctgtctaatgacacaaaactcaaaacggtggcttctgctttgcagatagcatcctggcaacagggcaaggagattgtttccctatattaggtgtgtgtgagcccagaaagcctaaatgtcactgatgattgcaatccctgtgaataagaaaagagatggaagataccggaggcagtgtgagaaactagctttttcctattaatcccagcaaagcaggcaagtcaagttgggtcccttaagcatgttactgtcaacttcttgctatatgttgaatatgaactgatttaactttttgcttccatttaatggggccaagaaagatcagtatctattcacttacagacctactccctggaggtctgatacaggaagtgttatcgtatcctagagagaagcctagcacagacaacagtctacccaggattaagcagtttaaaatgcataatacacaacaaaacccactccaaactctcaatcatctcccacgttatgtttatagaatgtaacatcttttctctttgctattaacattctttgtcaatgcttgactatggctggttttatgcattccaagtttgaggcagtttggggaattatgtagcaaaagaattaaatgcctgagatttgggatcaaacaggactgccttcaaatccaccttccatcacttgcaagttgggtgacctttaacaagctatgtgtcttcaataagcctcagtttttcccgtctgtaaattgggaataataaataatacctacgacctactgtattgaggatttcactgatggagagcacttaacatatgcttgctactctgtaagtgttagcttaaaaattattaacaccacactttcatatctttactgtagtttcccaaatgtgtcttcacagagtgaatggctaagaaaattgtagagatagcaaacaacccaaaatttcccaaagggtccaaaattccagaaagagaagccaagggtgccacacctcatgtgtccacacaggtgctcgtggccctcctgctatttcactgttccaagacaagttccttggaacagctggtttctattccattcagcagggagcacagggagagagaggaaagcaggaagggacatggaaatggcccacttaggatccatttgctggttttaagaacatggtgttctaaacatcaataagaaagccacacacatcatccatggtaacatgtctggggtctacaccccctccatctgtttccagatgggcagtgataactgtattcaatcatttgggaagcattcattgagtgcctaacatgtgccagcacagtactgggtgtgacacatgagccacctctgtgtgaatatcaccgaggcagcaaggacaagaaagaagtggtttgcagagggtggtaatcatgggaactttagacctcagctgcctttttgcccacttgagactttgatgttttctaacccaagacacccttctcactgtttctatcaataatgtttggttaatttttcaacattgtccttgctcaagcttcccaaggaggtcaatataaggatggaggcctttaacttcaaatagtagtttaaattcatttgcaacacaatgtaattgcataaaagaaagtagtcaaatatcaaactgtatggatacacacaaatgactccctcataagtgttaatatcttccacaatggaggaaacttagttaaatcaaatgaaggtggcaactcattaaaatttgattttccctcctatccttttttatcttttaatcctctgtatatggcacaacttgttctgttaaataacactcattaatgaaatctcatcttctcttagctatatctattttatttattttgaaaaccttcagatgcttataatctaatttagttagattactgcttggacatctctaagtaggaaaactttgagcttttaaggtggaattactggcaaaggctagaagtgagagaaaccagttctcttcccatttccccttggtaggaggtggttgggcaggcctttcctctgtgaggggactgggcctccatttggttaatgagggcactatgaattaagtatctgtgttgattcagggaaggggagggagggaagagcctctagaaagagttgtaaactcaaattcccatacatggggtaggcgagaatgacgtaaagtgggtgcattcaacagggtgtaagaggccagggaggggtgacaaactggaaagtgaatgtcccacctatggagggcagacatgacccagctccagctgaacatggccatgtagaaatgcaagcctagtcttccccaaatttccaatttttcagtagaggccagatatttggattgttatgtatggtctcccaattttcaaatgctggcaagcaactaaaaatgtattaaaatgttgtgcaggccattcaaacaagactgggggccaaatggaccacccatctgtgactactgacacctacctccagggcaggattagtattgagtgaggaagcatcatttgcctggattgagactgggacagctttggcttctcttgtttgatgccccatctctccttggtaactggtttaagctggtgggagtctcattaccatgatacaatggtgatactttgcacttgcatggtgaattttctccaaggagctcaaaagactttgtgttgcctcagtcaacctcacagcaagcctgtgaagcaggcaggtagccattgcccccaaacacaatgagcaacaacagaaagtattttacacaaagcagctaggtggactcattggcttaaatccagcatctacactattggcaaatacagcattcaagaagcgtgggcaggatttcccactaatgcctcccctgccacccttttcagcttatcttccttccatctgctccaaatggcagctaagccccaaatctcaacaacaaataccagcaaaccaagccagtgactaatccctgttgtgtgtatgagtgtatacacgtctgtgtgcatgcgtgtgtgtgcgcccacctgacttcttagcatacccagcccggtacatctgcatccattacaacgtgtctctgcattggtcattggtctaatgccatgctctgaaatgctacttttgcaagtgtttaagacctaaaaacttcaaatggtaccttcaggattctggatacctgtattttgctaacggtgcctaataatttgtgctgcttgggaaccctgtgtccctttctcttccttatgctgataaaattacaactgtgaagtctttccctgacagagctagaatacggccctctctcaggctactgcaggttcataggagtggccatgtaaaatagagataagggccagagccgtgcagtggaggccagggacaagaatcttctctgagttgccttggatagaacacccgagaaagttggactgagcagcagtgactggggctcctccagagtcatcattttcccctgtatgactgggttcaagagctttgctacatagtcccgctgggctatgccttcccctctgcttgatggacatatgtgctctatgtcctgctctactcagagaattccttgggctttgcaggcatgacccagagagaagattccagttcagcagtgtaaacctgttgatctttttcccaggacaggacagcacaacacaagtattctgcattttctagattgccttgctcttccttctaaattgtctcagatcaggctactgatttctgggaacagttcccagcatgatattctactataatcattcacattctctgcatgcaggcatgccataaacatccttcagaggcagatgcaaaaccagggaaacacctggccattttaaatgcatgtgttggagagataactagacttactggcattggaactacaaaggctgacatatctaccagcttcccatctgatcccacaaatcagaacatgcttctttagagccagaggaaactgcctttcccagggatgaaaccttaaagatccagcagaaaagtttgggaagtgtctcttgatctaattggaacaaggaattgattaagcatccagaatcaagaatgatgtttcagctcttcccagtagatcaaaatcaatattgaatatttaaaaggtatatagatttaaaaagccatttctttatatacctaagtgtatagggagaaatcaacttttatttttgttgccttgggagaaaccaacttgtgctttccacttggctatgcagaatgaaaaccgtacaggctttcaaaggccagctgaggcttctctgtatcttcattcatcatgcctctcaaagcgtcagacggatcagtcataatttgtgtttttcacacacatacacaaacatttctattttggagcgattggagcgctatactggagccatctctgtcttagtagcctcaggtgcatacattccagaaattctaaaaagtcagagaagacacatatccccagtgctgccaaatccagtaaaaccgaaagagttcaggttgcatggtttacggacatcccagagaaagaatgtccattcaagcccaccaggctgaactagccatcaggtgaaattaactcctgactaaactaaattaaaaggtgaaactcagggaggcccaagtagacagaggtgctgatcattagggagtttggccactagagtttctactttcggccctgctcaggcttcagaagatgcagaggtgaaagtctagtttagctaagtgtagccggctggaccaacaggtcactttaagtcatgtctaactgatctcagtgctcctggaatggctttaccttgacatttaaatttcggcttccatcaccagtgagatggggttatgctaagtaatacaactttaaaatattttctgaacagtaaggcaaccattaaaacaaacaatttcagcgttataaagttatgtcttttaggagacattaaaatgttgctgatactgatgacagtgaggtaaaaagctgcaagccaaggctttgaggtgatagggcagaggccctgaaagcagcatgaggctgatagataaagaaggtagttgaagccaagctgagaatagcttcagaacctagaggcacacatggctgggggcattgccttttactttgtttttcctcccaggctgtggctttacccctttctcttaaaatcctgacaatacttcccaagaaatgtggtctctgacagaggcaactcctttggatgggccaaacgtggcacctagcagcaaaacatactattcagaaaagtcctaaatgatcccctgccttgaagcctggaatatagtagatgctcagtaagtgctggctggcttgagactcccctgtgtgtgagccctctccacccacctttcactgcccaagtcatttaagatagagaaaatggagaaccacactgcatctaaaaatagttggggagggaattacatgaatccactgtaagttagcttcaaaaatactgtgcttcctaggtgctagaatagcccatttttagggagtcaagagctggattcagagaaggagtagccaaggggctcaccaagtaaataaagggtttctcttgagttttggagcattcaggcttgaacaagggattttttggcctgtgacctagtgcataatttgcagtgggggtaatatcacccccaacacagtgaaaaattgttctaggggtagatgaaagtcttactctttttttttttttcagaaaccacatttattttggggggttcatagagaatattatactctcaaacaatactttataaaaattacttagtatgctatatctattctgtttgttacattttatatttgtactttctttcctaagaaatatactgctgctaataatagaaagtggaagaaaaaaggcataagcaggcagaagtggggggaaaaaaccctgcaatctttgtggcaataaaacattagattgcattaaaataacctaaaacgttagatactggccccagtgcctgggcgcagaactttgttgaaagggtattccagtggtaagatgaaaataaatcctgtgtcatatatttgccctatagcagaaggagggtggggtttaagctcaggaatcacagcctaaagcacaataattgtctggtttcctcaaaggagtttgcaagtttcacataccggaagtgtagaaaggctgaaaggagaaggtggggcaagggcatgagagtttctttcaatgataccagtataaactgtacgtgtctgagctaatattaactagaaatttgtctactacacttctttttttttttttttttttttttgagacagagtttctctcttatttcccaggctggagagcagtggcgcgatctcggctcactgcaacctccgtttcccgggttcaagagattctcctgcctcagcctcccgagtagctgggattacaggcatgcaccaccatgcccagctaattttttttttttttgtatttttagtagggacagagtttcgccatgttggtctggctggtattgaacttccaacctcaggtaatccgcctgcctcggcctcccaaagtcctgggattacaggcgcgagccactgcgcccagcctactatacttcttttaagtctttttttttttattattatactttaagttttagggtacatgtgcacattgtgcaggttagttacatatgtatacatgtggcatgctggtgcgctgcacccactaacttgtcatctagcattaggtatctctcccgatgctatccctcccccctacccccaccccacaacagtccccaaagtgtgatattccccttcctgtgtgcatgtgatctcattgttcaattcccacctgtaagtgagaatatgtggtgtttggttttttgttcttgcaatagtttactgagaatgatgatttccaatttcatccatgtccctacaaaggacatgaactcatcattttttatggctgcatagtattccatggtgtatatgtgccacattttcttaatccagtctatcattgttggacatttgagttggttccaagtctttgctattgtgaataatgccgcaataaacatacatgtgcatgtgtctttatagcagcatgatttatagtcctttgggtatatacccagtaatgggatggctgggtcaaatggtatttctagttctagatccctgaggaatcgccacactgacttccacatggttgaactagtttacactcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgacgagcattttttcatgtgttttttggctgcataaatgtcttcttttgagaagtgtctgttcatgtcctttgcccactttttgatggggttgtttgtttctttcttgtaaatttgtttgagttcactgtagattctggatattagccctttgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttagatctaacgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgtggcgttatttctgagggctctgttctgttccattgatctatatctctgttttggtaccagtaccatgctgttttggttactgtagccttgtagtatagtttgaagtcaggtagtgtgatgcctccagctttgttcttttgcttaggattgacttggtgatgcgagctcttttttggttccatatgaactttaaagtagttttttccaattctgtgaagaaagtcactggtagcttgatggggatggcattgaatctgtaaattaccttgggcagtatggccattttcacgatattgattcttcctacccatgagcatggaaggttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctaggtatacaatcatgtcgtctgcaaacagggacaatttgacttcctcttttcctaattgaataccctttatttccttctcctgcctaattgccctggccagaacttccaacttccaactcttttttatataaaacgtgcacatatgacataaacagctatgtagcatatctttggcattaagggagaggaattagaggggaaaaggtctaaaaaggtttctaggatgggagataatgaaaaaaaaaagttgagaaatattaacctggtagaagagatgatagattgatccatttctagagcctcaacagaagtggcctcaagcatcctcagggaagacactgtttcttagaagactctgccaactcatgcttctgtctttatcgcccctgcctgctggctcatcttataccaaatcagtttggactgaaataaccaggcaggccaaataattgatttggtgcatgtttttaatttactgatttactgaattcccttttcagaaaataccagctaacattattgagtactaatgacagaaacggccggtcccattgctaagttctcagcatggctcctctcttctaatcctcatgtcagttttgtgaggtgaatactgttagcatcatcatttcacaggtgacaaaactgactcagagaggttaagcaatgtgtgaaaggcttatctgtcaatgagaggggccggtgagtgctaaatccaggtttacttgacagaaaccaggcttaatcattgcactttgcccccaggtagttgcaatggggttctggggagtccagcaatgaaatcagagaatatgggcatcaggggacccccccttcacctgtcgggaaagtcatcctctgcaggagtgtgtccttggtgatggaggacaattccccttttcactttaccagtgccccctggccaaagagtacactaaataatctccgattccaaaaatgactcactgctactccgcataggcgtagttggccaacttccctaaatttaagttgactttctatcagagttcacatttccaccaacttttcattaaattaattattcaaaacaattcagagttagcgttctcgcagcaactgtaactctgccatgactagattaaggcgtaaattgaacagcatgttttgcaataaagttaattttatattcaccagagaactgagttatagttgctgtgggaaccatcatttcgaatctcttgactttggtgcatttaaattctcaaccacagcgttgcacacagtagcatattttgcacggacgtttaatttgcttcacaccacggcctggctatcctgaacttggaaggcctgtcagaaataaacattgcagctttctagctttcccagccttctacttatcctatacctatgacactatacatagaaacagccaagaaaccaaaatgattccaattttatcttgaaattatctgtttgggggaagtgaatttccttagaagaactgagtctccggcaatgtcaactaaagcaggcaatgccattgcttttgtgtgcagccaggattctcatccaaggatatttttggttctgcgctgtattattcagtacacatggggtgacctctgaaagctccaagtccttgcatgtgccattaatcaagcaggcatgcacagccatacatcagaacttattggagctccggaaaagctaagcaacatttcccagagccacataaaacccgagcatccctaaatcaagacacattgcagggcctctaaaaggtacgttcagcagaaccggaatagaactcaggctaaatgctggtggtatggaattgggaacatgtaccaagtaaagacagaggcttgtttggaaggaatagcagaggaagatgaaactctgagatggttagagatgcgagcattccatccacgaggattatcgatttttgtagctttattggaaaaatcagtcatgctttctgcctcctgggaattgctctgctgcaatttgggagtgtgtacgtgtggaaactgcaggttagcagctgagtaccagctcccattcactgttcaattatccatttagctagaatgtgacttagcagaaacagactgctgttttgcatgtgtaagatgtatttgaaaggagggatttttgtttctctgtaaatgagaggatttccaaggagaagctcttgccttcctaagggcacactcattatgcaaaattgaagagtggcacctaacaaaagcataggccagattgttggaattctgaataccattgtacaagctttcaagaaacagaagtctcttatttctcatactgtgccacacatgaatgtacctcctgatcagaactactgcaaaatttgtagataaagaccctgtaatgatcagtggcctccccaccaagtccttgattagctaaaaactgtttaaaagaaagtttcagagagcaggatatgttcacgataattcagggttccctgggccacgtggatgggatgggtaagtgatagatggctttagattcatgataaaggtgggcaggggaaataccatgccagtcagagcaaagaaaaaagagtgaagaagcaggggagaaactggaatgttttattgcttctgtacaaggtaaaaagtgccataaaacaatataaaatacgggctcctctatgaggtcgtttgacacttactgttttgtgaccgcatcttcacaggatttagacagatttttggtaaggaatgtttgacagattaataaataaatataaatatatatgatagatagatagatagatagatagatagatagatagatagatagattgatagatagcacaagctttttaagcatgtctgagtgtcccattcgggtgggtcaagctggcctatagggttaaagagaacgcaaaggaactaaaagaccaggagtaataacctgggagcatgcttgggtggttcaaagagaccctattgccaagaattagatgaagctggccggatgaatgcagccttaaggtctggagtcgctgtgttaagaaaggcgaggcattcatttgctggagctgttcatatgaggttgtctgccctgaccttgcagatagagctgctgtgactcaatggttctctccgcgtctccactctcagccatgtctgtcctgatgcggcacgatgctcccctgtcaccctttcccttcatctccacatgttatttttagtatgaaaaagcaacttggagaggagggcagaatcctcacaaaatccagcttcagcaacctcatctgcctgctagttccaaccgaggagtctggtttgctgcatcaacaggggtagttggtggggagtgctgtttatagactgtatgtctaattgtctgcttttgtgtctctaaagccttccctttccgaggcatgttaggaaaacagaaacacatctagcattagcggtgccacatagagtcacagagcaggacaaatttgtgccctgcccaagcctccaccctggcttacccagatggtcctgatgggtccctgctggccagccttctagattctgtcctggccccatcctctctctgttcctcacccagcacaaagggagcctttaaaaactcatgtcagatcaggccactcctctgctcaaaagcttccaatgacttcttttcactcagaataaaagcaatatccgtacagtggactatgaggtcctacccctcactcactctgctacagccacacgggcctcctctctgtccttccaacaccccaagcactctcatgcctaggggctttgtacctgcagtttcctctgcctgtgctactatctcccaaatattggtatgatttgtttcctcccctcctttaggttttttgctcaaacaacttatcatcaggggcttccctgaccatcctatataagacagtcacctccatcacacacaacccccttgtggtcccctccccctacatttccctaaagcagtgattaccatctgacataccatattaatttttattgtttattgtaggtctcctcactgtagaatgtgagatctttaagaacaagactttgtctctttcattgactactgtatgccccttgtctagaaactacccggtgcataataggtgctcgataaataattattgaatgaatgaaagaataaactcatgagtctacagcagaaatcagcattttctaatcattcagtaaatgtttgatgtgggattggtatttctcccttggaggtccatttgtcccctgattcgcacacactgaactcaaggattagggacagggcaggagacagaagccaacactcttgacagggagaccaccccaccactcaggcaggacgccatgcgggggcttccccaagtaggatcctcatggatcctattctcagctttagaaatcccattttgtttctgttaacagagtggatcaagctctagactgactccgtcacactacccaaattcccatccaaacctgaaatggccattcagtaattcacagtgaggaaattctacatctcctgctcagtgtattctctccctaaagggaaatctatatgggaaatgaagttaaaagcagaagatttcttggggaacaagaaatcaaagcaagtaatatgatattctgagtctgccttctccctgtacagtcctacctggctaggggggcgcaaagtgcatgggctgagagttgcacaggcctggattcacaccctccctttaccacttgcagtgattatgaccctgggaaagttaattaacttctctgagcttcagctttttcagccacaaatgatgataataatatgtatttcataccatccttgaagtggctcagtgaagtaacaaggatgtgaattgctgagcatggacaaatggcaggtgctgttgcttgcctcccctctgtcaagccggacactctcacccgtgaactgaccctggctctctcttgctccaccacctccctctccacatcccaggcagactacccctttctgtgggcatgcttttctgagcctggttgagatttctatgccctgcgatccttgataatgtcacctcacacaactcttgcgttttaaggggagttctattgacaacttgtcgcatgcattatgtgcagatcttactcacgtaactctcaggaaattacctcatttttctcattttcatttacgtctttggagggcacctttctggggctttgctgtattgactacactgatcctattttaaataatagcattcagtccctcctcataaccaattcaagtgcaaatcaaaggctttcctaaaccacgcacagacctttctgccatcattggaggacacttttaataaaaacaacaacaataataacaggtatctgttgtagaatatttattatgtgccatgcatcatggattctctcatttaaatgtcagcgaccctctggggttctattgctctggttttgcaaatggagaaactaaggaattgaagagcttatgatttttacccaagatcatgcagccaaagggtgaagccaaggtttgaacccaggctgcccagattcagagccactaccttcactattccaagtactgccacatggtgactgaggtgacctgatgcagtggccccgggcagcagcagaatctgttggaagccctaacataccaaaacaagtgacttggtataaaagtctgcaccctctttcttgcccttgggggccttcatctctgtccccacctctgcctctgggacagccaatgaaaagagcctagtcctcactccctgttttcaatgatgaccaatgattccaggctgcctcttggggcacaagattttcagtgcaaaaacttggatcatccagggcaaattggaagggttggtcaccccagttgagaacaggaactatagagccattggctggtgtcaaatcctggctccaccatgaacccaccctgctactttggccaaattacttaacttttccatgcctccatttcctcacctataaaacaggaataatcgttgtacctacaccgtagggttgttgcgacaattaaatgagctaatgcatgtaggggatctaaaagtgccaggcacagagaaatgtccctgtgaggggtttgctatttttgtggctattctataaaaagctttctaaaatccagaatttcatcctggggcagattctttgcctagctcttttgagatctattagaaacatttagtgatttccttacatttcctgaagttacactaggagcaacaacaacaacaacaaaatggcaatttatggttgacctgattttacactagttaaaagagagccgtcaaccctgcagaagtaacaagtccgtgcccacaggcctcctcggtgttatttgtatttttatgaccctcctgtggctataaggatgctcagtgggtgtagaaattggatggttaaaaataacaaataagaaatcaaagtcgtgctttgtccctatttccatactggtaggtaccacattcattatttgctggacagctgtgggaataagctgcacaaggtacaacaacttgattcacctccaaaaaccaaattaaaccactggactctcttattattgtcatccctacctttgtgtaacacttgtcaccctcctaagctaccaacatgccttctcttctactcgctgggtaccctagtctgcctctttcagtccagaggtatctgcttcttacaagttgaaaggcacaaacccacatccgcattcatacacagcccctgtcatcagcttggttttgaacgctgggctgcaaccagctgcttcatttgcttagagaagtgtcatccttccagaggcttggggtgtggcctgtgggaagcttttccttttacctggctgttgaatcaagaacacagtgaagcagcaatgaaacaaagcacagtttgtttgtttttaatgtattcattcaacagatatctttaatgctctagggtgggaattaggaaaacagccatgaacaactgagccaaagcctttacacttgaggggtttggaggctcccaggaagatggacattgaaccgcttgctctcatcatccattgcacataggaatcacctgggtagcttaaaaaaaaaggaaagaaactgatgtctgggtcgcttcctcagagattgtgatttaattgggatgcagtttaacatgggaatttttcaaggctcccaggtgatttgaaagtgcggcccagttaagacccgttgctttaaacaaagggttcattagaattatgaggagtgctacagagaaggggaaggtggtgctataaaagcatgcaatggagcaggaaccctgagctggaagccaggaaagccattcctaaacaagggccagctgagcacaaggtgaatggctttagccaaagtgggtgcagggagcgtagttcagagagacacatctggaaaagcccacaagaagaatccaggctacagagaacagagacaaatgtgacatgagaagagagaaatgggcagggccagataatgcagggcctttgaggcccttttaggggtttgggacttaatccgaaagcagaggctttcacattgagcaggcgtctggatcccgggggcttgttataaatgcagacggctgggccccatccccagaggttctgattcagtagctcaagaatgtgtatgtctaacaagttcccaggagatgctgctgctggtcccaggaccacactttgagaagcactgctccaatctaaagcaatgggagaaactcccggaggatgttcagcaggggcatggcatgagttggggtgcgttttagcaacacggtgctattcacccccataactctcaaaggtaatgttccagggagataaagcaggcacccccaggaaagcacaggccaggctggactccagtgcaaccgggtgataacaattcagtcagaattcactgagtaactgacgtgggatttccctcccaagaagagctattttggttactgttgcctaaattctccatttcctcacatgatcacctactttaaaaaaaaaaaaaaaaaaacagtaagagcttgaaacatcaaaacaccaaaaagtaagatacatcttcctttctccttttttttgagacaaagtctcgttcttttgcccaggctggagtgaagtggtgcgatcttggctcactgctgcaacctccacccacccagcttcaagcaattctcctgcctcagcctctcaagtagctgggattataggtgcctgccaccatgctctgctactttttgtatatttagtagagactaaacaacggggtttcaccacgttggccaggttggtctcgaactcctgaccccaggtgatccacccgcctcaacctcccaaagtgctaggattacaggtgtgagctaccgcgcctggcccctttctcctctttattcaaatgtgaaaggattgtttttactgtttttacaagttcatcatttttctgcagccaaggctgagcctactgccttccttgtcccatgcagacagacatggtgctgatcagtgagaatccaggtgcatccagaaaacatgcagcctagacagctggaggcaaatttatatgacctcatggaagctctgctgtttctattgctgttggggttgtggggagtgatttctgccttaggagcaaaagccagccaatagaccatggaaaggatcactggcctcctaacaccccaacccagcatcccccatacttgcatctacacaaacccttaaagacatacagacaccactgaaacaaagaggaacatctgcctctctcaatttgccacgtcttttctaacaaagcagagtcagctgtggacgtgcaggttcatggctgcgtgtccacgccatttgtgcctagaaacagagtccccgcacagctccctcccgcacacacgggcaagcaagagggacaatccctgccgttttccagagaccagagaccagggtgattctttggcagccggtcttccaaaactagttggagattttccccagagcacctcgaagcatcagattaattttctgagcatttgccactgctgttcagtataaatggctacctgaacccctggtgatccccgatctccaacacctcagctattttcaactacaaagagctctggaatgtaatggcagactctattattaaataatgtccagtgtatgtgtgctctttaattccaacaatgcacagctccagggaaaacaaaaacaaaaaacaaacaaaaaaaaaacagtgatatttaaaacagttggtgaaagggggggggggtccataattaagttaatattcaaaagcacaattcttcccaagagaaagggcccccatgtagtctaccttcgtgtctcctgcacctcataattgcccttagctccagtgggttttcttctcactcagcccgtccaatgtggtattgctggagttttggctggtggtcattgggagaatgagaatttcttaggctgtgacacaatcacacacggaggacacttgatgaaccttcattttttaacttgaaaaaggatgggttcttgtttttttccctgatctcagagtgaggcaaagagaaatgacctacacttcagcctatgtgctaaagggaaagcttaccactaactatgatagctgtcataacaactatatagacactgacaacaattagtgccactatctactgagcacttacaatgtgccaagctctgttgaaatatttagctttatcattccatttaatacctctggcatctgtaaaaaaaaaaaaaaaaaaaaaaaaaaaaaaaattgtaagtacggtcttgtgaccatccctaaattatttgatcagcacatatttcttgaatgtctgttacgtgccaaccgttcttctagaccctgagaatatctcaatgaacaaaagaggcaaaactttctgcctttctggaagctgtatgctattggaagagaaaataaataagattaacaagtaaaatataccattttacaaacaggctgaggctcagagaggtggatctaccagcccaagctcacacagacagtaagagagacatccagattccattcccagaactctgactccaaaccaggttaaggttttccccatagttaaaaaaaaaaaaaaaaaaacactttttttttttcacctcagtttaacttaggatgtaagttctctcctgatggtctcttgaagcaagcagggacatctggcttctctggctttcactgtcatctgtctgcatttccatgcagcctgttttatgtttttacttgcatttccatctggatagggtattgccctttatgcttttcttaggcatgcttgatgttgaatattaaaatcctatttctctcttcgtacccctcatgcattattagccacttatttctacctttaaattgctgcacatggcagaacatttcttgatgcttttttagaaaagccttttatggtaattatagctttcttcaagtgcatttatttttccctttttaccgtgctgtagacattactttgttcatgcctaatttttgttaaggcaaaaagcctgcctagctggtaactgtgtggacagacttttttttttctagtggttggaattttatgtgtagaaccttggaaactctctcatttccactctgccaaaggcatcggattcagccagagttattcgttcatcatttcccccaactacttattgaatactggcaatccaagagtaaacaaactagacatggtccctccctgacagttttacaccatagcaggaacgcctggggcagccgttcggttcacagtaggggcaccattcaaagtgtaggtaatgacaacgggcacatttattatgacacttttccagcaggtgacagtaaaatgtcttaaggaagagctgctacatggcctagcgagcatcaaggaggtaccagccaattgtgatacagcggggcgggtagtaccacataaaggaaaggataaagatgccatgactggtgctgctggcatgagcttgggagctttggaaaagcttccaggaggaggtgacttctgagtggggatttgaaggatgtattgaagttagggaggtgagaaaagtgaaaaggaaaggccgagtggcttaagtctaaccaaagcctaaagtgatattgagataggctgatgtggtaagagtcagttcatatgaagtcagcaagcccaattaaggacttcagactttacccatgggtcaatggaaagctattgaagtgtttccagcagtgtccagaatgtgagacatggatgatggtacaagactggaggcagggagaccagttaggaggtttcgacaagcatctggaccaaagatgagggtggctggggttaatgtggtggcagtaggggtggaagtagagcacagattccaagatatttaggaagaaggacagataggagttcttgcagttaagaggaaaattaggcagaacttggttggaattagatagaagagacaagagaaggtaggagaggaggggaacaattaagaatgcctccaaggtttcagtggtgggcaatggggtagatacctggatgtgccatgcactgctcaaggggtcagagtttgtggggaggaaaggtaaagagtcagaattcttttgagtttgaggtgcttatgagtgtacaggtggggaatagatggctatgttgagacgcaagttggagttcaggtctagaggtcagaagacttgagttgaagatttaggggccatcagaatataagggtgtgggttgttgtttgttgttgttggtgttgttgttgttgttgttttgagaccgagtctcactctgtcgcctagactagagtgcagtagcacgatcttgactcactgcagcctctgccttccgggttcaaatgattcttcagcctcagcctcctgagaagctgggattacaggcacctgccaccacactcagctatcttttgtattttcagtagacatgagatttcaccattttggccaggctggtctcgaactccggacttcaggtgatccacccacctcggcatcccaaagtgggtttttttaaatcccaaatttcccatcagctctctctctataggttggaatgtgacagaactagcccattaatatcactggcgtccttaaaaattctccctgggaagaggacttttgatctcagagaggaagtctctattatcttctcatgattctcagaagagtttatagatatgaggcaggcagacagaaaagatatagtacgccccgattgtttttattcattcaagcaccttctatgtgcctaaaaccaggccaagctctgggatccaacagcaaacaaccaaatcttggatctcatgggggtttatgtctagggctaggtttctcaaccttagcacagttaacattttgggctgtatcgttcttcattgtggggcctgtcctgtgcattgtaggatgttgagcagcatccctggcctctacccacaagatgccaatagcaccctcctcaaattgtgacaatcaaaaatgtctccagactgggcacggtggctcatgcctggagtgctgtaatcccagcactttgggaggccaaggcaggcggatcacttgaggtcaggagttcaagaccagcctggccaacatggtgaaactccatctctactaaaaaaaaaatgtgtgtgtgtgtgtgtgtgtgtatatatatatatatatatatacacacacacacacacacatatatatgtatacacacacgtatatatatacatgtatatatgtatatatacacatatatatgtatatacgtatatacatatatatatgtacgtgtatacatatatatatatacacacaaaaaaaatcagctagatgtggtggcatgcacctgtagtcccagctactcaggaagctgaggcgggggaatcatttgaacctgagaggcggaggctgcagtgagccgacattgcgccactgcactccagcctgggcaacacagtgagactccgtctcaaaaaataaaaataaaaaataaaaagtgtcttcagacaatgccaaatgttttctggagagaaatagggagacaaaattgccttagttgagaaccactggaatagggtcatgatagaacctttagtctccaggcagccagctctctctagctccataaaagaggaaccaaatgggtatgctttaaggggctttatattggtggtcttggagacaggcagtaccagcctgaaatccagaagacttcctataggagacttcttgggtgccccagtataagcccattagcccaatccaacttcggttatagcatcctctccagagaaaagcctctacctcatacccattttgccctccagactaattacttcctaggttttgtttttccttaagcagaagctggctttgcactttacaaacacaaaggatcacttcctcagaaggccaccagtagaatgaacttgtgctggggttagcttggggttgcctagcaacgccatgcacctaccagggctgttctcttcctcttcaagctaaaagcaaagtcctgtccgttaattaccagctgccctgaaacttctcagagatttgccagcttcctacttttcttgttttcatcttcctcatgtgatgtggagaaaacctgctactgtggtctgtttatttcacttcagttggtctgcaggggcaggttggggaggaagcaagagaggaagagaaggggttaaaaaaaagcctcattcaatctagaaatatatgtattttgagtgcgtatctctgactgacacgctagtgttttttgcagatttaaatttgatgtagcggacgtgggtttcctatacaatgaggcttctgttgacacattggacatgaatttagtcagacatgagacctcaaagtagctaaataacaaagctccaccaaatagataccatgctgagcaaatgttggtaggtctgtcatttagtgtattttccgtgatccattccccaaaactctaccagtagaaattgttaaagctgaaggtagctggaggttggagaaattctcttttccttgagaacctgtgaaatgtcccttggtcttttcctactgagctcattttgttcctgcagaaatgtttgtggcatttctctgcaactggggacggctttccctccacacaccgtctcacggtatgaagtgaacaggggttttccaggcaggaccacagtcaggaaaagcatggaaatgtgaatctgggctttgtgaggagaggtgtgtagaccaaacaagcctttccaggtgtgcaaacactggtgctttacttgcctgctggacttagtgccaggctgtgcaacaaaagaaaacagattccctggtaagagtctccttatttgccctctcaagacagcttggcttccctagggactggcccacataggtctcttctgttgcatgcactccttgctcagatcctaatccaataccaccttctggaaaggatgagaggcagcaagcactgaagagtgaaactcctcttcctaaagaagtaaagcttaattgtatacccttgagaccttgcttcttaggaagatgcctttaaattcccaccactggccaagcataatgcttcatgcctgtaatcctagcactttgggaggctgaggctgaggctggagggtcatttgaggccaggagttcaagactaacctgggcaacatagcaagacccaatctctactaaaaattaaaaagaaaaaatcgctgggcatggtggcacacacttgcagtcctagctactgaggaggctgaagcaggaggatcactcaagcccaggagttcaaggtgtcagtgagctatgatcatgccactgcactccagcctgagtgagagagtgagaccctacctcaaattcccaccactgccatatgcatatattaggtttatcagcattctcataaggggtactcaagagaaaagaaggaagatgctaggtgaaggcctctggaacaccggagagaagagcaggggagatgcatgcttttgatccacaagatttgggccaggaaggtttcaaatcaattacctccatcattacaaagctttttatcctctgccatggcccaatccagcctgcactttatgtagtttaaaaatagatgtagaaaaaaatggaaacagagatggtggcagaggtagagataggactcgagatagatattcaaggaaattactttctggggaaaagtaaattaatggtcactggggtatatttaaattaagcaagaaaacatatcccaagtgcacaactctgcaaatttactagaagtcatcgcattgtacacttaaaacaggtgaattttatggtgtgtaaattatgccccaacaaagctgtgaaaagaaagaaaaatgaaaacatgtctaggaattcttgccagcacgtaggttttgtgagtgtggccacatcctagtagttctctgcttctctcctacctgttataaagagtcacggaggctctgctagtgagacctttcccatgtctctttagtgtacctcctttctccacttttctcccccagtctccctttgtccaaactcaggtcaggagagtgctggctgcaattgttttgggtcctggagtaattagaaaattacacaggcagccaattttgcacagacacgtgagcgcatgtatacacacacacacacacacacacacacatcaataaaggaaaagaaatccacaaaataagaactactcctaccccaccacccttccccgagcacatatattttttcttctatctttccccaattcgtggcacccagcatctatccactccacagccttcgaatcctgcagtatttttaaattgtgccataaatacgttgagtgataagcagccaacatctttaagtgccccttaaaactaaatattacctgtacaagcatatgaaaatagcccagcagaaccatccagttttcagtcatgagaagctcatgataatcctatgtaaatatatctttaaaactctgaaagatggcgggcactttgcctccatcctgggttgatagggaattttttctcttctacagaagagcacttcttaaaaaaagagagaaagaaaagcttcttttcagtagcatcaatcctgagctattggctggaaaccacagcctagctagtctggttgtcagctcagcactggtttagttgtctgggatgtgcattgaactccccgctttgggaaggttgcctctgacctaggtcagttgtcactggggatcccctgcatctgtgaccccactgtgtcttgctactgcatgcgttgcctgctcccctgactctgtggaaggcaggcgcgggccccactgtgaggctggcccagcggctgccctgcggccttgctcccctctgcatggctcccctgcttccccagcgcggcctcacgtccctccttctcatcctctccatttctccaaccagatggctgccctgacttgtgcaacggtaacgggagatgcacactgggtcagaacagctggcagtgtgtctgccagaccggctggagagggcccggatgcaacgttgccatggaaacttcctgtgctgataacaaggataatgagggaggtgagcacgcgtcttctcattcccagcccctaagagcagagcgttgtccatgcttttgtcataagtcatttttcttcggaaagacctcccctgcactattgtcaaatgttgttgtaacattttctttgaagcaaatgcagcagagaacaggtgtccttatgccaggggggatctctgggagacaccggctggaggcactgggggttgatactggctgagaattcccaagtgcccattgccacataaaggtggctgggccctggcgctgccttcagggtcaccagtcctgccagaactttcagggctgcggataacagtcggtgacaatgaggatgacaatctatgcctaacgcacaaagctgtcataagcaatgcctgctgccttcatccttacagccctttgagatgtcactctacagatgaggaaaccgaggcctgaagagtgattaagtaactttttcgagataatccaaccaccattagtaaaattgagacccaaacccagctgtggctccaaagcgtcttttctaaccagtagttggcaaactatggtccatggaccaaacctggcctgtaagctaaaaatagttttaacatttttaatggttggtggaaaaaatcattaaaaagaacaatatttgataatgtgaaagttatgtgaaattcaaattttgatgtttataaatttttaaacagctttattgaggtataattgacatataaaaagttgcgtatatggccaggcacagtggctcacacctgtaatcccagcactttgggaggccatcaccaccatcaaggccataaacatgtccatcgcttcccaaagtttcttcctattgactgaaccaagggttgggctgcttgttttcaaggtccaataacaagatgcagacacactgggaaagtaaccagaaataaactctcccaggtacagggagaaggccagagataattcaccaggccatctctaaattacaaagttttccagtgtgtatataccttctaagctatgtgtctacatgtaagtgtgcattcatctgaagacacaaatgattgattccatctaatctataactaaggtttgggtcctggacaccttcctccagagcctcagtaaatttgcttagcctagatgggtcctggtgccgggggtgattacccttatcttttctccagctaaggtgtggaggtctggggagttcctttagactcccagtaaaacttgtttaatcctaaatgggtcctggtatgaggagcatgagaatttcttcattatcttgtgaaggttcaaggcccaggaaaggcctaggcaagactcttggtgagcttttgttacattccagcctttgtgtaagtgcgctggctctttccgcctttaatatttaacctaaccattcattcagtgccaaaacagttgtcatggaggcctgcctgttcagctggtggtgagacctggcctgccacactgctctctttgtgattattgtcttggggtgattttttggttttaagagtttttgtggtaagaacattttaacgtaagatctaccctcttagcaaattttgagtgtacactactttgttagccatagatactatgctatgtgtagatctccagaatgtatttatcttgtatcgctgacactttgtaccccttaacccacacctctccatttattggaatacagccatgcccatttgtttatgtttggcctagggctgcttgcactctccatgtcagagtggagtcaaagcaaaaaccacttggccatcaaagcctaaaacatttactctccggccctttacaggagaagttttctgtctcctgttctaaacctctgagctgaatttccccatgttccttcctgatggagtgctaagattctggggctaaatgaggttgggttagcatgtgggccacctaatctcctaagaatactgtggaatgttccgtagacttcagtacaggtatgttatccacccccatcaaaattactaactgatcagaattcactgggggcagaggttgtttcagagtgtaggaagatccatgagtccaatcatttgatttaacaaaaatgtatttagtgccaccttggaccagtcattgaattctagggatatcaatgaccaagtcaaagtcagccactgccttcatggccccaacaggtcctttcagtggtgtccagagcagggtggaatccatcggggtggtggatgagagtattagatattctatttttattttttctcatcctcttaatgggtattttgcagtttccataatttatgattgccattgtgcctgtatgtaatttgtaaataaacagatgtacatacactgataggagtacacaatcaaaacagtttacagacctgatgtggtttacagagctcccattcattcattttctctttcctgaaacagagccaaagagaagtcactttaattcattttttaacaagttaaggcataactacataatgcattttttttcaagtcagaatcgcacgacttttgctggtaaggttcactgcttttccttctgcctccctggcgatttcattgagcacagcggttgcttacagatcagcttctacttccagaaaggagctgctctcctggctcccttccccgttcctggtgtcagcagctgaaagcataacaaatggctggaatgccacacagaggggagagaggaaactctgggggactgtctccccagcataccctgccttacccacctccctccccaccagccctacccctgatcccagcttccacccggccaaaaccaaaatcctgaagtgatggagctaaaagaggctcacagggtccccgggcctaagggttgcccaccaggcacaattcaggatcccccccccaaccccccccccccccccggctggcagagacaaagcagtccaaaggcagggcacaaaagcaaatgaggcagtggtgattatgctaaagacaataatggccttgttacgggaactgttaaagcaaacctcccaaggaagtaattaaccacaaagaaaaaaaaaaaaaaaggctgcatggtgtttatgaaaagaaactcccagttaattcagagttgcttatgtcaggtgagaggggtagacaccaattctctctcacctggcataagcaattcacaattaactgagttctttttttggaggtgattcctcagtgtagagtatcctttttatggttagtgacttccctaggaggtgtgctaagcactttgctgtttattgataaatattaaggttgctcctcatcaactccagattcaatcctgcagcacactaattatatcactctttttgtttggttggggtggggatgggagttctgccctcgtctctgtcctgcttcgtgagttatcaggaagggctatgtgagtttataaacctggcagtgggtcagagaggcacccgggcagaacatgaatgcagacccggggagcagcagcaatgaacacatttgttataaatttcatgaacgagcaaaataatagagctatctaccaaagtggactggaaaagacaaatcacttttccatctagaaacactctactttaaaaaaaagaatctgtttgaagggatatgtattttttattttaaactgagatagatatagatacaaataacagatagagatatttgaaacctttaacagccttttttcaacctgggttcctctatgagagaattaagccctaatactttatggccactagtagttctgaaacttcagcatgcagcaaaaccaccttgattcaacacagagtgctaagccctattcctagagctcctgattctctaagtctggggagggcagtgcaagactgaatttctagtaaatatcccagcagtgctgacgcaggggacgctgatgcaggtcctctttgagaaccactgtcctaagccatccattctatgtaatgaattaacttctctcctatgcatctagaatggtactggataaaataactcctttggaagaactgagaaaactttcactcaaatatgctctgtagtcagcagtgttgagatgaaaatccctgttggagaaggctgccttagaatatccccaccaaaacagtttatgccaactccctgccttctcacccccttggctttcaaagtctccagacacccccagtcatgtgaccgccactcatgtaacctcaggaagcaatggctgattctgaagggacaagccacacctgcccatggccactaaaaagaagtggaaatggttcagacagacacggcagctggcagactgtctttttaatagtgagagatcttcacttgaactgctcaccccaatttgaaaaagaagagactcaaagaaatatttttgcttacagaagacaaataccagctcattaaagtctgagaatacacacaacatgtgcaccaagtgacaggcggataatatttaattatcaccaccaagacagaggtgtgagatttagttcatcacagccaggggtaggagagagggtgtaggtttcctctaaaagtgggaactgcaaggtgaggaggcgttgttagactgtctggcctggtgagacagtccttacttcttccccactcccctttatcaccctgaacttagagtcaggagccctagcccttccatcatttcaagccggcatcggagtgagtctgaagctcctgtggaatcctatgagatgctttctcccatctgtgggcagcggtgacagtggagaccaagggaggtgatgtcataaccacatcacctggaggtagggtaggaggaagcctttttaggctgagcctgtcccgtcaccccgcatcactttcttccttactaaactaggagagatgtcttttcccctcgttccgtttcaacacagcactgaaagatgttttgcaccttctctttcatgtccctggtttctgaacaggtgacactgtatcatcataattgattgagggcttgggcttcagagtcagcctttgtattccagctctgcaagtcactttgcttctcaaagtctcagttttcttatctgtaaaataggcatggcaatgccaatgtcactagctggtgtgaagtttaagtgagaaaatgcatgtgatgtattttacaagacacctggctcatagatgccctcacacgttggctgctgctagcattaacattattaatattaatgttattttctagaaaggagactgaattcatatagatggaacccaaccaataatttttccagtgtacacaaccacaaagattctaactttgtgcttattgaactttagtgctgcgtgactgtgtggagggcttgtttaaaagtcagatttctaagcccccacctttgaggttctgatttattagtcagacatagaatgcaggagtctgcacttttaccacgcaccccagagtgtctgatacaagtgtgtttgctctgcagatgacattttgagataaactttttaaaataatggtgttccctgggtgggctcacccagcctaatgtcatagtgcttataccccaaaccctttcccctaaaatccccagaacacaggagtgcagtgaggagaggggaattttatttcaggaagaaataagtagctgaaaagacatgaagtctgggcatggtggctcacgcccgtaatcctaacactttgggagaccaaggtgggtggattacttgagctcaagagttcaagaccagcctcggcaacatggtgaaaccccatctctacaaaaaatagagaaattagccaggcaggcatcctggcatgcgcctgtagttccagctactcaggaggccgaggtagaaggatcgcttgctcaggaagttgaggctgcagtaagccgtgattgtgctattacactccagcctgggcgacagagtgagaccctgtctcaaaaaaaaaaaaaaaaaaaagacatgaagatatctttatgtttaggtcctttgtgaatgacttcagtatgatttagaagttctccattcttgggtggagagttggctgatgtttgtttcaaagtttaaaaacctttaattctctgtcattagggtatgaattcgtctatccactcatccatccatccatccattcattagcttattcatttatggtttaacaaacatttgttgagggtttactaaatgttagaccctgaaaataagcctttagaaatactaaagcaaacatgacatatgtccacaaagagctcactatccatctacaaagatggataaacacattgttattattattattacagtccagcatgtgagaggtgacagagatggaccatcttattagacggcaatagttcagtgggagcatagcaaagggactgtcacgtgtatgggtgtcaggaacatgacatgagagaaagcgcagcccattgttaaggactggctcttcagctcgtctccatggagtgtcctcaaagccacaaatccgtgtgatcagtaacccgtggtagaggctcttcaggtcactagcagttactgcagttccctctctaaatgaagcactccactctggcttctctgcagagcagtatttcccaccctacctccatctgcaaggctcggttccttggttcactccaaaggaggctgccttgggttaagagacgtggatcctggcctgagctctgggcatgccatccaaggcactccagccaggtctaaatgaggagaaataacactggagtctgtccaaagcacttggaacagacaaaactcacccctcgcccactgcctcctcccgctccctccccatcccgtagccatccaaattggtttgacacgattcaggaatgctcttccggcatttatctcacttgctaattaataactcaccttgtctgtgcatttagcagagccaagctagggacttcagggactccaaaagggttctggttcccatgcccaaatagtccagtttcttcctccaatgagacacaaagcttggtgaacccactgtaaatgccttgattaatgtatcccaatcgtgttgatggattggttgggtgggggacagcttaaaaatacaatattgagctattaattgggttggatgaggattccctttgcagtccaaagaccttgtggcaaatgtagctggagccataaacagagtccctgattagctcccagagagaaaagcaatgtctctaatgcttaggaggaaaacttggccttgaggacactgccagctggccagatgctgggtctctcttctttaggagggaagcagaattagcctcaactgagatcttcagggaacacatagcaacagggatctgaagttattctggctcttccagttgaaataagatctttgacttcctgggcatatttgactagagaatcttctgtttagaaaactgtaaggtaggggttcagttttctcttatgctactgaggtttagaaaaaagatagaaccagctgcgcacggtggctcacacctgtaatcccagcactttgggaggccaaggagggcagatcacttgaggtcaggagtttgagaccagcctggccaatatggtgaaactctgtctctactaaaaatacaaaaattagccgggcatagtggctcacacctgtagtcccagctactcaggaagctgaggcatgagaatcgcttgaacccaggaggcggaggctgcagtgaggcaagatcgcaccactgcagcactccagcctgggtgacagagcgagactccatctcaaaaagagagagagagagagaaagacaggagggagggaggaaggaagaaaggaaggaaggaagaaggaaggaaggaaggaattctcttgcatataaaaataataatcagtaagatttttgagagcttacatgtgccaagcactgtgctgagcttgctctgcacctgggttacgggaacagcctcccaagtggtctccctgcactcctcttgccgtctgctctctgttcctccacacagcagccagagggagtgttttagtaggttgatgcaaaagttattgtggttttggccattgaaagcaattaattttgcaccaacctaatacattgtaaatctcatcattccatgttctcaaagggtttctcatggagttagaatcaaaatcagctgtttttttcaccttggcttagagggccctctgtatatcccctgccttgtctctgacctgtcctcccccatcctctccggaagctctgcctcatccactctggccggtgtttagactgcacaagtgcaaagattagttccacccgagggtctttgctagtgcaaggtggaaatgctcagtcaaggcacattgtatcactggctcaatgtagtcattcagttctcagctcaaatgcctcagaaggacttattacgaagtcttcctctgtgtctctcccatcaaccattagtgtttcctttatggaaatatcacactcctaaattttctcacgctgttattcttgcagattgtctgtttcttcacactagactgtaagttcaatgagtctatttcatcatattattttcattatacagataaggatacaaaggctcaagaagttaagactcagaatagccctttcagctaaccaccatgatatatggcttttctcctttaaaaccattggctccttttttctaaaacactcaaaaaatttggacagtgtttctgaagaagattcaaacaagtacagaatgtgtgctgctgcaaggaagccttagaaaaaaacacctcaaagacaaaacttttccattgaaaaccttttcctggtacatgtaattgaccattgaattagttgtgttcttttttaaaaaaaggggtttaaagtttataatttacccaacacagcactttcagtcttttttaatcaagtctttattagtttaaatggttattaagtgtctcttaagggattatgtttttttccccctgattagatgacaaatcaaatatccattatgaaattgtgatgaaaatgcataatctgaaaaaaaattttaatcatgtaaatcactatggacttattttagggaattaaaggatgaaaacgcagatttcactggtggcaaggaggtgatattgatagcgttatgttggcttcctgtatttgtgctttggccagagccttgccctagatggtggcaggcacacccttgccatcccccggtctctgtgaccagcatttgaataaagaggcaaggtcctcgtgccatcactagctctcttgctcccacagtcttcccccaagtccagaccagtggttccctaccggggcaactcgctcacccaggaacatctggcaatgactggaagcattcacgagtcatggtggtggggaggtggggaggtgctactggcatccagtgggtagaggccagggttgctgccaaatgccctacacacataggaaagccccaaatcaaagaatgatcccacccaaaatgtcaataacaccaaggctgagaaatccgatatagacatttaatgtcccaggaacacatctgtctgagggaccagagggtcccaaaacaggcagtgtccatgggcctgatttgaaaggacgtgatgtccaaaaccctaaggcattgagcccttactaagggccaggcccttgctaaaacgtcacccacattgcctaaataaatcatgacaatccccacaagagccctgggagtctttcattatcctttatatagaagcagaaactaggagccagagagaacaagtggcttgtccaagctcccacggcgaaaacatagccaagccaggattcagaacctgggtcaagaaccctcctctgggcccctcacagcacctgagtgtttgttgtgtttgggctcagagcaaggcagagcataagtgcttgaacaacctccgcccctcagaaacacgaattttgcagcatgcttaaaaataccatcggcgttagcttttccctccggttttggatttggaatgcatttttgccacaaagcacttaggcactgaaatgccagggggtgagcaggggagagttgagcagctggactttaaatagcaaggtgttagcaagcagcacagcaagagcagctgcccaaggcctgtgctcttttctttgactttctatcttctcagccaagagctctgggggattggagaggggccagaactctgtggccaaatgcaaatccagagaaaactgcgaggtgttcccccaaacctctgtgcctaatgcttctcttcctccccactcacaaccaagaccaaacctttccaaggtgattctcctcctctgcctgtcctcagggtatgtcatcatggagctctccccacctccttcagtttcctggaactccatggccacgtgcactgaggcacactacctctttcatttatgagaatcacaggatgatttcatttatgggagtctggaaatgtcagatgcaaaaaggctaaactatagagtccccggcagctgcaaaacccaaggagggaagccacttactcaaggccaaggagcaggcagggcagacctgagactggagtcctggtttcctggctcaaaatccagtgtgcttttgtcaatgctgcgttgccaccaaaaggactcagtgacactcaggagaatgggtgcctgccactactggttggagccaagatctatttcagacctgggacctagattagaatgagtggagatgcctagggtacctcacagtgagtgtcgccttcactttcgccccctcagcccctcattcacctcttcctagttgcaaccctgctcagacctcttgtcattgatggcaatgacagaaaacaccctcccccacaccagccacactcctggacagaccactcaccaccaaaatcatttattcatccaacaaacatataccaagcccccactctgtggcagggcatgtgaatgaataagactcaaactccgcccataaagatgctctgtctggtgggaggtaaaatacacactaaagctgtcactgcagagccacattttaagggtccataatagaagtaaggccaagagaccatggccgctcacaagagaggcactgaagacttccaaaataggtacagcttgaatcttaaaagataaaaaggaattaggcaaggaaggagggaaaagcattgtgaacgaagggaacggcaaatgcacagaggcaaggaacagcaatgcctgtgtggggacctctgagaagcctggtaccttgcagcctagtccacatggagaatggaggaggatgaggctagaatggggtttgcgtgcagtgctgggcagagcgcaatacagccatcatatttgtttgtgcctcccatcaacatagcatctcagtcttcaaaattgcaaccatgcctgcccctcagacagaaggctgatatatctgcttgagttattataaacacacacaccacagctgagaagcaggcgtggccttttgttgtgttgcctccattgcacatgggcattctttctcccagggaggggagacagcctggcagggtagtcaagaggctttgggatttgagcttcaggtcacgtcccagctcctccacttcctcaagatatgagcttaaatttaagctttgtcctctgtaaagtggagctagggctaatttctacctcataggatactgtgaggcttagatgagttaatggatgcaaaacagtcagcacaacggttcgtatacatcttatacgtcagtgagcatcagaatcacctggaaggcttcaggcacagatggctgggccccaccctcagagtttcagattcagtaggtctggcaggaagcccaagaatgtgcatttctcacaagtgcccagatgatgctgttgcgttgagaaccactgacttagcgtaatacgtgccttttgaagggaagctcaagtgctggcagagggattcctccgagcgtgtcagccctgggccagctgatgaggagagacaggccaaacagctctgcatcctgaggcggtggccacttcattagcatatggaccttgggtacattcctgggttcactgaggtcctttccacagaagcttgtcatccggagaggagtcagggctccaacttcccgggatccatcctcctccttcaagagtgttggaataaacgaaaaatgtggaaggagtttgctgggagagagcagtggtagctggccctggttccttgccttttatgacattctgctgcttctcccatgccccctgccccacttaggacaggtggtgctgtgccatttactgatggggtccacagactttggaatcagacggacctagctgtacattctgactcaggttcttactagctgtgcttccttgagcaaaggacctaacgtgtctgagactcagttctctcatctgtaaactggaaacaatgatatcaacttcattggcctgttgtaaggtttgactagaaagtttatagacagcaacttaatgcccctttacttaaatggctgctctaagtgtttgcatctccctgtatgatgtgagttcagagattctaaaaacatacactgccttccaatcaaaaactcatcatttcaaataatacatacatttcaaaatcaggaacccatcttttggtccctgttataatacatttccctcaatttcatccccactggctctggaatgagtgctgtcttccctcagaggtcatgaaccggtgacccccaagctgggtgggtcactgtcatgttccctttagccacataggcttacaaaaatctttgcattcattgctgacatttagaggatttcatttaactaacaaagaagctgagggcctagaggttaacttgcccagagtcaaacagtggaagggctgggattggagcccagttcttttgattctaaatgtcttgttcattcttctctcagaccctttttctgaaagtatttttatgccaggtgtgccagagtccaaagccactaggtgtctggggttatgctggaaaagaggaatccatggagaagacagatgcagaaaagagaaacagcagtccccggagcaagcttctcctgctcttacttctgccatgctcactcagaaagcttgtggctcagggagtgtagaaccagggagaaaaccccagcctacctggggtccatcactcaaagtcttagccctttgacgagcaacactaatatcatcactacccaactagcacaccgtctgccagggaggccattgcataggcctttgacatgccctctttgtctatgcatcttgccacacagattttgggatgcccccttacctggcctctccattccctactcttaatccttaaggccatgatttcttaatagctttccacctccactcagatcatgccaacaacttctctgcgctggactatgggtcctccagcttctaatctgttccccacagagcagctagaagaatcctttcagaagtcagatcctatcacacccctgctcaagccttgccagggcctctcatctcccgtagcatggcacccaggttgccgcagtggcttccattgctctgcattagtgagtccctgcttccatgctgatctcatttcctctctctcttcctcgtcctctctctgccatacctgccatcttgccattcctacaactcacagatacactttcaccctaggcttctgcacttgctgttgcctctgctcagagtgttcttcttccagatgtttccatgactcatttcctcatttcgtttaggtttctacacgaacatcacttctttagagaagccctccctgccctccctgtctaaagcagaaaatcccctccttcatcactgtccagccctttaccttgctttacttagtgtcttcagaacactgtcactgtaattccatcatgcattcattgtttattgtctattttccccctctagaatctagggccataatcacagggtccttgtctgccttggtcaactcattgttacacgaattgaatgagtaaaagctttcacgagaagtgtttgggatcagaagcaattgtcttttattcaatagatgattgggagataaatacatttcattttaggatttcaaaaaacatgcatacagtgacacccaagtcactatataccgctgatatcgttttatcagtgcaaagaaaatccagatataaaatacatctttgcttttcagtaaggcatgaagacatggttgtactgctcttcatctgtattattgacttggcctcatcctgttcattgacttcgtatgggttggtgcagtaggtatgcaagcctcataatcctcctttaaaacaagaggaaaggcagaggcagctgcagattgttcttgggtgaactccgacctcccaaactacagcttgctggagaagcatagagtaggggagaagaacagcaagtctaaggctgggccagctgcgtgtgaatcccagcttccccacccaccagcagctgcccaaccttagtcaagtaactgaccctctctaggactgggtttctccatctgaaaagtggaagtaaacaaatggttactatacaacaagtccttctgcatacagtttatttgatttttttgcaacagccctattaagctggtgtgattatttttattttacagatgaaggaaccaagactcagagaggtaaagtaactagcccaaggccacacagccaatattttgctgacctggggttgaacacagatcagctgcctctagatcccgtgatcataattggcagtatgatactaattcctattatctacaccatagagtagatgcgaagattaaatgacagccaggcacaatggctcatgcctgtaatcccagcactttgggaggctgaggcaggaggattgcttgagcccaggaacttgagaccagtctggtcaatatagcaagaccttgtctctacaaaaaattaaaaaattagctgggcacagtggtgggtgcctatagtcccagctactcagcaggctgaagcaggaggatctcttgaacctaggaatttgaggctgcagtgagccaagattgcaccactgcactgcagcctgggtaacagcacaagacctcatctctcaaaataaataagtataaaacaaaataaacgagaaaatctccagcgagtgctaagcacagtgcttggaacatggcagcagccacgtttaggaatgacaccgtttagaaattagtacttccaactcctctaattccacaggaagctcgtagaatagccaagtccgggcccttctcccagctggcagtctggggcatttctttatgcagcagaaggagaagcatcatgcgcccctactaatcctctccactctggggccaagcctcccatcttccccccagggacaaggtctcccctcaggcggaaagtaactgttcaccttgttgctctgaggtgtcggtggtgacagccccttttctttctgagggccccagcaggtcactgtctggcaccaggctgccaccccctgccgggcctcggctgcactggccgtcggctcagttctgtgtgacctgtcagtgggctctttgaaatggaggttgatgaggaacagagcagggtagaccaggcagcgagaggccaggaacagcaggcagagggcaagcatttggggaaatcagaggccaagagcagaggcccctgctctctgttgccagtggtttttgtaacagcaaagtggggagacagctgcagccaggatagaaatcccccaggtataaaaaacgtggctctaggctaacaagggtgagactgtgccagagaggcctgtcagaggctgtccaaggtgggaaatttctgatcaaatgagatgattcccagaggccctttctgggttgagagtcagcaggggcgggacagggagaggaaaagaaggaaggggaaagagacagaaaaaacaactaagaaatgaacatgtcttctgaagcttcagtatttcccttcataagtcctgtgacattcagagggtacctatatatggctgtgactgcttccagccccctgtgaaaaaccgagaacagaagtcaagaggctttggaggaggctgggcatggtggctcacgcctgtaatcccagcactttaattccagcactgtaattccagaagtcaagaggcttcgggaggccgaggcggatggatcacttgagatcaggagttcaagaccaggctagccaacatggtgaaaccccatctctactaaaaatacaaaagttagccaggcatggtgaagggtgcctgtaatcccagctacttgggaggctgagccaggagaatcacttgaacccaggaggcagaagttgcagtgagtcgagatcgagccactgcaccccagcctgagcaacagagtgagactctgcctgaaaaaaaaaaaaaaaaaaaaaagaagctttgaggtagacaaccaacatgtgaatcatgaatcacttctccatcatttactagcactgtgaccttgggcaaggcccttaagctctatgaacctcagtttctttatctgcaaaatgaggatcatagaacccaccacaaagggttcttgagagcatgactggatgctggctggatcgaagcacagcacaggctgagcaagcacagagggacttaagtggctggcagagggccaagcacttaattgtaaacttaagtcaaaagtgtgaactggatgaagctaggagctggggcagagggctggccaaaacattctgctgcccagtttcccaaaacataaatcaccctgtactaggtatgtaaatggttactctcactaactgtcttagataaaagagctcatatgtacatgcttgtacaaacatgtcatggcagagggtacaacaggctcctgtgtgttggacactcagcataacagtcacacaaccttacatggcagctttgtgtaggatttcgttccagagtgcagcaaacagggtccaaaacccagtcctaccacttaaaaacagggtgaccataggtgaattatttaatctcgaagtctcccatttctcacctgtaaataatgatgttaatagcacccaggattctggtggtgtcttaataaaggcatgcgtttaaagtacctaacccagtgccaggcacccaggaagctcctcctgagcaccaaccattggttctcattagacatggttgccattaatgttccattgtcttgctgacgccaggatgttgtcacctagcacagggtccccactctaaaatgcactggccttgggagacactgggagctggaggacaggggctctgaactgatatgctagtagtaccgacgtggtttgtgttgggcctgatcaccaaaagccctgcactttataggaagtcaatcaaggatgagactgccacttgtgactattgagtagatggaggtatggctggtccttccaagaacaaagcccccaaacctagagccctatgttctcatgaactgttttccaacgtgcatggcactagatgcaattgcagggagaggctcggagccagaagggtccatggtcaggaaatgctgcgtactccatgacaatattaaagactcataacgtgtatccatatatcaaagcctccaggaagtcctgctgtaaagtttaacttcgtttaactgactcccaaattacatttgatggcagatcctcccctcccacctccacttttgtgtttcagggaatgcgtattaacatcctgcaggagacagagtttggaaaaactgttgtagcccctcagctgtactgctgtggatatttgaaggctttttctcagtcactcagaacagaggtctcaagctttagtgagcaaaataatcattcttgagaatcttctttaaaatgcagattcccagccaggcacagtggtgcacacctgtcatcccagcactttgggaggccaaggcgggtgaatcacctgaagtcaggagttcgagaccagcctggccaacatggtgaaaccctgtctctactaaaaataaaaataaaaaaattagctgggcattgtggcgggcgcctgtaatgccagctactcaggagactaaggcaggagaatcacttgaacccaggaggcagaggttgcagtgagctgagatggcaccattgcactccagcctaggcaacaaaagtgagactccatcttaaaatttaaaaaaaaaaaaaatgcaggttcccaatatttagtctcaggaattcagtacgtctgggttgatggcatcttaacaccataccggagcaggtagtcagggagcacaccttcagcaacgctggtttaaagcttagccactggaaatacggtgctcagagcaacaacatagacatcacctgggagctcataaataatgcaggctctcaaaccccaccttaggacacgggatgagaatctacattttaacaaggtccctgagtgattgtgatgctcattagaatttgagaagcattggtttaaaaggttttgttgatggcatttgtttttggtttttgtccattagttgctggtgaagaaccattttttaaaaataactggacaacactataatccccttgtcaaacatttcccccagtggcttcaaggtacagtctattaaagagaggccttacctgaatcagatttctgcctttggtagcagagccttgattttcttaagcagcccgtgctttttttcccacatccatcctaaagagtagaaaagccagcaaacagctttcactggggcctcctctctgccagatctctggtcagacatgattcatcttccatgactaagtcataagaaaggccagaaggtgctttggtacaacgatctctggacttggaagtcagagtctgaccaaaagagttggcaagaagtaggaggaaaacttccaacaggtcttcttccagaaggagtgcaaatacagttttacttctttttttttttttttttttttttttgagacagagtctcgctttgtcacccaggctgaagtggagtgatgcaatctcagctcactgcaacctccacctcccgagttcaagcgattcttctgcctcagcctcccaaatagctgggactacaggtgtgcaccaccacacccagctaatttttgtatttttagtagagacggggtttcatcatgttggtcaggctggtctcgaactcctgacctcaggtgatccacctgcctcagccgcccgaactgctgggattaccggcgtgagccaccgcacccagcccagttttacttcttgcaatatttgagaatggccgttgctctgtgcagggaaggaggatgcctgaggagcgacggttcatcaggcagccagggtattaatggcaggtgaaaccttccaaacgagcatcctgtcagccaatctattgctttaaaaggttcgcaatgcaggagaccttacagaggcaatgaagaactaatctcatattgccaggttaaatcaagtcagccttgcctattcctttcacttcttagttacatcaagcccaaatactttcaattatcctcacttccaacttgtcagcaggcgtagggtaaaatgcaaatggaacagtacctttctctcgtggagagcaggaaatatcattaagaataaccttcatgtattgagctttgcctccatcttaagtgctatacattcatcatctcatttcacacgcaccttcttagagcacctctgtgcatttcagtgcagtcagcattattaagtccattctatagattggaaaactgagccacaggaattcagtcacgtgcccaagatgacacagctgataaataatagaccaggttttaaagccagaccattctaattctaaagcccgtgtttgtttgctgtttttcaaactgagccaaaagtccagtaccaccctgggcaaatggggcagggcagggaccaagcattgcatctcagcgggccctgagctttgggatgactcccttgaaattttctaagttgctccccaagtgtcagggactggccagagtcagcaatgctaactgggaggagcacctcagtccagactaggacccacgtgagccctgatccctgttcctccccttcagggtgctctttttttttttttttttttttttgagacagagtctcaccctgtcacccagcctggagtgcagtgatgcaattgggcctcactgcaacctccgcctcccgcgttcaagcgattcttctgcctcagcctcccgagtagccagaaccacaagtgcgcgccaccatgcctggctaatttttgtagtttttaatagagatggggtttcaccatgttggccaggctggtcttgaactcctgacctcatgatccacccgcctcggcttctcaaagtgctgggattacaggcgtgagccaccgcccccggcccagggtactctttgaccctctgccacccctcacccccactcctgtgcatgtagggtcaataagatgccccaaattgttttggcatttgcatctatgggatatcctaaggcctaacggccagccccagttccagcaggcagcctagcaagcactggccaaaggactctctcttttgcaaaccaagcttccagaatggtgctgacctgctgatttggggtgactcaaattgtttatatagccaggggcccagcacaaaaaaaaaaatgccctttgactggggtgctgcataccttaggcatgccctgcaggagtttacctcaaaacaaactaactcccaaggcaaaaccaatcctatggttccccctttttactcaggaaactctttccatctctatctcaaattcagcaggagcctttggcctttgctggccagcattaagtgccctccaggacccctgcaccttcttcatttccatcacgaacaaccagatttcatctttcttgccccaacttattgcttcttccctcctttttattgctgcattaatttttcacctcttcatcattattagctgatctcaaaaacgaccctgagtcacggggttcaccacctgactacccagactttccttggggaagtgacagcttggcaagcacctagctctgtataggtaaaaaaaaaacccatatgatgccaagaagactcaaaaagaaaaagaaaaaaaaaacatagaaatgactcagaagcacttagtaggtgacaaggtgctcacaactgttgtaaggacctttcgtggattacctctgtggatcctcccagcactcctttgggtataatcatcactgccctcactttgtcaattcacctggggaaccaggtgactaagatgaagatcaagagcatgcccagtgcccagaaagtttccctgtgccctcccaactaatacctcctcatcaaggtaactacaacttctaactttctatcatcactgattaactttgcctgttcttgaacatcctatcgatgggtcagagagtactcttcaaagctcatgtttttaaccaatccactctatggcttcctggcccaatgagtaggaaaggtagatttggtgcttggtggttcctctgtgaaaccatgactgcaaagagtgcagcttatttttaaatctgagcttctgaccagtccccaaccagcagctgcgtgcagacactagaagagccatccacagcacctgcagtgatttgttagaggccatctccaccactctgtcacaaaatgaaacttagaaaagtaaatgtaggtgttcttctggagcctttaatacctaggaaagccatggagttcatgcacattggagagagactcacttgcaaaccaagctacagggagaaaagttgaacaaaatgcttccattcaaattctctataagctgcccagaagatcaaagaagaaaataagtgaaatcaacatcttctcattccctgagccatttcctatgagaatgatgatgcaagaattcacacagcctcctccaggcagaaaggtgtgcatggttcagccaactccaaaggatccagatgcttattgtggctgctttacagcctctccatcgacacagggcctccttcctcctgagtgtagctttactagtaagcgtttaatggaggctttgagcttaaatctctttactagttaggagctccttttaaaatctagcagagtacactagacaggggattgaaacggctgacaaaaacctatagccagcacaaaagtaagtgccaccttgtgccaatggtaaacagctgaaaggggattgtgtctcacaggtaaatagtgtggtcctctgcagcctacaatgccaggaataaattcccaggcatctggtttctcctgctgattcctcttcagatgctcatttcaaccagccacattctttcccagctataggagtagacaggccttcagaagtgattaaatctcacagctgcccacacttacccctgttgatgggtgtccactgccttgtcttcagacttccttggggaaggaagcgtcacccctcctaataatgaagacaaaaggtgataatctcatcggctgcctttctctactttttattcatagctgcttcttagccacttggatatccaccttctccaagcctcagttgcatcctctataggtgggtatagagtgggtggcatggtgataatggagctaagataatgtactgagcattcattatacgacactgctctgagtactgtacagacaataactgctttaaccctcccagcagcactatctaccatcgtgatcatcatcatcatcaacatcatcatcatctccattttatacatgagggaaactgaagcacagagcagttaattgcccatggtcaacagctaggtaatagtcaatctgagattcaaacccagataccctgttctataatctgacatttaagagttacattattctgctttgcaggatttccatgaatctttaaattaaaaaaaaaaatgtaaattctgctcaatctatagcatttgttattcctattaattattattattaacctatcactgtttggaaattaagtatttttgccaagattcaaccagcccatagcctacaccagtggatgactctaaatataagggaatattaatttcatttacttttgcatctttttttttaaaatgaaaaagtggaagacttcagggagtttctggttatagttatagttcattggacatatactatataccagactgacatatatatatatatatatatatatatatatatatatatatatatatatatttgaatttatatatatatatatatatttgaatttatatatatatatataaatttatttattcttcatcacataaccctatggcatatgtacaattataactcagtttttaatgcaaggaaactacaacccagcaaggctgattacctttccaagctcacacagccagggaactagcagagacgagcttcaaacccaaatccatctgattccagaggccaggctgtcacctctgatgctgtgtagaatttttggctttttaccttgggacttctaatccaaaggtttcaattcagcattaatgaacctgtttcacgttgccagaactgttatggaagaatctctctgatttgctttatcaaaagcaataaatagaatgccttggtatcattcccagaaagtttctccatgatcacatttctctgaaattgtcattacaattagcttatgacgtgtatgagtagactagaaccagagctgtgatttagcgtccgttctgacagaaaacacctagataattctttttggccccgtttcactgagtgaagtaagattaagcagacatgagccaccgcagtgtgggctgattcagaaggcctaagtcgctttcccataaccgctgagtcagtattgggccctttttgaggactctgcaaacctctcctaccatcctcacccccttccccaggaaaaagccaaccagactaacaaataagtaggtagataaataaataaagaaatcgtccattgtcataggagggccaggccgctttccctctgctgttgaatggagacatcggccacctctcaggtcctgaactggcaattcagaacagtttgattgcctgcttgattgtttgcgagataactgcaagattgtcagtgacagggtaatttactgaagattgcaatgtcagactccatccaaggggcttgctggcataaagacgcgattctcatgactgacaggccactgggagattggagtgccaatttaaagttcacagtgtcgtctgaaagtgtttggcggctgcagcccataatcacgcagcatgatgaggtcattataggcataacgtaggctcctacttaataacgggtagaaccccaaatgcacaatctctggagcaggtaaatgtaaatatgtaggaggaaatcatttgtatcctattttctttctgttttggcatttgtcatctgctattgctgatgtgcttaggccatctcctgccagacaggcccttgaatcaaaagcccaggatcaacaaaacagtggggaaatttgaagttcacaattctgaagcagtcacaagcccggaaagagtgacaggctggagggggagggggaggcaaatgttcagcactcaataggaaaactgtcttaagttattcttcaagcccaaagaggtcttcaaggcggttatatggagcgggtggtaaatgggttggagggggaggaaatatttccccagcttcaggagggaaaggccaccagagatggatgatacccctaattggaagaggcctgtgaccttaaagaaatctatagtgctaacagcagtgggtttcttctcacctgagaagcttcttgtggctgctgaaggaagccctgccagcatatctcagcaggttattttttaaatctgaaacaggcattccgtggtagagcccttctgtcttttgaaggcagcccgtggacagtgatgttcaaggcagaattctatgcactttttttcttctttttcttatgctgccaatggtcctccagattggacagcctgaatgtggatctgaaacaatgcctggatatcatcctgctactaagatacaatctccagtgctgtttctagggtctgaggtttgccaggctccggggaactggggagtatccgattcagccagcatatcagcccgagatgttcagagccttgattttgaaagtctctcaatctaaagtgtgcatgcctgctcaccctcctgtgtctgcatttctaggaaattgtgtaaatctaaatgtgttacgaggcacatgagcaacatttgcccatgtggaaaatgagaggctagttttagtaatttaaagccaggcaaaacatgcaacctcctaatttgtttgtttgctaaaaagaaagtaatgcattaaaataattgcacattaattgctaaattacagtggaactttggtgaaattacatatttcattttcattagcggaaccaaacgaaaagggtaatgccaaaaaattacactgtagtaaatttaaagcacccagccaggcctctgattcagcgttccagtacaagtgtttgtcaaggcacagcccagggtttgagtgcgtgtttccatggttctaattatggtccaaaaaaatgccttgctatcaaatccaggaggtgcaagcaagttattctccaagcttctccactgtgtattcaatccgctcccagccgagtgaataaggattgactaacgaattcgttcttatcagaaattccaaggagcaaacactgccctaaacattcccatcttcagccctcacagacaggtgaggaatgggaaacagtcattttattcattcaacaaacatctgttgagtgcccgattctgtgcttggtactaagagaggaatgaatataaaattaataagacatcatttttctcttcaaagagctcattttccagatagggaggcgagcattaagaggtcattaattctactataagaaagttggcattaacaatggtttttaaatcgtattgtgtgttagaatcacctgagaatcatgtttaaaatgcagattccagggcctgctcctggaggctctccctggggagatgtggggtgggccgtttattcttcctgcaggattctgatgcagaatgcttctttgagaacctctgattcagggatgtacagaacagggattcctaactgtcttggtcagtttgggctgctacaacaaaaataccatagactagggggcttaaacaacaaacatttatttctcgcagtcctggaggctgggaagtccaagatcaaggcaccagcagattcagtgtctggtgaggccctgattcttgattgatagactgcagtcttcttgctgtgtccacacatggcagaaagagtactgaagtgctctctggggtctcatttataaggacactcatccatttataggagttccaccttcatgacttaattacctcccaaaagccccattcctaataccatcacattgggagttaagttttcaacattgaacttcgaaggatcacagacattcagtttgtagcaataacctggccaggggcatcatccagaaggcttcctggaagaagaggccaacctaaacttgatcttaaaggatgagtcagtcctgtcagtttcccccactctaccattagctccttaaagacagtctccatggttctttgctctctctcatttccagcacatggagaccactcaaatatttgttgaatggtagttgagtaaataggaatcagcccaggtaaagggatagaggcacaggactctaggcaagtgcataataatgttccgagtcctgagggcgtgcaggaagacagaaccagaaactactgcggaaactgcaggcttaatttccagattcccaagccaaagccatttctccacatttcctagaaaatgtaatactctcagcacccaggtttccaattggtcagcagttcccttcctggcttagagagagtgggatagaatacttttctccgttaaagtgagatttaagggattccatgcattttagttttttttaatttgataaaaaaattgtatttctaatagagacagggtctcactatgttgcccaggttggtctcgaattcctgggctcaagtgatccttctgcttcagcctcccaaagtgctaggattacaggtgtgagccaccatgcccagccagaaattccatgcattttgattacttgtgcacccattagcacggacccctgggaactgaccgtgggtaatttgctgtgctgtgttgtttaaaagcgaagtttttgtttttattttcccactcaaataatacgtgttcatagtagaaaaaagtagaaattccagaaaagcacaataaagaagagaaacacactaatctgctacatgaggataaccatttgtcaacattttaaattatttcctttcagtcttttattttctatgtgtatggattggaattggatgaggcttgctgtgtgaaacctgccacctcaggcccttgggtacgtttgatgctgctcatgcctgtgctggtaacaaaggtgttagtgtctccaaacagctttatgccatgaaatctgctgactctggctctgcctctgcccttccagatggcctggtggattgtttggaccctgactgctgcctgcagtcagcctgtcagaacagcctgctctgccgggggtcccgggacccactggacatcattcagcagggccagacggattggcccgcagtgaagtccttctatgaccgtatcaagctcttggcaggcaaggatagcacccacatcattcctggagagaaccctttcaacagcaggtaggcaccctctgtccctgcaaactcctgaagtctctgattttcttcctgttggagccagaggcagttctccagctttcccggggacccaattggcctggaatctgcccccctagaggcagctccctccaagggggactcagagaagtgccctttcctcactttgtgttgggctccagaacagagccctagtgtctttgcaggatgtcaacatctttaacccagaacctgctggagacacctgttgattccctggtttttagatcatttttaaaatctgttattttatgatgttattgtcattatattaaatctccctttaaaatgcctctgatagtggcttttgttcgagcattgctgaaatagttcattcaatagagtgtttttgaaagctgttattaacttgataacataacctatcatttggtggcatcttagagtcaagaagatgttggttgcaaggatttattgagcacctaggatgagccagagactttgtgtagattatctctaatccacacaacaatcccatctattgcctctcctgattacctattgcatgcaagccattgtgccactgcatttcacccctcattctctccagtttattattgctcttagttgctaatttgaggcttagaatattctagggtcaagttctagattcattttgtcttcaacttcaccccaggacaagttagaactgtgctcctggagaagagagcaaggggaaggtttgtcttggagacacttccccaccaccccatcccctcctcttttctatgcactacgtatgattctgagggtagagaggaggggtaggagaggctgggggtcttcttatggcttggccatgcttgatcttcctctcagttggtccaagtccagatgtcgatggtgtatgctgatgcaagaaggaggagcgtggtctaattggggatgccccgccccatctctgtggtccttcacatcaagaaataaaaactgctggtcaggtcctttttcacaaaacttctagatactaggaacttgggtaggatggtcctggcccctttgcagccctgacgacccccattgtgccatctttgtcttatttctctttagcctcattcaggtaggcccaggagcaactctggatgtatgctacttctctcggcttccaagcagggaagaaatactagacttcccttcttacagaagcacctaactttataagtgattctctcggagcccctctcatgagcctttcatcggtccccaaccgagacagcccagcgagggtgggatggggaaggaatgggtgtcagcacagctgattctacagcctcttagagctctctggaaagttggagagccccaattcctgcagctcttttgaatatgagtgtcttaacaaggtcaccttaggccaacaacttttgcttctctctgttgtcgtttttactaaaaataaaatagaaaaagaaataatagaaaggtaaaaataatctcagccctcttctatttcagccctgatacctcctagcgatatcatgttgggctcgtaaacctcattttcttgattaataaaattaggataacactatttaaatacgtaaaagttgatcagacaaattgggtcattcttgtcatacccaactaaagcagaggcaagaagccaggaagaaaaagcactctgggcacataacattgccctagaaatgtaattctccccaggcctggctactgaaactgtctgttgtaaccggaaaccagttgatctaatagcgactgaaacaacctactatgactctaagactagttttacccaccaccatcattcaccagtcagaactcaccagatcgccaaaactttaccagtcccagtgaactttctctcaaaagaataagtaacatttctccttataaaacctccaaacttctctttgatcttcagacatcctgaagactacccccatgcatatgccctgaattgccattcttgcttcccaaataaaacattttaaatttagagattaatctttctattttatttgactttaacatatactatacacagtattattactgtttcttttagtagaagaacctctcaagaaaataaaagaaaccacagatctctgataaataaaaagcatttactctgcttgttaaatcctagctctagaacagattctgtaagtatgcttccttttaattatgaacataattcatcttgctagagacccgtgactgggcagagcttgcactgggccataagcatttcagtggggtttgtagtttgcttatactgaaaatgcatcctctgaaggcctgtttcaatctgcttcctcattaacctatcattatttctaccctaaatccagtcatttcctgatattctccctttcatgctttctccacctggcccttctggttttatcttattctcctcatcaatggttaccacttccagaaggcaccttgagctagagccaaaatacaggtgaacagtcaggaaccccagaatatttggtagactatgccagcccaggagacctgaaagaaagttgctttagagaaagcgtctcggaagctttaaatgtaaacaataaatggcacttcccaaatgagcccaggctctccggctgtctgcatggatacataattcagaaatatgaaatgtaactccaagacataggttgaagttcagtaagcgtgtgaattccagtacattatcatcttacaaataacgaaggacaaagctaggagtaaaaaagaactcgaaaattcaagatttctaaaagggcgttcccctagataatggcatacaaaaataactaaaatgccttgactccaccactataatttatagagcagatctcactatctagataatgcgataattgttacacatcaataatcataaatagaaatgaactgatagtatgtcttagctgaatcttttctgcaaattgactgcctggaaacgataggaagccagcagcaaggaagaatttgaaaaatagaggatagaaatcacaggcagcactactcctgttattcctatggcacactgcaaagccttctgctacaggaatgatttaaaagaaatagcagttgtagaaaaaggaagggtggggggactccattgtggaatgtactttcaattttgttttctcatcacgagcactgtgtaccttgtggtcgtcaacacacatcactgattttaaagtagtgtctggtaaggtcttaaagaaatcttagtccgagctaagataagaaaatggaattgaacaaaaggattattttcataaattagttttccactttaaaagagtctagcattgtggttaaaaccagctaaaaatggcattcatttgttaggcagccagtagcagacaattagagctgtcagtggaacagtctaaacactcctgagatcatcaaagggttggagttgaacagctgggggtattgctaataaaaagagagatgcgtggagacagcatccctccggttttcaggacacccaggaatgcaaaagtaagtgcatccaaaaatcgagccgactttgacaagattgtgacaaaggacgggtcagttgatcacctagttcagaaactgggagtgtgtccaggatgctgggagcctgagaacctctcttcttttgccaaattgcccagtctgctgggggcttggtgcagaaatggagcttctcattgtcccatttctctgtgaagtcaagagaattcagatgagaggaggcatgcacattctccctccatggactttgagcacaatattgtagcatctctctggctttataggactttcccaggggtagctggttggaaaccgggatttgtgggaaagttctagttactgtgtctggaaagagggagatgttctgtaacactggaaataaattggtaggatttcaaaacccttcaagatagcaggaattcgacataagagaaatatgtagtaacacagaatccagaatccaatatatttctagcagaaaaaaagtgtatatagatatatacacatttttattgaatgtgtatattgaagggttttgctatatatatctccaaagttctcgtttcctcagaccctcatggattatgagaaattttgctcttagagggcagcaaaagacaatgcatgtgtatttcccagccataaaactctctgtgctcccctctacccactctgacattctggcctctagaagagtaacatggccatcctccaaagccaaaaaatggaaataagtagccagatgtggaagctctcacccgagtatggcactctcggtgccaggctaaagagcacctgggaatgatgagggacagcctgaagctcaggccaaacaaaagccaaacaatgtcaagaaatggagcaaggccaagagtggaaggcgggtgcccaggagacccctgggcccagctcagtgacgggagatgctgcccatggatttcaccccaaaatgtcactagcgtgattgtgcaaagccagaagttaatgttgaaagccttctccttgcctgagggaccagatgaggatgagggagcagaggcagtggggaattgtctctgttctcctgcatgtggctcaaagacctctgtttctgtctttctcagcttggtttctctcatccgaggccaagtagtaactacagatggaactcccctggtcggtgtgaacgtgtcttttgtcaagtacccaaaatacggctacaccatcacccgccaggatggcacgtgagtagctttgtggggctcggacctactcaggaccacacgtgtgtgcaaagggacagacggtgctgttggcttggaaccacaggattccccctggtggactggaatgtccaccaggcctgtcccctagtgaggattcccccaaagacatttcatgctttttgatgtgacatcaaaaacagaaaataaataggaaagccagcttacctagtacagctcacagccacctcgtttttttaatgtcaggtcaatgcacgtgtgtgtgtgtgtgtgtgtgtgtgtgtgtgtgtgtgtgtgtgtgtgtgtgtgtgtgtgttggggtgggggcaggttctagaaaaagaagggaaggtagctcttagaaacgaactcctgttttaaatcaaaggcagtgcagggtgacaggaatccacatgacatagtgtcctgtggtgatccccttctgctttcatctgtggctttaggagttgtgttgttttcgctactgtttggagggggtggcgtgtaatcagagaagtctaattaaatacatttagcagtcaccctgctgtgtgaaggaggcaacctttccctattatcttctgattggaaacgtgtacccgttcagcctccatcaagatgaaagctctgtcatttccttaatccatttgggcatagagtagaaatttaaagaagaagaaaagaaatctatgggagggagaaaacactaacttactctgggctaaaaaacacacagacacacacacaattatggcattctgttttaaatgaaaagggaactgtggctaccaatctgatccaacactctttctgtaaaatgcactctggaaaatcttggatgtatcacagaagtaagaacagggattttttacctttctctggcgaagagtctggccttattttctttcttgccctaaggtagccttataggcagtttcaacaattaccagcccccaggagccctaacttcactctcccacctctgaaacccaaacaaggagtctaaggattcatatcaaatcttcaatattcatgaaatttctgatatctcactcatacatttctgtagccaaatctaattattttaaagcacaggatggcagatgtgtgccttgcaaaattactctggcccttgttcgttcttagaagccggtggggtttttttgtttgtttgtttgtttttgagacggagtctcactcttcttgcccaggctggagtgcaatggcgcaatctcggctcactgcaacctccgcctcctgagttcaagtgattctcctgcctcagcctcccgagtagctgggattacaggcacccgccaccacgcccagctaatttttgtatttttagtagagacggggtttcaccatgttggccaggctggtctcgaactcctaacctcaagtgatccatccaccttggcctcccaaagttctgggattacaggcgtgagccaccgcccccaggccagtgttcttgaagaactgacatccttgagtcaattgctgtgaagtcccatgaaacaacagaaggagacatttctgagtccctgatgtgctattttccctttcttctgcatccctctccactgcttcctgagtaattatgccccaagtccacttcccagatcatctatccaacctcctggatcagttactcttcagcttgttcaggttgtaaagctgtggaagtcacaggacgtgcttgagaatgctctgaggaatcccacaatctgttgcatagtggcgtgtgccccaaatattcatgttgattctaccgtgccaactaggaacaattttacttcaagacatttgactctcttctgtactctatgcagaactatccccagcagtgtgcatgcccgataaataagcacataaataaagtaattaataagtaaactattgtactgtacatgctctgatatttgtcttaatattcctatgctccctgttcattcacatttactaaaaaagaccaaatgtgttactaagattggatgaaaccagcgagtcaagtatatttttaccgagtttttactgtgatccaagtactcttagctgctggggattctgaagggagcaagacagacagcaccactgccctcaaagagatgaaattctaaggccaggtgcagtggctcacatctgtaatcccagcaccttgggaggcagaggcaggcggatcacgaagtcaggagatggagaccatcctggttaacagggtgaaaccccatctctactaaaaatacaaaaagttagccaggcatcgtggcaggcgcctgtaattccagctacttgggaggctaaggcaggagaatcacttgaacccaggaggtggaggttgcaataagcccaaatcatgccactgcgctccagcctgggccccagagcgagactccatcccaaaaaaaaaaaaaaaaaaagatgaaattctagaggggaggtaaaataaagcttaacattaggacacctctctgttaacgtccttgttttctgttaattgggaaagagctacctttattctactttacaggtaatacacctccatccagctcttaagaaacgaacagaaatatagcttaagaaccattggcaaagaaatcagccacagagcagaggctgattagaagaatgctgtaatgagctcctctctgtgtcctaacgtagtatcgttataattacactatttattgaacattctattagcctaggactgtgctaagtgctttacacgagtggccagcaaacattttctataaagggccagagagtaaacagtttaggctttgctggccatgtggcttctcaccaacaactcagctctgccattatagcagggaagcagcctaaaagatacataaacaaatgggtgtaactgtatgccaatgaaccctttttttttttttttttttttttttgagacagagtctcactctatcacccaggctggagtacagtggcgcaatctcggcccactgcaacctccacctcccaggttcaagcaattctcctgccttggcctcctgagtagctgagactacaggcacccaccaccatgcctggctaatttttatatttttagcagagacagggtttcaccatattggccaggctggtcttgaactactgacctcaagtgatgcactcacctcagcctcacaaagtgctgggattacaggcgtaagccaccatgccctgcccaataaaatttatttaccaaaacaggtggtgggccggatttagctcataggtcatagtttgttgagctctgctctacactcatgatgtttcactcttagtcatgccatgtgtattggtgtaattattcccattttacagatgaagaaacttgggctgagagagggttagtaacttgcccattgccactcagctagtaagtgatagagtttgggttccagccccacctgtctgcctccaaagcccatggtctcctctgtgctctgcccatcgcatggccatcaggggaggaggagaggcatcctgccttgtctaaaagtgagtctaccccctcatcagctcatttactccctctccaggttcgacctgatcgcaaatggaggtgcttccttgactctacactttgagcgagccccgttcatgagccaggagcgcactgtgtggctgccgtggaacagcttttacgccatggacaccctggtgatgaagaccgaggagaactccatccccagctgtgacctcagtggctttgtccggcctgatccaatcatcatctcctccccactgtccaccttctttagtgctgcccctgggcagaatcccatcgtgcctgagacccaggtaggaatggcagtgccagggcgggactctcaggacttccctaacgaaaaccaactggacactgcctctccccgagtggaccagaaactaatattgtaggggagtaaaaaaagtgggagcataataaaatttatagccaccagagatgaaagtttgaatccctcttggctgttctggatgtctgcagatagtcgttcaagactttggcagtcatcagagcttttaataaaataaaaacaacatacatatgtgcaacccacctgcaaattgctttttgttcctgttagtcacagagatacatggtaagaggcgctttaatgatctacatcggtgttacgacagagggcatattacattattgcctccctgttgctttatacggattgtcagtggaagttgtaggttcgtataattacagcctctcgtggcctccttgcatgcagctagcaataaagcctgctgttcttatttacatcttttgccaacagtgtggctttttaaaaagaaacacaacagtgaccaagaataattattaatccaaaaatcataacctcagccccatcactctatggtggaagataaagtttttgttgttgttgtttttctttctcagtggtggtaagtggttcttgcacccacataagatgtgatgcctcagtgagggacatagcagacagacagtatcggggttacagtttacctgcacaggtgtgttttaggtgtgtgtctgccatgtgtttcctctccaggttcttcatgaagaaatcgagctccctggttccaatgtgaaacttcgctatctgagctctagaactgcagggtacaagtcactgctgaagatcaccatgacccagtccacagtgcccctgaacctcattagggttcacctgatggtggctgtcgaggggcatctcttccagaagtcattccaggcttctcccaacctggcctacaccttcatctgggacaagacagatgcgtatggccaaagggtgtatggactctcagatgctgttggtatgttttggtttcaaccacttattgatcaatggatttagtcatgtgttaattcgacccatatttattgagttccgaggatatgccaagcaccatttcagtagataaggacacgatggccaagaagacagacaagattcctcttccacggggtttacattttggtgaggtattgagataataaatacaagtgaaacaaagaaatatcaagcaagataggtgctaataagaaaataaaagtaaatgatatatattggggaggagggacaactgtggtgagcatttagggaaggctcctctgcagggcagcatttaagcagagactaatgacaagaaggaaccacatgaaaatcagaagaagaggatttcaggcagagagaagagcagggtgtgtttgacagacagagagaaggccagtgtagctggagtgtagtggaaaagaaaatattcaagatgttgggagagaggtggtcaggggctagttcattttccagacggagcacttgtaaatggcacagaatgaccctgaataatcagaaaacagggtttgaggagatcagaaagtcacatgctatgttccagggctttgccttttgaaggaatcacgattccctccttatgaaagatcttcgtaacagaagtgtcctaccgttatcagagttgtgagctgtagattaatcttaacctaccttgtatcttcctacttgtggaaagctatctaggaattaattaaaatccagaatcctgtgttctcttcaccaatagtcgtgtgtattttaaaaactgtaaagataagttaccaaagtaggaaactagcaacctcagaaattttcactataattggtagccaatgtgtatcagacgttccttttgtgtagagagaattgtgttaaatcttttgttgggtaacctctcaataacccctcaagtaggcaccctcataaccccattgtgcatatggggcaggagggagagggtaagaaagttgcccaagatcatgccactaacaggtcacacctgctcagaatacagccctgggggtctgctccatcagtgagtggtgttaacttaaccaaggtagtaagaagttcccagagtaactagtgtatttaatatacaacactggctaatcaaatatatgtatatttgtgtgtgtgtgtatatatatatacacacatacatatatacagatatatatatgtatatatgcacatatatatacatatacatatatctgtagctaataccaaaatgacagccaatattaaaaagtagactaaatattgtaattcacttccatacactccagctcctgccattatcaactcatgatgaggcctgtttttccatacccccgtctactcccctttctcctgtatttttctgaagcaagccctagacgtcacatcatttcacctgtaatatttaagaatgtatctctaaaaacataaaaacaatatcatcacaacaaaaaaacacaataattccctaatgtcatcacatagcccatcattgttcagtatttcaattgcctgacaaataccataaactatcaatactttgtctcaggatcccattaagatccaccttttgcaattggttgatttcttttaaactgtttttaaagttctttcatctttccttatctttctctctctctctaacctttataatttatttgttgaagaaattgggttgtacaatttcccatatagcgtggttggttggttggttgattaattggttggttctcgaattgcataattacggctatttggcctgttcctctgttccctatatctcctgaccattgatagttgggttttgaagctttctcaggttcaggtttgattttttgattttttgttttggcagaacaacttgataggtgtggctgtgtccttccatcaagaggcacctaaagtcaagttgtgtattttttagagatttcagtagccattgatgctcattgcctagtctgtctggccattagggattgcaaaatgatagtttaattctgtacttccttcctcatctattagctgaaatacttctatatagagatgctttctccttaactacttggttatttaaagtacagttcaaataggaaagaatagataaatgcttgattatttccctttatttactagttttcaatataatgagttgattcattgtccaggggtggcaaattaatgtttcttaaataccattatgaactcatggactgaaatgcatccagtatgtttcaatccattgaagttattattctcactaatggccaaatggccccatctttggtcagtgggcaccttttcaagctcattcccaaatccttttgacatgaccctaatagattttgattccttccttgctatctagtatgataaagtaggctggtgtcattgtgttcatttcttgctccagccatttcttccagaagccctgattccttttaatgagaaataatatatcaaggccacaagccaggcactagcaattctctttgctgctggggctggtcatttggcctttgtttcttggcattttcagaggacaagctaggaaatacatagagttttttaaagataaaaatgcatcctccattcatattgacacttctatatctcaggaattttttaaagctgcagagaatccccaaaggtgacacacatagttaagagtttaatgcagtaggaacagcaataatagcaatgcctcatatttctagagcagcattccaattaaaaatgtatggcatctcagcacttcatctcatctctccttaccacatctgtctgagaaattgaggcttcacttaacccattttacacgtggggaaaatggagccccaaggaagcgtgagcttggagccaagctaggactaatgtccttcatttccacctctctctcccatttgtccatgtggcaaatgcaggatttttaaaaacagcttttggattctgttccccattgaatccccatgtaactggcaggctgtactcctgctggtgcctgcctctcctggcactttctggaatcctgagtgaacacaccaagtgtcttaatttacacaagctattgctcccagaatctccatgtcaatgagccagtacgatcccaaagggctttctcctagtaagtggaaataaataacacaaaatataataaatgcatgctgtgaacagcaggctgagagaagcagtctcctgtccatctctaaaggggaattgtgtcaggttttcaaatgattcctttcctccctccatgtcaccagggtcatttttgaaagccagtcgttcattggaaaggtctttccattcccacagagtactactgtgtaaagtttcaaggttgagttcagctcaaaaatctgaatttaatattgtagcatcacaaggagaaaagcaatcagcctgcctctttgagtgagtttttggaacagaatctgtattactgcgaacacgtgcttctcattcttgctacagagctctggagtaatcaagtaaactctctcttttctctcactctgccccaccccttttatctttcagtgtctgtcgggtttgaatatgagacctgtcccagtctaattctctgggagaaaaggacagccctccttcagggattcgagctggacccctccaacctcggtggctggtccctagacaaacaccacatcctcaatgttaaaagtggtacgtgaacacatcttctttcccaaatacagccttgccacttctctggaaccttgtctctagcctcagcatttaagtgatcacacctccccttccctgggtcattttttcatcaagtgcccaaaatatgcatggattttcctaccttcttcttttattatttttttatttaaatatttaaaatatttattatttttttaatagagacagggtcttgctctgtcatccagagtgtatgtgccatcatagctcactgcaacctcgacttcccgggctcaaatgatcctcctgccccagcctaccaggaagctgggattacaagcttctttggttatcctcccaagtgtcattttacccaatgccacagcatttggggtccacctctcccactgcagctctctccacattgtgaagaagttggagagctccccgagcactgaagattcctaatttgtctcttcccctccctcccagttggccaatacacatgtcttccccagagggcttcagtaacccctcccattctccaacccccacaggaatcctacacaaaggcactggggaaaaccagttcctgacccagcagcctgccatcatcaccagcatcatgggcaatggtcgccgccggagcatttcctgtcccagctgcaacggccttgctgaaggcaacaagctgctggccccagtggctctggctgttggaatcgatgggagcctctatgtgggtgacttcaattacatccgacgcatctttccctctcgaaatgtgaccagcatcttggagttacggtaaatggcctcacaggcaaccttcttttgctctcttgccccccataactcctgagtttgatcgggtaactggggctgcatttgggattctccagagaagatatagtccttgtgatccaaaacctaggcccagaatcaaataaggaggtgggaaaaatgctttgtgtatctgtgaaaaaccatacacagatttgatacaatagtcaacaactgacttacagacaaggcttttagtctccagactggagaacaaccaaagcatcttttatttttaagaagctctgtagacacacatcaaagtttgagaaccactaatgttcatttgctaattcaaaatgttgtattgagcacctctatctggctagctctctataaagtctctggatctttgcacattcactaggatagcacttcctttactgcataggctttgctgtgtaatttctggccagcctaggtagattcctcctgcccattgctggctactaagtctgaaagccagacccctctgtgctgggaaaaaactgacccctaaaagctcttagacatgctcttgccaggaaagttgatttcagaccctcaactcagaggagatctgtaatcaaagagagaaataagatctataagaaaggggcaaaatttcattcaacaaatatttggtgaatgtataccatgtcccaggagctttctggctagaaaaaaaaaaaaagtggggtcaaacaaagcacctgttgttgtgtttgtgtttgtgttctggtaaggagccacagacaaaatcatgtgggcaaataaaaaataataatttcctgtatccttaattgctttaggggaaatataacagagtaagaaacaggaactgggcgacagggagggtacatggatgaggaggctacgtaaggtgaattagttggagaaacctcttgtactaggtcacgtttggctaggatctgagtgatagacgtcagccatggggagatctggggaaaagcactcaggcaaagagaagttgttcaaaagccctataccagccaataacctggctgatttaaggactgatagaagcccaatgtggcaggagggtggtgagctcagggaagggtacctcaatgcatcagagtctcactaaccacttagacaagagtacattgtattgcaatgaacaagcaatggaggttgaagtagggagtggggtggaattgatatgatctgatttgcatttttttaaagatgactctggctattgtgtatggagtagattgtaggactgcaggagtggaggcaggaaaacccatagggaagctgcagcgattgtccaggattggggcaatggtgatttgaaccagaatggtagcagaagaaagaggagtgctccaattagaatatattttcgaggtaaatctgataggatttgctgatggatcaggtataaggaacgaacaaagacagaaacgaatcaagggccctgcctaggattttggcctgacaactgagtggatgatggcatcttctgaagcagcctcagcctctctcctagaaggaactgcaggttgcacttgcatttgagagtctctgaggccctgtctgggagaaatatcagtggcctgcccccagcaactgctgctgagcattcttgggagccaagagtgtgccagggactgagaggagtaaaaagaggaaaaaacaagagcttcaccctgaggaggctgcagcctcagtgatccagtgggcatttattgagcatggaggcgagccaggcatgtactgggctctgcggtacagaaggggatgaaacacaggctcagaaaacacccatgtgagcatgagaggtggcacctggggaagtcagtgcagttcaagctgagctgaagggccaaaggccaaccattatggagatccagagacaggcctggggtggaggagggggcatggtaaccagagggtgaacaatgagagcaagaaggacacacgtgggaagaggccaggtagccctcacgctgccaaactggcgatcagacaaatcgcttttcctagacttgcccatccatatagattcccttcccaagatgttgtttttgtttgctttttttaatcctaggaaagcctccttttctcaggcaccctgtgggcaacagagaaccatgggagaagacagggtagggtggaggtagcactgtgctttgccattgcctataggaaaaaagggtggaaatatttcatctggcccttgtaatcttccacatcaggcccttcctcctttgtcactgttcttcctgctcagaggctaatcagccctcacctggtacagtctcacctccaaaccttcactcttgctgcttgctctgcttaaaataccttctctacctaatctaccacatcacatccacctgcaaggcccagtgtcagggccccctcttccacgtagcctgatctccccagcagaaaccattgtcacccacctctgagtcactacaccctctgatcctccattagagttgatgccactgaatgccttgttgtcattatctccatgtaagtctttagggcctaagcatgtgaacttctgcagcagaccccttggtcatctttgtccttttaagtactagaggaggtcctggcccacactaggtgctcaagataggttgcttaaattaaagaaaacacagacccgtctcctccctcttgttggagttggtccctggttccacgtctctcgagttgtggaggccacaacgtcaatggtgcaagctaagggcccaatcagaacaagtcacgccatgcccacgtggtgacattaggacagcttgaggcggaatgtggctcccagtttccctcgacagccgtgtgattcttttttctaactgcctttagacttgttcttactttcatcagccaggtacccagagccgattagaagttaagcttttataagaacactggttttattcttcttttcttcccactacatacctgaaaacaaagggctgtcaatcccctctcttcaaaacagcaaccagcagagggagggagggggaggaagagacctgtcttgcttatgtcttttctccattgtaagttggcagctgaatgattccatttcgggagtcagtgcccatccctatctcgcttacccaccccggagctgagcctctgaattgggatcctattgaaatgtttccatggttctctcactatccttcccccttcctccttcctttgtctctccaaaacatgcagggacaagttctatacacttaaataacttctgatgctacaaagagccttctcttaggtaaaatggttatcacctgcgtgctctgattaggcagacatttaggacatttccatactcctgtcccatagaagcctgatatcccatctttactagtccagttcccactgcccattccaagtggtctttggaaaacctaaagccctggagcagagtaaatttgtcagtcactaacattatagggggaatttctctcatagcaaaatcttttctccctccccagttttagaacatcttaggaattagacctcaatatgaggcagtaaattatacgggatgggacggtatctctctcccttttcttagcttagctccttttaataaacataagaatctcacaccttacataatttttgaaatttccatttttttattttttaaacataaaataatattatgatattaaacatgcttttttccaactaaaccgcttctccatgctgacattctgatggtgctttcagcatggagtcaagggcaccaatcattagaggagaccttcagagaagggacatgtccaacccagatatgttagtaccgggcggggggaaagtgggagcctgggaaggcgggcaaagccagcagacattggaaggaagcgtcagcaaggacaagctctgcctgagagtttcagccaggacagaccctgcttgatgaccaggtagactgttagggaagactatgtggttccacttaaagaacggaaatgcttttcctatgtggtcaggctttgaaaatgggggtcaggaaagaaaagtcatgaagcactcaatcccgaataaaagtaaaaacaatgtccccataaaattttggagactgattggcactattttcaaagtctttttaccaagggtagaacccagattttatgaagcctaagactaatacaatttcagaggctctatctaagaagaaaaaactaaaattataaatatgaaatgagaaatgaaatggaatatttaggatgagaaaggaaacccaaaaaattgcaaagtttagaaaagccaattctatcacaaacatcacaaaatccacacaaataacctaatatttttattaattaactcctgtaacacttccatgatacatgtttttctatactttttggctgcatatctttgatcatcttttaatatcacagttattttgtaatttcattatctatagaaagaacagagggattttcagtctttagtagggctgatcaaaattagtttcatattattgataaattagaaaagtttcttttgtgttcataattgattattggtgatgtgtaaatcattagagttataaaattggggaaaatctttatcaagtttcctttttaatatctctgggcatttcagattttcctgtggagtgaataatctaaatagtctttgaaatgatgctcattaaccagtttgtcattgatgtccttgtattagtgaaatatgaattctacatggggacttttactctctgcagtgatgctagacaaatcaacattgtagggcaggagcattcctcaaagacattcctattcaagaatggctagcaaccatttaactgggtgctaaagggactgcaagccacatgagctcatcctcctgaaactaaaccaaatgcaccccaagtcaacttctctttagttagaacaacaacaacaaaacaaccctgtggctactccaagtgcaccttcctcaaggggaaaatgtggcacagagagagttggaatgaaaaaagacaacagtctccactgattacagatttgtaattctgagcagaacatgagggattggagttagtccaaggcaaagtctgcccagcactaagggaagcagcctcattccttgcttccttcactcaagaaactgtttttccagccctaactctctcctgggccttctactaagtatctgcaattcagagatgactgagtcatgtcctattcacaaagaactgagggggacaggcacacaaacataaatcaccagacagcatgatggcagctctgagagacgggctgagaatgccacaagagaccctgaaggcttcccagagacatcattgagaccctgcagtgtgaagaagagctaatccatctcaattctcccatctgaaacaccactttttcctcaaagggctcacctaaagagtctgtggtattaaaaccatgcacacaaagcctaggcctatcccttgtaagtaggacatctgtacccagctgcatagactgactcggtgatgctgttattctggtttgttgcctgctaagcacccagcctgctgtgatcctggactggaatagcagtgacctcagcctttctccaaagctcatattcgtatgatcattcaggctctacactctccaacaacttgatccttcaccccgcccttctccttcccccaacatagatcttatattaatcaactgaaagcagatgttcttaggaaagaagtaggtcaggcctgcagacccaaatcccatccagtatttttacaaaatcttgactttaaaaagtgaaattgatattgcaataattaagagccaaatatgactaccactggtggcagataacatttcactttcattaagcaatataaaatagacgcgagaattcccggctgccaccctgacacaccaggctttgcagaatgaatcttaaattgcactatgtcagtcagagctcagaagttatcagcatcatttaattaactttttttttttttttgcaaaaactaacacattggaataaaatataaaaacgtaatccctgtgcaaacccaccactaatgatggcccccggcagaggactgagctacacctgagcagaaatcagggcattaaactctctttgtcccttccctgaagcctttctcctcaactgaaagggaaagaggggtcaggggtttcttccactttggcctagaagcctcgagaatgggagtggttctccttaattgagaccttggcatcttctcgtctctggcacgtcaattttcagccacaatttcctattgaaattgaatgtatttcttcccttaaaacaacaacaaaatttttactagttctctgataagaaatgataactggagtctttgactccaattccaagaggatattattacctataaatttcatttatggacgttattgcaatattggacgttaccttttagaaagaatgcatatttggggtcccaccccaagttaaaaggagacaatgaaggtgacatggagcagggaaaggaagtggttcagagtctcagggttcaacagcctttgcccaactgcagtaggctgtgagcagggtctctctcttgggtggtactcattctaccctgaaatgcaccaatggcaaataggtggtacatgtgtcaccatcctccctcccacactcagaggggacattgcaagtgagtcacagtactctttatacctgatattaaatttggtttcaaaatccttctaccaccacactcccagtggccattactggccaacacatgttggcacccaagatataacctgtttgccatcccttccttagtcaggaggcatatttcacctgttgccacctctgtcttgtgacagccacattgctgatgagagaattcaagctttcttgtccagattgtccaatgtctgggaggagtccaaaatcaggggcacttctcaagctattgagccaggagttgtcagttacaggggaaaaaagaaaaagactgccttttttgggcccctttatacaagaaacaaaaatgttatgtttgctttatcatcaattcttctgctaactgtttgttcttttttcctttctgttttctttctataaagaaataaagagtttaaacataggtaagatgaagaactctttcccatataatttgatatggttcgtttgcttccttgtgtttgctttttttgttttgtgcttcttgtgtaatgttgtatatttttatgtaccaaatatagtaacttttttatgtgctaattgtgtgttgtggatatgataagctttagcaattatgaaatgcagtcaaaaagcaaccaaataagctgacagtaattagaatttccgggagattcaagtgcaagataatgaaccctcagcgaacttctatcccgactgctcagtgcggtccataattgggctaaacagttgaggcaaactcctggcttttgtaaatgctggactgggttcacaaaagctttaatgaactggaaacgggttaaaaactcattttcaactcattaatgattttttcccctggatatatggtcatctttaaaaaaaaaaaaaagttaattgccaatctgctgatcagaatgaatccaacagtcagatgcattgagaattttcatggagtaaaatcacttttgaatagtttgaaggatggagaccaagtattctttgtcaaaaccgccttggtcattacattgatccaaggttatcatttaaaaccacactagtacaattcacagataaagtgtaaaacacacatacacgtgcattcacacatgaaccacactgaaatgaagatagtgtgagctttcttaaggaaaaatgaccttatttttattcagaagaagagaaaaaacaaagcaatctgtaccactactcaacggaatgcttctgctcactttttgaaatgaaacatggacagctctccttcatgatattaggtcaaaattagacaaaaagtagagtcaaattgcacaagatcataacagtcagtggaaaggccatgcattgacaaagtcctctgtcttcttctcaggcaccccaaaattggcctgttataggcaccccatttgagccaaattttaaaaatgagtagaaatgccctggaaggacatttttccaggaaattcaccaacctcatgtgatctttgccacagccacaggtatggaggcatggctgtccctctgacgtgagtttctctgcaagcatcttggtgaaaacaggtatgagaccatggagaagaatggtctccctaagcaagaactgacctcacacccaccactgcctgctcttctgccagagcttttgaaaagcctcctcaaatcaggctccctagaaagtccaaaattaattatctctctcataggtaggcacagatgtgcaatgccttgatccttctgttgataatgccagctactgttcattcagtaacagagtgcagcatctaattaaaaaatggcatgaatttttccctttctgccctaatttgttttgcatatatggatagtctctaatgacttaatagccaaaaaagaagaagaaaagaggaaaggaaaggaatgaaaccaggtagtctacgctttagttatctgggctggaatttcagaaaaactttgacttctagttcagggatgtgtcttaatagcaacctgaagagaaacgggaatgaaagaccatctcaactccacccagattgttcctaaaaatagcttcctagttcttttcttttttttccttaaatcagagaagaccccaaatggtggtgttttaattagtaatttactagctaatgtcaacaggacaaatgcatccaatgctgtcatctctctcaccttccctccacctctcccagcccctgtcttcccatcaccccaaagtaaaattgaaaaataataggaaaaggctggttgcatggtttatacctataatcccagcacttagggaagccaaggcaggaggatctcttgaggccaggagtttgagatcagcctgggcaacatagtgagaccccatctctaccaaaaaaaaaaaaaggtttttaattagccaggcatggtggcatgcacctgtagtttcaactactcaggaggctgaggcgggaggaccacttcagcccagggatttcaggctgcagtgagctagaattgtgccactgctctccaatgagaccctgtctctgagaaaaataaaataaaatagcaggggaaaataaagggggcctgtgctcatttcaaaacctagtctaccacactgaggcagaaaggcaattactgtttgcatcctagaggtgctgattgtaataaccagtataggaataacatgagcacctattctggtcccaacctcaaaccagtgacaggcactacaaagggaagaactgcagggttttgagccagaaggaacattagcaatatccagtatgattgatttaatccctccagcccctgcaaaaaagctaagacctgacacagtcaaatgacttaaccaaggtcaccaccagctgggtcagaattgagtttagagtttcctgtgttttagtcctgagccacttctacaagtcttactctgtcctagttagcctcacacagggcagccagacacatggcaggggaagcagcccaggtctcagaggctcacgccttcctaatacacttcacacacacacaaaggtattaatcccctagtgtggctgggagccctggcagaccgtggctcacgcctgtgacctcactgttacctagatttgaaaagtgcatctcctgtctcagtaattcagattccagacacagtaccagcaagatacccacatttctttacactaaatgccaactttatccatgtccacactgaagagcagtaaagaagcaagctctgagcctggagattgggggcggttatggggtgcttcccatgataaaattaggaaaactccaggtcaccctggtattaatggcctagtaccctggaagcataggttaaaatgagaacattgtcacatggaagtgttcctctatcccacttgagaatacactaagccctcaaggggaaattaaggagactgcacacacatggactgtagatggtcttgaataactatcctgcttacaaaaacaggatcggagtgggagctctcgtactggctaaatgaagcaacagttgtttagcatggtgggaaatgaattttctaatagcataagaagcataagtccaattagaagtagctaagaaccatgatgtgttagaacactgagtttgatgttagattctttccagttcactaaagtggaaagacactagagaaggtaagcgtcttgctaggatttttgtcattcctttgatctaggaggccagctccatagccccctcctcatttctctttgtgcttcttctactaaagcaacaacccagcacacaagtactacttggcagtggaccccgtgtccggctcgctctacgtgtccgacaccaacagcaggagaatctaccgcgtcaagtctctgagtggaaccaaagacctggctgggaattcggaagttgtggcagggacgggagagcagtgtctaccctttgatgaagcccgctgcggggatggagggaaggccatagatgcaaccctgatgagcccgagaggtaaaggacatcaaggaagagtctcccgccccagataaagctttgccaccagcttggctttcttctcatcagaacttaactaagtccagcagtccaaaacacagctttccctgtaatcatttaactcagatagattgctttggtgtgtggatgggtgtttaaaaagaaaaccagtcatgaggtcaggagatggagactatcctggctaacatggtgaaaccccatctctactaaaaattacaaaaaattagccgggcgtggcggtgggcgcctgtagtcccagctactcaggaggctgaggcaggagaatggcgtgaacccgggaggcggagcttgcagtgagccgagatcgcgccactgcactccagcctgggcaacagagcgagactccgtctcaaaaaagaaaaagaaaaccttatttatttatttgaagaaaactttatcatgcacataggctccaagtggaaagtgaaggggattgcgcctggagatttctgactgctgccagtcaggagaatcagaggaaatcctggctccatgggccacagtgccagctgtgtgggctggagacagaacaaagcccagcgaggggcctctggccacgcccagacttccgtggtagacagcaaatgtgtatgaagtcgaaagtgcagtgcctcacatgttgtaaatgcccaataaatggtagtaattaagaatgggtataatttccaggggtccaggatggaggagttctgggaacccatgggtctctatttgaaaaggactaaaaatacttaacattaaggagcagtcatctgagagtccaattcctgttagcatttttagctactgtgaaagcagcagggcagcatggattaaggaggcaaagccttgtacttgggcactggggcaaagacacaaaataaatagaagccatatctgtgcctttccagccctgctgcaacaggggaatgctaggccccagtgtccccctggggcattgaagtgctgattggagtcaagcttaactgggaatacttcctgaagcatacaccttgaattaggagtttgtaactacaagaatcatcatttctcagcattactgctgcaatcggttgtgaagtatattcaagtaacttactactaataatgtttagggtaatgaacttaggaaataacttcttttctaaggagagcagatgcaaagttatttcctgcttcattcatttgcggccttggttcatttgcagtccaaggagcatgctttcgtcagttgcagggaagaaggtggtgatatagccagcaccctaggaactatacaaatcccagcacagtgcccatgggaaaggatcttgcgttagaaggctgagaaccactgctctgagggtactaatcaattccagtaaggtctctggtctaagcagagtgctcagcaaggcatctcatctcccacctccaccccgcaatcctacacctttccaagagataaatccacaccgcttgtcttgctcaggtattgcagtagacaagaatgggctcatgtactttgtcgatgccaccatgatccggaaggttgaccagaatggaatcatctccaccctgctgggctccaatgacctcactgccgtccggccgctgagctgtgattccagcatggatgtagcccaggtgagactctttcttatttctcttcactaagcaacacctgccccttggcctgaggttcttacctgtttcctgtttggtttggaagtggaatgggagggagagatacagatacagatcacggggttgtttggagaaagcctgagatgagctaaacagtaagatggagtggaaaatgtcagataggtatgagagagagagagagagcaagagagagggaaaactgttgagaaaagtggaactggtgacacactccagccgtggcagattacagggtagaagctgctctgtaattacctcccttctccatcattattgcaggtttgagaatgtactgtacagtgttatatgtcaatcagaacttcccctttaatctgaaatgactgcatcctcactatataaacctttactttgtgcagtagtaactagagcagagccctctacaatatcacccaaagtgtgtgtttagtttgggctgttagagaggcagagaacagaggctcactcaaatatacagcatttgttctcagacagcctggaatatacgttcagcctttctataacggccttttcaacccttggcgagcctcataaatttcagctcaagttccacaacagacaacttgctactgagatttttatttcaaattccatagaggaaggatgcgttcggttccgtttattttttaaagcagacactcaagttgtagtttgctggagagcctgcactttggctccccttggatcagagccatcttccaagtcacatggctcctttttgtgaattagatacaggtgccgcctctaaatgtacatagcttccgtaggcgtctgcttggagagcagagtatgggctggatggcatggtctcttgtgcagtgaactacctgtgcaaccatatgtaacagctctgatgctggtccagccatctggagctgagaagcagcatcataggtagagctgatggcctgttctggtcatggcaggtgacacggtagaaaatatatattatattatctcttcttctccatcacacccactcatcatgggcaatgagcagctggttcaatgaagagcatttctaatacaatgtgttattaaaaagctgtcttttttcctagatatataaaaccagtaagtgccgtacggttaaacgttggacatattaaaggctgttctttaatctgataccacgtcatccacaggttcgtctggagtggccaacagaccttgctgtcaatcccatggataactccttgtatgttctagagaacaatgtcatccttcgaatcaccgagaaccaccaagtcagcatcattgcgggacgccccatgcactgccaagttcctggcattgactactcactcagcaaactagccattcactctgccctggagtcagccagtgccattgccatttctcacactggggtcctctacatcactgagacagatgagaagaagattaaccgtctacgccaggtaacaaccaacggggagatctgccttttagctggggcagcctcggactgcgactgcaaaaacgatgtcaattgcaactgctattcaggagatgatgcctacgcgactgatgccatcttgaattccccatcatccttagctgtagctccagatggtaccatttacattgcagaccttggaaatattcggatcagggcggtcagcaagaacaagcctgttcttaatgccttcaaccagtatgaggctgcatcccccggagagcaggagttatatgttttcaacgctgatggcatccaccaatacactgtgagcctggtgacaggggagtacttgtacaatttcacatatagtactgacaatgatgtcactgaattgattgacaataatgggaattccctgaagatccgtcgggacagcagtggcatgccccgtcacctgctcatgcctgacaaccagatcatcaccctcaccgtgggcaccaatggaggcctcaaagtcgtgtccacacagaacctggagcttggtctcatgacctatgatggcaacactgggctcctggccaccaagagcgatgaaacaggatggacgactttctatgagtaagtgggtttgtaaagcatctctgaagagcccttcccttgccctagctggcattaggactgggtcgcttgtgtagctttttaaattgctttgtcacgttgtctttctaactttaatgatgtcttatggcctcaagacattcatgtcccctctccctgactctgaaatgatttgctctaatggatctctgatattgagcatcctccctactagagttgggaattcctgttgcctgcttgccgttcaaatttcaggatattggacatgcacagcacctgggaggtaaaatgttgattaactttgctgattattcaagtttgccatgggtgcggaaattagaatctaaaaggcaagatcccagtggggttcctgtaatttgccaataggtccagcaacacacttgattgcacagacaggtagataaactctgaatttcctccttagcagaagcagatcgatacagataaagcattaggtatattaaaagatgcgagagctggtcatatttcccctaacaattatctcatacttaatagtcctgacgcttgttttgcaaaaagctgtttttcctagctcctgcaggcagttcttggtcaaagtgtctgctgctgtaggtactaatggtgggatgctggttggaggaagttactaggcatgattctcccagtggctggctgagactggagcagaatttataaatatctggctctcctaggtgatgaaggagtgtgttaacccctgtgtacttggagtccttgcttgtgttttgtctggatgctgctgctagctcagaatgtagttaagttagggagagttggcacagcaaaaaaaaaaaaaaaaaaaaaaaaagcgggggacaagagggagaacagaaaacctcattgttgatcattcctaaacccggcaatgtttacttcctgtttgtatgccaatggtcttgggagaatgtaaaaggaagctgttgccacctgctggatatttagtgcattgcagaagaattgcttcccctggttctgactttcttctttgggcaactctttctcaagcaccttaacgatgcttgagatttctgaagcatcttaatacccttcaggacactgtagttttgatcaaactttaccagccagtgattctgccctcgagggtaccatccgagtgctgtccttggctctcataccgaattaggctgaagctatacactcacccaaacacctccgagattttcatcttcctttctgacagtttcaaccaaagacctaatgcatttcagaaacaatttgttggctctcctgaaagagggggaaaaaacatccctctcagggaggccagcctgaactgggcctggtttacagactgtcataaagaagcttgggttcaagtgcatccacagatctgaactctaaaagggaaagtattttccagaaagtgtccctagtttaatgaaaacataggcatgactcgtaattgtgttttaaaatgttcagaagttacattgaaactgaatttttttatcttaatttgataagctgccctttttttcataatgtagataaatccagtgatcacaaattctccattgtggggttcaaatgtatagggttttcttttctacctgaaaagatggtgagttctttttgttttatggcacttttggcacatgatcagccaattggaagacacacagccaacttaaaaatcagacataacttcacctcctgtcagggcagtgtggtcaagaccaacactgcatagccttagccaaaactttagagaaagggtgatgaagaaaaccacacagaggctgtgaggctactagaaaagtctgtcctggtcgggagtgatgcctcatgcctgtaatttctgcactttgggaggctaaggcaggaggatcactggaggccagcagtttgagaccagcctggccaacatggaaaaacctcatctctactgaaaatacaaaagttagccaagtatggtggtgcatacttatagtctcagctacttaggaggcaaaggcatgaaaatcacttgaactcaggaggtggaggttgcagtgagttgagatcacgcagctgtactccagcctgggcgacagagcaacactctgtctcaaaaaaaaaaaagaaaaagaaagaaagaaaatgatttgtccttcagtgagagcttccttagggggattcctctcttcccactctgttacagggggcagagtacaaatccccctataggtgagaagagtggccatatcttttttttctgcatagaacatgaggtacagaagccatttatctgccgtgttgtcacagtgactgtctaaatatggatttgattatccccattttattgataaagaaactgaggctcagagaatcgaagtgactcccctaagaccacacagggagttggtagtgaagcaggactggaatccagatctccaagcccagcgttctttgcattgcacactagcgttgtaaagcagggctatgaatggaatttgtaactccaccttcagactccacatgggaactgtccctgaatttttgggaagatgtaactcaataagaccagcctatcaatgactctggaagcaggagagagaaaggggtaggaaaaaataacactatcgaatcttcctggacccattttatgatcagccagttccagaaacttccaggacatccaaccgtggaattaagatttccccagatgcaggccactgggtcttgatagaagaagtatcctgatttagtttcatccctgagggaactcaggttttcacagtcttccccaaaaggcagcatcttataccagaaagctcctaggtcttaggaccaggatgacaggggtgtggagtccatctctgccacatgcttactgattgacgttggacacgttatttaacctctctgagcctcaatgtctcatctgttacatggggataaaaatgcaaattaacaacaggagccctgtgctaatccactgagataatacatttttagaaattagcaaagcgcttggcatatagaagtttaactcagagtataggctaatgggatttgagaggaattattaagcacacctctgtctccttcctacccctcaggtttcactcaactaactgtagagtggatacaagagtcagacagatagagacttattttggaaaagcagaattgaagaatgcagcttgcacattaggtctttttaatacctcactttgcatttctcctgctctcttcccacctcccagtgctgcctgctggtctctcatcccctgcaggagcagagtctgccttagcaaacttcgggctcagaggggcagaaaaacacatcacccttaaaaagaggccctccagaagacagaaatgataaagagcctctttagtcatgttcaactccttctcccaatccagcaactggggaaggggcaaatgtcagatcaaaggaaaagatggaagttgacttcccatggtgtggggttcaagagtgattttacagaataagctgccatgcaattcatgaaggctggaatgggcccctttaaaagttgcctctctctcctctttgtcctgggaagtgaagagctgggcagaaatagagctgatacagaatgccttttggaaaccctatcatgcctgctaagttcccagactagggaagatgcatctgtattcctgaaaagaacagtactgtccttaaaattacactctctactccctatactctctccttctccactccctcccttctttattttagtccttagcacctattactcaccatctgacatgctgtctattttctatcttggtttagttttgccctcttcagctagcatgagtgcaagaattttgctccattttcttcccagccgtatctccagtgccttgaactgtgtttggcacatcacaggtgcttgatgaatatttattgactacataattcaaaggcagcctccagccccactccagccaaggctgggccagttccattgggttggcattgagatcccattgctggaacttacagcgcttcactcctacatgcagtcatttgcaaaaagacctacatctgaagacgttccttgggggaagtaagtagagctggaggcagccgaatcttcttaaaagttaaagaaaatctgtttttctccctttggcccatgagattctagtccctaccctaaagctctgctccctaaagtagaaactccaattcctactacttctctcataaggaaactcagcagcctatgcattgtaagtgtccccaaactacagtggattggaattaaaatccttgccctggtcccagagaatgtacttgtcagcaggaggagaaactgtctgttactgagtaccgcactagacaccccgtatccaaatacttagaattgctttgttttctgatgttttaaataccttttgtttctgtttattaaacatgaaagtattgattacaagtaatttcttttttttttttttttgagacggagtcttgctctgtcgccaggctgaagtgcagtggcacaatctcagctcactgcagcctccgcctcccaggttcaagcgattctcctgcttcagtctcccgagcactgggactacaggcacacggcactgcgcccagctaatttttgtatttttagtagagacagggtttcaccatgttggccaagatggtctcagtctcctcacctcatgatccacccgcctcagcctcccaaagtgctgggattgattacgggcacaagccaccatgcccggctgattacaagtaatttctaaattatgggaaaatgcaaagaagaaaatgaagattcgtcaaaattccatacagcaaaaccaccattaacatttaaatgtctatattttcagagaatttctgctccatatagatactgatattttttacccctccctgaaaaaaaaagctactgtcaagggagtatattttgtaccccacacttccactcaacacgtgtagatttgtgtatgccaataaatagaaacccatgttgtcgatcctgatggcttcataggtttctactttatggatagatcatcagttatttaatgaatctcccatcaaggaacatctaggttgttctaatttgtcactattgtaaatagcacctttgtccccctgcctgagaggtggcttctttagcaggtaagaaagcacagaggagccctattgatttagcagacctaagtccccatccctgattacaacaccagggctttccagggagtgcatggtctgcgccaccccatgcctggggccctgggcgagtgatagcggtggatcctgagctcacagacattcctgctccaagatctccctcctctctcccccaacacctttaggcagcgcggtgtacagcttaatgtgattgcactctcagctttcaaacttctgcagagcttcactgcttctagttcttcccagaagcaaagtttctcagatccctgaaagcctgagccaggtctgcaattctttattccaaaaacatttcctgagtgctctctgtctttgatgttgtcatcctaagccctaagcgacaacatccaacaggccacagcggtcctttccaccgctcacaggccctccccacagggatccttctctgaggaccccccatccccacgcgctgcacaagctccagttcccatccctcagaccctgccagctttttccctctccccagtccaaagggagtaacccgcaggagttgagccactttcccttcttttttaccctccaagcaaaatgtcttcatagctccgccttcttcctccccttcctcctccagtaacaaaactcatctgggagagctcaaaggcctggaaacgagcctgctttcctttcctgggtgtgagaagggcccagctctcagagtacagtggatcttccaaagtggggaaaggctgtcccaactagaacaaggcttcttgctaaaggtgatgtggggagaaaactccacggtgtgagaaaagaggaaagacgacacatatacataaagaaggaggccccagtgtcaggccatttgcaggcagtagggcatgatcactggtgtccctagacttacttgggtgctaaggacaactgctgatggtaagggagtcattgggaaactgtctaagaaggctgcttgggaagtggagccatggcggtttagtggggaccaaagaacaggttccatgcagccaggccttctatgctgagccaatttgtgcaggtggcatttggcacaggctgattgtccagaggcctaggagatgacaagtgagacaaggttggactccagtagaagactcagggcatggatggtctcaaatgcgagatttttatttgatttagcaaccaatgggaaaagagtgtggtttgttcagcagggaactgacatggtgaaactgctatttggggaatattgatttgatggctttgtagaagacctaaattaaaaaacaagagagggccaagtgcgtggctcacgcctgtaattccagcactttgggaggccaaggcaggtggatcacctgaggtcaggagttcgagaccagattggccaacatggcaaaaccccatctctacaaaaaatgcaaaaattggccaggcatcgtggtgcatgcctgtaatcccagctgctcgggaggctgaggcaggagaattgcttgaacccaggaggtggaggttgcagtgagcggagattgtgccactgcactccagcctgggacagagtgagactccatcatctcaaaaaaaaaaaaaaaaaagaaaagaaacagaaaagtaagagaagctcacaagtggctgttttctctaactaactagaggaagcctgagaccaggtgaaatgttttccaggagctgaagtcagttatatcagcgggtagaagaaagcatcacagctgtttctccgggcataatagggttttgactgtgacgaggggcctcagtgagatgcgccacccagccaacccaccttcccagctctttctctggccctgtgagtcttgggaacactgtcagccccaatgactgctgctaaccagggtttatctatctatctatctccccccagctatgaccacgaaggccgcctgaccaacgtgacgcgccccacgggggtggtaaccagtctgcaccgggaaatggagaaatctattaccattgacattgagaactccaaccgtgatgatgacgtcactgtcatcaccaacctctcttcagtagaggcctcctacacagtggtacaaggtgagcctccacccataccatcctacccccaaactcacccatagacccagaacccagccaagcccaacatgtgagttatgcagcctgggaggacttccagagacccagcgtacccctagctttctattttattcaagtgtccacagcaaactataagaggtcaatcttgtagaaaatgacttaatcagatagaacagaatgtcatctacacccagccaaatgtctagatatttgaactgtctacatagttatctgaaaatgtccatttccacccgccccccacatactctctccctacctcttacccttccatcaccacctctccccaccaacccaaaacacatagttatcttctcaaaggccatttattctcctggctcaccactagacttcatattttcttgttccatcctgattctctcttttaagcatttgtttgatgagttggttgccctgggactggagctctttaacattctctctccaagactgggatctcaaaggtctctgcccaccctgtggttattgttgctactagacatgttttgcagtccagggcaagcactggggctggcaagaaaatgaattgtgccgattaatttttcttttaattaagatataatgtcggtgggctagcccgttgtcagaggataaaagtgtcctctcagtagataaatggtgacatttctggactattatcccacagcggagcctgtttcaatgactctatttctgctctgccaaatgattaatgatgtagattctgtccttctgcgtgtgacggctggagtcacaggagcgacaggtacacacttgctcactgccccaaaagctgacatctcagaggccagcccaggccagctcctttgcccagacagtcaggaagcagtgtatctgtaaaaggagtctctgactcacatttccttcccgtaacttttcggtaaaggaaaaggtcagacgtctgattgactcgtgtagtttccactggggaagataaacacattatcagcacccacccactgactccagctccctgatgtatttgagtctcttcagagttctcttgagtgggggtggtatcaggtgcagtcggcagtaaaagcatgaggatggggaaggttgacttcttctctccattttctcaaagaaagaatcctgggctttgatttgtagtggatctggcctgtggctagaccagcaaccttgggttagacggcaggcaaaaggaggaaaactgaagtcatttgcctttctttttttttttttttttcctggtataagctaaaatatatatgttaagcttcgggaatttgattgacacaaattgtgtaggcaatagacatctttaaatgtttaaacgtgctattaatagtcttcagtgagtaaaagaaacatcacggcataattatttctggagtgccacatattatgtttttctttacgtggatcagtagtatctctgctacttaccttcacatggtatgtatgtgtgctaattgaaggcagccttcgactaatggctgcaaagtaccatggaaacctattaaaaaaaaataggggttctattctcttctgactaatagagcggataatttatttccctatccccacccccacttacatttttccagatcaagttcggaacagctaccagctctgtaataatggtaccctgagggtgatgtatgctaatgggatgggtatcagcttccacagcgagccccatgtcctagcgggcaccatcacccccaccattggacgctgcaacatctccctgcctatggagaatggcttaaactccattgagtggcgcctaagaaaggaacagattaaaggcaaagtcaccatctttggcaggaagctccgggtaagtggttccacccaatctgttaccacagagtgggaggggatatacactttcctcacagagctgagaaagtttctctgttaccacagagtgggaggggatatacactttcctcacagagctgagaaagtttcccagcttcaaagcctctaatacccctttattccctggaaaaggcaaactctccactcagaaggtagaatccatctccctttgggactcataccttgggaaaaacgttctccatttccatttcctaggactgaaaaaggcggccatttcctgctatggggatttacattacgctgtaactagagacagctttggtcttcttttcacacttgctgtcttcttcttcctcagttttcactgtctggccagttcaaccaatgaattggtgttcgtgcctactatgtgctgagtaatttgctaagtgctggaagaacaaaacttttaaagtatgttctttgcactcaaggaattgagggtctgataaaatatgcagacacaggatgatcacaggttaagtgaaaagacagaggtacatgcagggtctgatgggatcccagagggatgccactcagcctgagaggttcagggaagatttcccaagaggaagtaacaactgaacctcagtggggagttttagccaaccctcgttttcccagaccaggcaacttgccccacgtgacatctttttaaaaccaatatataacattaattatattattattataattattatataatgtaattttatattacatttttatattataatgtaaaccctatattatattataatgtataattatatacattatatgtatacataatatacatatacgtatacataatatacatatataatacattatatgtatacataataatatacattacattatatataattacatatataattaatgtataattatatgtataattataatattataatgtaaaccctatgttaaatgctttgcttgtattattttaactttttcaatagccccacgaggataattattactatcttcatttttcagatgagaaaacagactcagggaagctaaattacctgtccaaggacacaatagctagaaagggcaatgccaggactcgatcccacgtctctctttctgtctgactcacttgccaatatgtcacatgccttcctgcttatccgtggtcatccagagcttctcagcagaagtggattctgctccagtcacttatctgtcaccaagagggaacagttcctaccatcatgctaaccccttccctggggagggggaatgtaatggcatacaaagcaaaggccataacttcctgcaccttaccttcaggttgcggggagatgggagagaggggtagatcataagtaaaaactaataaataaaaataaataaataactgcagaacaagacaagcactaggaagtcagtaaacaatggaacaaagaaagagtttatcaaatgctttggaatccctgagagtagaaggctcagcatcgccaaagcttgggttgtaacttttttgctgtgtaactggattgaaatccagccagcccaggtgacctccctgcagagccaggcccctccatattaagattccgcctttgtctggctgaagtttaagtcaagtctccacattaggttagcagcagtctcccaggtttttcttcctctgctggtatctgcaaagttgcaaactgcagtagcctcctaaagacaaaaatggaatgagattagtagttaaatccttaatgactggatttcagggctgtgtaattgatttttgatatgctgcactgtagaagttgattataagtagtaatcgtgccttttctctgataaatcagttatgcattttgactaagttttccaaataaagataaatgtggccctaaaataaagtggctataatcccaactccaaatattaaaactctttctttaataatggtacttgtggtaattagcccaagttaggcacacaagtcttataactgaatttctgccagggttagatttgctggcatcgtgtttatgcaaatcaaaacacagttttatctatcaacacctcaacatttaattgtctggtgttagttcctgtaacaacaatcacatatccatttagctctcttaaatgaaaatcactatgagattataacaggttgagtggactgaaaatgtaatttgaaaatgagggagaaagcctggaatttatttgcatctcatttattttaattcagttcgtaaactgtttagtgaatgaaatgaaagcaacttctggaaatggcaggagagcagttggaagaaggtataagggaaatgttgggtgtgatgtggattgagggaactggggagtggccatttcgtcagatgtttcgtgagcccatggcagggagtttgcagcccctaagccgaaggtacccattggccccataaggctagcaggctgtctcaccattggcaagatgggctcttctctccctatctatctatcttagtcttgctgtgtcttttcatccctgctccactgtcacatgagggcatgaaagttcatttattcaaaagatgtttattaggtgccaacactacagtcagtaccacggaacaaggagactctagagagataaagaaaactgggtggcaccgactagctaacggtctcatggagaagacaatattagtagtgtgatgtaagctataatacaggccaaaagcacaaagaaagggatacttaactgtatctgctggaagaggataggccacggccaggtaacaaattaaccctgaaatctcatgggcgtaacacatcgcagtccaaatgcatcgggcggctcttcttaatgaggacttgctccagttgctctgtcttgcgatcctgccatcttaagcacaggctctgtgcagttgctgcagcaagggaagagagtttgggtgattcacgagagcttaataagcaggcctggatacggcaggcctcacttccacccaccctggtgagaacactatcagggaacctcaactgaaccacagggaagcctggaaaatgttgtcttttctgagtgcctaagaagaagaagatgaacaaagacttggtaagcacgtagcagagtgatcaggtctcccgtttgacaagagatcaggaagggcttcacagaggagctggaatcatttctgtagagtagtaagaatcagccaggcagagatagggaacagaggtgacaggacaaagaatgtcgccagtggaaaggccaagaggccaaaaagggaatggcatttcagaaaactaattcagtgtggcagtggatgtgttagagagtagggtagaaaaagaagatgcagccagagactgcacatggaaaagaacatggtgccaggctaacatttatcctgagggcaatggtgagccctacctggacttcattagcagagtgatgtgctgggatgtgtggcattagaaagctctctccagcctgggcacagtggctcatgcttgttttcccaacactttgggaggccaaagtgggaggatcattttcgcctaggggttcaagacaagaccagcctaggcaatatagcaaaaccgcaatatagcaaaaccctgtctctacaacaacaaacaacaacaacaaccaaaaaaaaaaaaaaagtttaaatagccgaccatggcctggcacagtagctcatgcctataatcctagcactttgggaggccaaggcaggaggatcccttgagcccaggagttggagaccagcctgggcaacatagggagaccctgtcatggtggcacatgcctgtagtcccagctattcgggaggccaaggcaggaggactgcttgagcacaggagtttgaggctgcagtgagttctgatcatgccctgtactccagcctgggcaacagagcaagaccctgtctcaagaaaaggaaagaaaagatctctctgacttcctcaggtatggaggaagacagatgagaaggggacaagatagatgataggaggagagggacagtaaggagggtgctgcattagtccaaacaagaaactaaatcactagcagcgaggaaagaaagaaggtagggggagagatttgagagatgtctagcacacgaggacgaggattgggcaactagcagggttgctgtgtcatgctcaccttttgacaggctctccccatgatcatgtaaactgggaaggctgggtggccgtccacgctttgtgggctctgtaaaagagagtggctgggagctgaaacccaagccagagatgtaagattctggtggccccagccctgcctcttggaatggagaagaaactaaatgaactttgaaatgcagccacttaaccagctccatgtaatcactgctccccatgtggagagcagggatttggagagaatgtgtgggtatcatgcatgaagcaaatagcctgaacgtccccgggactggcaagctcctgggagcctggtcagctgaggggtgtgagggcccaaggctctgaacattcctggagtttagagaagaccaacaatctcagtgaagccatcacaatagaacagtgcccagtgaaattccaacccacctaggtaccctttcttcccacaatcctccagacggaggcatctcttagtggaggaaagtatcagtggctcttccttacagcctggggaaatgtaagatgatggcggatggatagaccgggaccacatcctttcaccaaaagctttgtaatggagtgttagtcccttcattcctgcccaaactcagtgcagggaagattttcattatgcctcccaagaactcctcaaagaatctcctttgaaagagtcctccccctccttcccgcattgtcctccattcctttcttcactcactctggccttgcaaaaacatgaagcaggccgggcgtggtgtctcacgcctgtaatcccagcactttgggaggccgaggcgggtggatcacgaggtcaggagatcaagaccctcctgaacaaaatggtgaaaccccatctctactaaaaatacaaaaatcagctgggtgtggtggcgcatgcctgtaatcccagctactcaggaggctgaggcaggagaatcgcttgaaccagggagtcggaggttgcagggagccaagatcgtgccactgcactccagtctggcagcagagtgagactcccatctcaaaaaaaaaagaagcagttacatcatggcatctgtgagctccataagtgcagggaccaggtcgcccctgtatccctggtgacaagtgccatgtggtgggtactcagacaacaggtgacaaagaaagatgtaataactgtgccttctataggcgccttcttaatgtgtaaatgctcccccaccacagtgggtataaattcacaaatacattgcccctacatctgtctggaatccttccactgcaagagacaggaagtgcattcagactaacttagaagagtaggcgctgtcttacctaacagggccaccacaagggagaagctggcctcagagactctaagatgtcattaaatggtgtactagtctgttttcacgctgctgataaagacatacccaagactgggaagaaaaagaagtttaattggacttacttacagttccacatggctggggaggcctcagaatcatggcgggaggcaaaaggcacttcttacttgacggcatcaagagaaaatgaggaagaagcaaaagcggaaactcctgataaacccatcagatctcgtgatacttattcactatcactagaatagcacgggaaagatcggcccccaggattcaattacctccccctgggtccctcccaacacatgggaattctaggagatacaattcaaatcaagatttgggtggggacacagccaaaccatatcagatggacgtctctctttctgtttctcacagcccccttccatcccatggcagggtttctctctcggcagttgacctaattttctcctacagtagactaatgtcctcttcacattgcgggggtggggggtggtcaggcagacttagccaaagttgactccaggcttacatcatcacagctaagtgaacccagaggaaaaaggaaggtatctcccccagcatttctatttttcataaaatatctcatggaagaaagattgacctggcagagggagttcacattcctgggcaaatcactggtcagggagctggggatctgtgatgagtcaggcaggcacaggtcacatgaccatacctgtatcttataatagacatctcagtaaaagcacctagacagggaagccctagaaaaaagaggtgccgtacccaaaaaagaaagaaagagatacaaggttaaaatataaatatcccaaatatagtctacatcctccatccctccgaagcctaatcataaggcgaaactcctggccctgaggatctaaaactcctggccctgaggatctcttgaggctctattgcctcccaccccaacaagccttttttctaggcttttggaagagagaactgaaatcaaccccttctattaagatttaaaacttctaccctttcctaaaacggatcttgtgcaggatgattctctttctttgtaaaggaaagcatataaccacgctctaggatatttcttcctgattgtgatttacatagagattgcagaagcaagaaacagctacatgtgtaggtagcagaacaaaagaaaaattgcttccaagataatcttccatcatgatattggtattagtgttattagtattccaagaagaagtgggagttagtaattttgttttggctcccatataattaatatgacattgcaattacgtgttggcatgtgttacttttacttatgtggcaaatcacagtgacagaggagggaggtggggggatgggcgtgcctatgtgcatgtgaacacacacacatgaactcagttctgcgtggagcccactcaagccggtctgttaacacacacaagtcattatgaaagcctgaattttcacagctccttcctgccacaatgcattcattcttcacgtgactaatattttatatttcaaacacctcctgtgttcttggcactacgctaggcactgagtgtacattagtgaacaaaagatttcaccttacatggtgagcagcacttgtgcaggcagaacttgggataaatttaatattagtttaaataacacataattagaagggcaagcctctgcaaacagattaaataatgtattccccaagcaaacattacttttgggtggcttctgtttgggatgatgatgtggaaaagtggaaaaaccctaatggagcttatgcctttacctcttataccttagcaaggagataataatccaataaatgtacaaacaatatatagaaattgtgggctgggcacagcctgtaatcccagcactttgggaggcccagacgggtggatgacctgaggtcagaagttcaagactagcctagccaacatggcgaaaccccatctctactaaaaatacaaaaattagccaggtgtggtgcggcacgcctataatcccagctacttcggaggctgaggcaatagaatcacttgaacatgctagacagaggttgcagtaagccgagatggcaccactgcactccagcctgggtgacagagtgagactctgcctcaaagaaaaaaaaaagaaattgtgatgggtgctttgggaaaaatgtacggtggagctaatacggaatatatgatataggttaagccctctctgagaaaatgacatttgaactgagaactgaatgaagagtaggtaggaatttcccaggcatggagttgggggaaaagcctctatgctaaagccctagcatgtgcaaaaggccctgaggcagaagagacttctgcctgtatcctgaacagaaggagagctccagtgtggctggagtaaaccagctgagggtaaggtcaaggggtagagccttatcttgttggcccttttaaggatcttagaaatacagaagtcttctgcagattatccacccggtacatgcaaatgagccctcatcgggagcctccttcttggacactaggaaatatacaacatacctgactcctgaaagttcaggtcaaaggataacaaatatagcttattccggtcatctgggctgagcctccataccagacaccctctgccccttctcactacatccctaccaatggaccacccacctgcactagaatactcacagcatcacctgaaaacagccatgctctgcctgtgcaaggcctttgctcatcccctgtgctttcatttgctgaccctccccacctggaatattctccctgattcttctcccaccctcacctgtccaagccttactcatacccaggcccccactgagcagcgctttctctgggaaatcatcctcatcagtcccagctctggttccacatccttcctcactgccacagttccttccctgtgtctactgccattaccacactaaaaatggtttttgttgttggctcacctgtcgttatccccctctggcctgtggcctgcccctctagggcaggggtcataactgtcttgttctatcttacaacagtcccagtaacaaacacagagtaggtgcccagtaaatattgaatgaaagaatgaatgaatgaatgggattttccactgacataatgaaaatctgctccctcccacgtttgcctatgaattccaggtcccaggggccttccagaatgactctaataggtctttggaatgaagcttttcagatattttgagaccacagatgtcctaatcatatatatatatatatatatatatatatatatatatatatatatatatatatatatatatatttttttttttttttttttttttttttttttttgagacagagccttgccctgtcacccaggctggagtgcagtggcacaatctcggatcactgcaacctccacctcccgggttcaagccattctcctgcctcagcctcccaagtagctgggactacaggcatgcaccaccatgcccagctaatttttgtgttttctaagtaaagacggggtttcatcatgttgaccaggctggtcttgaactcctaacctcaagcgatccacccgcctcagcctcccaaagtgctgggattataggtgtgagccaccatgcccagcctaatcatattttctattcctgattttccacgttggaactttagatcatcagagttagcagggttcttgtacccagtctgattcagtctgcttattcactaatgttcattgagcaccaagcactttccaaaacaaaatagagacactaagaaaaataagataaagtcccgactcaccagttcccaggctattacagatgaggaaactgagacatgaatggtgaaggtatggttttggtatggcaaagctaatcagtgacactgatgagtatcaaaaccgccactcaaactcgggtctttccacctgacctccatccaaaacagcaagtcatccaaacataatgtttgcttggggaatacattatttaatgtgtttgcagaggcttacccttctaatgatgcattatttaattattatattaaatttatatttaattattaatattaaatttatagcaagttgttttgtctccacaagcactgatcccaatgtagcattgagtcttgttgtgtgggagctggggatagctactttttaaatcccaggccgggcgcggtggctcatgcctgtaatcccagcactttgagaggccaaggcgggcagatcacaaggtcaggagatcaagaccatcttggctaacacggtgaaaccccgtctctactaaaaaaatacaaaaaaattagctgggcatggtggcgggcgcctgtagtcgcagctactcaggaggctgaggcaggagaatggtgtgaacccgggaggtggagcttgcagtgagcccagattgcgccactgcactacagcctgggagatagagtgagactccatctcaagaaagaaagaaagagagagagagagagagagagagagagggagggagggagggagggagggagggagggagagagaagaaaagaaaagaaaagaaaagaaaagaaaagaaaagaaaagaaaagaaaagaaaagaaaagaaaagaaaagaaaagaaaaaatcccagaagactgacccggaaagaaaatgaagatgtcctctaggccaggctttacctctgggtaggtaaataactaaactctccaaggcaaactcttctgcttttaaacgtcgccagacagggagactctcgtgacccccctcactaatcttttttgggtttcccatactcaaagcaggatgggcaaagggttcttctatacgtctaactgaaatctctcctgctgtgttacaattccgtttcctggaggggatccagcccagtgtaatttcctccctcatgtttctcaaatcactagctcccgtcattgcgcctggagctaagttagagtcaccagttataggcccagcagggccgttttgaagacagcgtttccttttctccaggttttttatgagcttccttgtgacaggcgtatgcttggtgagatcaaaacgttctggggggatattctgcaggggaaaccacttcccaaagtctgccctctgcaaaaataaaaaagcatgctaaatagctgagttttattaactggggaagccaggctgaggaaaatgcccgataattaaaaataatggcttccttacaaacacaaaattgtattaacttaaaaattggtttctctatcactgaattcctaccaagccgactgggaagggaatcgtgttgatcccggcagtgaaaataattcaaaataacttttatgttctccaggaagcctcaaggttaatttaaatattgctagctgggtaatttaattcagaataagagaacattgcagctaaattaaagctcccacatgctctaaactgggggggcaggtatcctcaaagggccgatcgtgcctgttggaccctccagcatctcgcacccacagccggggcacccccctttataaatggcaccctcataattaaagaaatttgattagattacacaactggcctgaactccttggctcaccttccagtgaatttttcagatttaattattagaaggattgggcattttaatagaaattttcacatttcaaagttaactcaaacctgtgctatcaaaaaatcccattgtcccagggatatggtaaatttgcaagtaaaaacccaccctaagttatccatggctaatggctagcacctatcattacttctttatagttggtgcacctgggtcaatggtcagaggcctctcagctctaagtaacagcagtaaatcccagggtggcagtcagaggttagggacccctcttctttgtttacccagtatttagttcttttgtaatcccatccaagcactaaccaggcctgatcctgcttagcttatgagaccaggaatgttcagggttctttctgtaatctaagcaccctcacacactaatatcatccttattatgatagtcatgatcacatatattatttacatgttggtctttcccatgattacatattatagtatattatgcacacatatgtacatctatacacacatatgattatattatggttatatatgtgattttcccattggtctttcccaggtaactaaagataaggccttatatcacactgagtgtattttaaccaagagtacacatcagaatcacccagggaggttttaaaaatcaaaaatccacagctgggcacggtggctcatgtctgtaataccagcactttgagagactgaggtaggcagatcacttgaggtcaggagtttgagacgagcctgaccaacatggcgaaaccccgtctctactaaaaaaatgtaaaaattagccaggcatggtggtgcacctctgtagtcccagctactcgggaggcagagacatgagaatcacttgaacccagggggcagaggttgcagtgagccgagatcgtgccactgcactccagcctggatgacagagcgagactctgtctcaaacaaataaaaatcaacaagacccaaacccctattccctgaggagctgattcagcaggcgtggagccagccgagcagcagagctttaagagagtgtcccatgtggtttagaattgcatgcttgatggaaagcctgtagtccaacacccctcaatcctagaggtgtacaacctggaggttaagacagcaagctctgtatggggatcctagctctaccactgagtatttatctaaacttgagcaagtcacttaaacccatctatatcttgtgtgcaaaatggggatgataataatgcctgcctgagagtgttgttgtgtaaattagacaaaacaagggcaatgctgagaataacactcagcctgtgtaaatgctcaacatgttgctgttgctgtggtttttcttccttgtataccagagcagacaccaaagcctggcattagctgacactcaatgttcaataattaataaatgcactagggccctatgatatgagcaaaaagaaaaaaaaatataagaaaagggaaggaggaaaaactaaggatggccaaggggatggaaataagtaggcatgatggcaagtccccagcagttgcctccaaaaaccctggaaatccttcctcattgttgcatcattcattctgcctaacaaaatgttggagaggtcttgaaccaaaatctgaaacccataggtttaagaatgatggtggccttccgcagttgtcccagatgaaccaacccgatgtgaccaagcttctgttggcagaggagaagacctatctttctgaccaccactgtgtgttttgctctgaaaatgatggctccaatcccgtataattcagacggcattaacttttggacctgtttttaaaaaaataaaaaatcctactactcagcctttgccttcttgactattcccagttgctggaagttgttgataggaatcttccacttgaagttagggttccttataatcccaagaactcaccacctttatttccctccccatgctttgatgcattctcttttctttttctttttgttctttttttttttgaaacagagtctcactctgtcccccagggtggggtgcagtggcatgatcttggctcactgcaacctccacctcctgggttcaaacaattctcctgctcagccttttgggtagctgggattatagacacatgctaccatgcttggctaattttttttttttttttttttagtagacacagggtttcaccatgttggccaggctggtctcaaactcctgacctcaggtgatctgccaatctcagccccctaaaatgttgaaattacagacatgagccacacgcacctggcctatgcatcctcttttctaattgtcctataataaatattctatcctctctctgagatgaccttatagaaacagcaatggtttggagaatctgtagtcctgggttcagattccacttctgccacttgtctagttatgggactcctgtagacctcagttgctcttatgtaagatagtttctatgtcatgaaagtgaaaatgggatcaggtatgtaaagtacctagcatagcacctgccaaagtatcaggggcttgtatcaatttagatttgtttccaccgctagtaacagagattagcaatagcaagggtttaaacaggatttacgcttattattttcctatgatctgaaaggagcttagggaaagcaatccttggctgtatggatgaacactgaagacacctagatcaacagagatctagactctttttctctggataggccatcatcctggaggtctccagccccaaagtcacctcatagtcacaaggtaaatgctggagctccagccatcacatacacatttcacccaggaaaaggaggaaagggaagaattaaagattgcctagctctcagctgagtcaatttcctttaagaatatttcccagaagaccagccaacaacaaccacttacatcttgttggccacccgtatctctgaaggaagctgcgaaatgtgtttcattacctgggcacaaagctgtttcccagaatgcaagtgtctgtggtattagaattattccttgtcccaccccctcacacccccaaagctgcaatgtggagcgttcaagggctgtgaaaatgcttcacagtctgttcatcatttgacacatttcagggcactcaatggacatacaatacaggaagcagtaaagctggtgaagtgtataagaagttaactggttaaagtctgaaggcctaagttccagaccaatccaaccacttcactgctgtgtgaccttgagcaagttttgtaaccactctgtttgaagctttttttatcatttgtcaaatggtctttgtgagcaacaactcaaacaatggatgcaaaatgcctaacacaatgcctgtatatattcgtcctcagcatatattaaagtcatcattactatcagctgggcgtggtggctcacacctgtaatcctagaactttgggaggacaaggtgggtggatcacctgaggtcaggagttcgagaccagcctggccaacatggtgaaacctcgtctctactaaaaatacaaaaattagcccagtatgatggcacatgcctctaatcccaactactcaggagggaggctgaggcaggagaatcacttgaacccgggagacagaggttgcagtgagctgagattgcaccactgcactccagcctgggcaacagagtgagactctatctcaaaaaaaaaaaaaaacttattattactatcatcaccaccatcactaccatcattattaccagtaagtgctgttgaattattagggtaaagtgaggaggtaccagacatctctcgagtctcttcctttcgcctatttacatcatcccttgccttcagcagccaccccagggatgtctggatttgcagtcagtgaagttgtgagagcctgggctgagtctggttcatttcattcacttccagccacccactcagggctagctgaatctcaggagcccctctcctttgcccctcaccagagtctagtctcccagctctgccttctgggataggctttcttctctgatcagatcaacttctaaataaatattaaattatgtctgatgtgtttccctattcctttcaaatctaagtaaatcagttcatccctttgttggaaatcccctagccctgctgaggcctccccactgatgtctcacattcttgacagtgacaagatttttctctagatattagaaggaaagaagttcacataggaatgaggcttcatattcccaaatctttgtaaaatatggatttctaagccctgttctccactcttctaggtaactttacttaagatttcataagaaattatggcacctgttcttaaagatcattagcttctcagctaatgatgtgccaaaaagagttccaagtgtgcaaatatgcaaactctcttgcccccagggtggccaggcagcccaggcaaaactccagggttcaagtctgttgtatattgctgtataatttgcacactgcacaattttcaccattcacactttccacgatcctatggcaccctttgtaattgtgcagtgcacagcctacccaactgcccatcacagccatgcccaggtcaatcatctctgtccataagctgccttatttttatattctattgcatattgcaccatacaaatactaccattttcttttctttggttttttttttttttttttttaagatagagtctcactctgtcacccaggctggagtgcatggcacaatttcagctcactgccatctccacctcccaggttcaagtgattctcctgcctcagcctcccagtagctggaactacaggtgcatgccaccatgccagctaatttttatatttttagtacagacggggtttcaccatgttggccaggctggtcttgaactcccgacctcaggtgatccacccacttcagcctcccacagtgctaggattacaggcgtgagccaccacacccggccaaattttgccattttctatctgtgccatgataaggagcttagaaagcactactctaactttggggttatttcttcctccagtgaacacttaagccctggccatgccagccatgtcctccacagaagcctgagccggcatgcctgggtgatgtctttcaaacaaggcctgttgtgttttcctaggtccatggaagaaatctcttgtccattgactatgatcgaaatattcggactgaaaagatctatgatgaccaccggaagttcaccctgaggatcatttatgaccaggtgggccgccccttcctctggctgcccagcagcgggctggcagctgtcaacgtgtcatacttcttcaatgggcgcctggctgggcttcagcgtggggccatgagcgagaggacagacatcgacaagcaaggccgcatcgtgtcccgcatgttcgctgacgggaaagtgtggagctactcctaccttgacaaggtaggtgaacatgctgccctgacagcaagggctttctgttatttctgttattccggcttctttttttttttgagacagagacttgctctgttgcccaggctggagtgcagtggcatgatctcggctcactgcaacctctgcctcccaggttcaagtaattctcctgcctgtgcctcctgggtagctgtgactacaggcacatgtcaccacgcccggctaattttgtatttttagtagagatgggtttccccacattggccaggctggtctcgaattcctgacctcaggtgatcgcccacctcagcctcccaaagtgctgggattacaggtatgagtcaccgcacctgaccatttctgctgctcttgtaagctagcctgatatgttttgccatgagacatcttaacatctttacttcgactctacaaggacttccctcctgctcccaccctcacagagggaagaaaatctgaaggcaaatgttattcatagctcagcactattaccattggggtggggggcgggggtgctagacgctcagtaatggcaaaaaggacgaattgtctgattctatttcaaaaaagaaaaaagtactgttgaagcggacagaatcatcccactggcagcgtggctcatcattacttatgaattggaaatgcagtgattcatttctgtcttgccctaaattaagccgtcaggatggggaattttgcctaaaattcaagcacacagagcaaccctctcctatttgccctgttggctgaaacagcccatgaattctctctacatgattccctgtgtctgaaagtgccaaattcaggtcttcatgcttgaaaaaggtcaggttggagtggcggtaaaaaaaaaaaaaaaaaaggtccctttgggcacgtatcaagacttttgaaggctgccctggccatgtagtcattagacagggcttgctcaacccgggcctctcacctagactccccttggtgcaggtccattccttcctttctcaccaactcattacagcggtgacttgcagacaaagctgttacccctctgcaagacagaactgctgtccccttggtccttcctgaatgctgtccttgttatgcctgaaacacaggaatgattgaccaggggagcaggaacctcccaattgcctctaattgaagtcatttttttcccccaaagaatcagtgattctaggttatttcatctttgcagtagcttcaaaatgcaggatgtggctgggcgcaatggctcacacctgtaatcccagctctttgggaggccgaggcgggctgatcacttgaggtcaggagttcgacaccagcctggccaacatggtgaaaccccgtctctactaaaaatatgaaaattagccaggcgtggtggtgcatgcctgtaattccagctacttgggaggctgagacaggagaatcgcttgaacccaggaggtagagtaggttgcagtgagctgagattgcaccactgcactccagcctgggtgatggagtgagactctgtttcaaaaaaaaaaaaaaatgcaggatgtgttttctcttttttaaatttaatcagggtatgtgtttcacacagctcccctgctggacccagtggcagtcatttctaagcaatcttggggttccttgttattgagcatggaggtaaacctcatgcctcttacttcagctgtccaggccctcaattcttaaagtatcatccaagcaacattggcatttgcagggagtttgttacaaaatgcagattctcaggccccaccccagatctaccaaattagactctgcctttttacaagatcctgagtattttgcatgcacattaaatttgggaagcactggtctaggcaaccaccatgatccatcaaaattggcatgtccagtgaaataaatctgtttaatctggtctaagcttcccatctttcatgacttttgagttgacatttggggaaatggactaaattctgtctgtttgaatgcttggtcctcaaaagccaactgatatgttctgttcccctttcctttctgcagtccatggtcctcctgcttcagagccaacgtcagtatatatttgagtatgactcctctgaccgcctccttgccgtcaccatgcccagcgtggcccggcacagcatgtccacacacacctccatcggctacatccgtaatatttacaacccgcctgaaagcaatgcttcggtcatctttgactacagtgatgacggccgcatcctgaagacctcctttttgggcaccggacgccaggtgttctacaagtatgggaaactctccaagttatcagagattgtctacgacagtaccgccgtcaccttcgggtatgacgagaccactggtgtcttgaagatggtcaacctccaaagtgggggcttctcctgcaccatcaggtaccggaagattggccccctggtggacaagcagatctacaggttctccgaggaaggcatggtcaatgccaggtttgactacacctatcatgacaacagcttccgcatcgcaagcatcaagcccgtcataagtgagactcccctccccgttgacctctaccgctatgatgagatttctggcaaggtggaacactttggtaagtttggagtcatctattatgacatcaaccagatcatcaccactgccgtgatgaccctcagcaaacacttcgacacccatgggcggatcaaggaggtccagtatgagatgttccggtccctcatgtactggatgacggtgcaatatgacagcatgggcagggtgatcaagagggagctaaaactggggccctatgccaataccacgaagtacacctatgactacgatggggacgggcagctccagagcgtggccgtcaatgaccgcccgacctggcgctacagctatgaccttaatgggaatctccacttactgaacccaggcaacagtgtgcgcctcatgcccttgcgctatgacctccgggatcggataaccagactcggggatgtgcagtacaaaattgacgacgatggctatctgtgccagagagggtctgacatcttcgaatacaattccaagggcctcctaacaagagcctacaacaaggccagcgggtggagtgtccagtaccgctatgatggcgtaggacggcgggcttcctacaagaccaacctgggccaccacctgcagtacttctactctgacctccacaacccgacgcgcatcacccatgtctacaatcactccaactcggagattacctcactgtactacgacctccagggccacctctttgccatggagagcagcagtggggaggagtactatgttgcctctgataacacagggactcctctggctgtgttcagcatcaacggcctcatgatcaaacagctgcagtacacggcctatggggagatttattatgactccaaccccgacttccagatggtcattggcttccatgggggactctatgaccccctgaccaagctggtccacttcactcagcgtgattatgatgtgctggcaggacgatggacctccccagactataccatgtggaaaaacgtgggcaaggagccggccccctttaacctgtatatgttcaagagcaacaatcctctcagcagtgagctagatttgaagaactacgtgacaggtgaggattctgccaccaaaggtgggcagtggctccctccagggtacttgttgctgtggggaacttgggaggaaggtctcccatcttatggtaggagaagcccatgggccataaagcccaggcagtgcagttggcagcactacagagtctagaaaagtagagagacggcagtacagagcagtcatgaggactgtttgaagatgtcccaaccactttcatgtccagtcagttgaaataactttataagagcccttcctaccccaacagaggaaagcagtaagaagcggggagagaatagggctctggtgtcagaaatacctggttcaaattctctctcttctatttataagccaaaggaccttggactagttgttcaatctctctgaactatagtttccttccctgtgaagggcactgataaaaccatcctacagagtgatcatgacaagtaaatgaacacagctgggcatggtggctcatgccacccacgtaatcccagcactttgagaggctgaggcagatggatcccttgaggtcaggagttcaagatcagcctggccaagatggtgaaacaccatctctactaaaaatacaaaaattagccaggtgtggtggtacatgcctgtaggcccagctactcaggaggctgagccaagaaaatcacttgaactcaggaaagcagaggttgcagtgagttgagatcatgccactgcactccacctagcctaggtgacagagcaagaccctgtctcaaaaaaaaaaaaaaaaagtaaatgaacttgtgtagttatagtctagtggatgatcatgaaatggtatctgcttgtgttattaacattgtcattactagagaagcaatgagtgagcgtaagtatcgagatgactgtaacccagttcctgacctccagaggctcatctggtgagagacatattcaaataaccaacgataatgcaaagtagaattaagtctttgctaccatataggtgtctgttcagttgtttatcaaaacgcatttataaagtggcactgtgctaagttctggggattcaatggtgaataagacaaataccgttctctcaaggtgtgtgtgtgtgtgtgtgtgtgtgtgtgcagattaattcagattttcaagattggcataatacagaagggctcatgtcaaaatgggcctgaagaattcatgggaccttggccggcagaagtgagctcaaggctgaaggaaggctatgaacaaatgtcataaggacataggaagtttggagaatagcatgaaaggaggggccaagaaaggcagattatctacttctctgtgataagtgagaaatgggtgaaatgaattagctgcgtgtggtggcatatgcctgtggtccaaactacccaggggcctaagtagggagaatctcttgagctcaggagttggaggctagagtgagctatgatcatgacactgcactccagcctgcgcacagagtgagaacccatctcacaaaaagaaatgaaaggaaaagaaaagaaaaagaaattggtgaaataagagtctctctccatccatccattcacccattcaacaaatatttgtatagtatttaaattgtactaaatactagagacacaatgggaggaaagataaagtccctgtcctcagggaaatgagcaaggaaatcaggatggctggatggttgggtggatggctggatggatggctgactggatggctggctggctggatgagtggatggatggatggatggatggatggatggatggatggatggatggatggatggatggatggatgggtaaatagatggataaattgatggatgggtaggtggatgggtgggtgaatggatggatgggtgtgtggatgggaggatgaatggatagatggatggttggtaggtaggtaggtagagagaaggggagagagagagtgagatccaaagagaccagggccccaaagggctaactttcagcaagcaggctggggccatctcacctgtttatgctttgtatagagaaacaataatgaggacccaagaccagaaccccaagttccagaaaactcacagctcttggtcatgggccaaggaggcatcgacactcaggtgactgaggccacttgtccatccccaaggcaggaatggaagcagcatctacctggagcacagtgctgccatctaagccccatgctgcagaaataaacaaacatccttaaagatcaactgtggccatgcattgcttcagtgacaagccccggacctttggaagtcgaacccagaatccccaagccccagaagcatctgggacctttcggacccggaagttatggccaagcgacctaggctaacatctgtaaaccctcctgtcctcctcccccgtgcctcatcgaggccctgccagggcttccccgcttaccccatgcttagcataacttttatccccgaaatcactgcagctgcaaattaaaataagtctcaagaaaacacacatatatagtattaatattaggtaatgatacatgatataaagatgaaaaaataggaagaggacatggagagcgatgagaagtgtctcctttatggaggggatcacggacggcctttctgagcaggtagtgttgatcagacatttatgaagtgcagggagagaggaggagtgttccagagacaggaaactgtgaatggggaggttgactaggcctaccttagccataggagagaatcctgccccacacagaatgtcccttccagaagcctggttggtatcagacaccttgggaatgaatcagccagagaggcaataaagagaaacccacagtgtgggctgaacagacatgtcccgctgccaagacgcaaacaaaatcatttcacagggcacagtcagcctcactgaccccctcagctacttacctggctctccagaaaaggccaaaaaataattagcagggttttctgaatagcaatactgcttttctcattccggtgtttcatggagactcaataaatgggaatcaaatcaagttgaactaagtccaacgaaattgaatccagaaaccattagagagtctaaaataaagggtggtgtcagagaagcggcgtgcacagggtggatgtcttcagtgggagccaagggagagaaggagccggaccaggcacagcccacgctcgggcagagacctgggagtggggatccaagtggagaacaccaaatcattctctgctgttcacatttggctcatctgtaaaccccatctaaattagtcttaatttgccacttaggagactagcagagtggctgaactcactgctcacaatgtaagcagaagaggtaattaagatgtagtcgggaggaacacaaagaacagaaccttttctctccagtacccagtagcagcaaaagaatggtggctgtttggagacagaactctctgaatgcaagtggcagctcctgaagccagagaagggtctatttgttctgcccaagaatgtgaggacaaaggaaagcaacccagagtactgactgggtaggagctcagagacatctgggcaggaacacaaattagcctccaggagcaggcggagggggcaagaagtggttccttctcacttacaggctgcaaagcagcactcttttgaacagttactttttaaggtaatatatggatgattgacatacctgtgatgaaaagatatgagaagaaagagtgtaaaagaaagactgggccaggcatggtggcttaggcctgtaataccagcactttgggaggccaaggcaagagtatcacttcagtctaggagtttgagaccagcctgggcaatgtagagagatcccatctctaccaaaaatttaaaagttagccaagtgtagtggtgcacacccgtggtcccagctgcttgggaggctgaggcaaaaggattgcttgagcccaggagattgaggttgcaataagctgtgattgtgccatggcactcttttttgagaccctgtctcaaaaaaaaaaaaaaaaagactgggagactacctcccaacaacctgcaatggcctagacttttccaattttagcatcccaggaaactcttccgtcttggacacactgggatctataccctgcccccagctctgccctattctgaggccagttctctctcatattagaacctgagtccatctcaagacaccacttcttggccaggcgcggtgactcacacctgtaatcccagcactttgggaggccgaggcgggtggatcacctgaagccagtagtttgagaccagcctgagtaacatggtgaaaccccgtctctactaaaaatacaaaaaaaattagccaggcatcgtggcaggcacctgtaatcccagctacttgggaggctgaggcaagagaatcgctttaacttgggaggcagagattgcagtgagctgagatcgcaccattgcactccagtctgagaaacaagagcgaaactcagtctcaaaaaaaaaaaacaaaaaagaaaagaaaagaggcactacttctaaccttgccaatcacttgctgtgtgacttagacaaatatctcaaccctttagagccacagtattttttgtttgtttgttttgttttgtttttttgagacagagtcttgctctgtcgcccaggctggagtgcagtggcatgatcttggctcactgcaacctctgcctcccgggttcaagcgattctcctgcctcagcctcccgagtagctgggactacaggcatgtgcaaccacgcccagctaatttttttgtatttttagtagagatggggtttcactgtgttagccaggatgttctcaatctcctgatcttgtgatcggcctgcctcggcctcccaaagtgctgggattacaggcgtgagccaccgcgcctggcagagccacaatttcttcatcagcaaaatagtaatgataataatagcagtcaccttatggggtcttgaaaactaaatgcatcatgacatgtaaagtgcctagcacagagcaaaggctaataaaagcacagagcaaaaaaagctaataaatgcattcattattttattttttttttttttgagacagagtctcactctgtcgcccaggctggagtgcagtggtacgatcttggctcactgcaagctccgcctcacgggttcacaccattctcctgcctcagcccgcggagtagctggaactacaggcgcccgccaccacgcccggctaattgtttgtatttttagtagagacggggtttcaccgtgttagccaggatggtctcgatctcctgaccttgtgattcgcccgcctcggcctcccaaagtgctgggattacaggcgtgagccaccgcgcctggctacgcactcattatttataagcagctatggacttggaggtggggagttcaaagatgaagagtgaggacactgcctttgtattattttctgaggtatgtggagaacggtctcccgatccaccttgaaatagattccaaccctgctctgaatggcattgctttagcaaagccccagataaaatttgagttcagtgaccctcctagacgtggcccatgatgatgcatatatcccctatccctttctccctgttgggtctttggctacgaaccccaggcacactttagcttaaagtcagattttgtaaagtttaatttacctaagtgaggaggaagacacaacctccttctcacatcatcctcttctcatatttacacttaacacctgaaggtgctgcactgacagcgtgttcagagggagaacgcgctttggcggtggataatcacacgctgtgaagaacgtgagaagaggagagtcatgagctattaggcggtgccacagtgccagctcctgcccaagcaattccctctagacagactgtttagggaggctgttaccagataacaccaattacttctaaaggaggaggggtgttgtgttgtctcagaaatgccttccgcagcatggagcggagtcactagaataaacatttccaaagggattgaggctcagaaaccagccatgttagaaaatttaaagaagaggaaagagggaaaggggagggagaggaagaggaagaaggggaggaagaggaagaaggggaggaagaggaagaggaagaaggggaggaagaggaagaaagggaggaagaggaagaatagaaagaaaagtaagaggaaggaagaagaagagaaagaagaactacaagaactaggacataaggattgctgttcatgggaatggccattgaaattcctggtcacagaggcaggagggctcttaacatcactttcacctcctcaagggatcctgagctagggagagagagatccctggaggaaaaagatcccaatgaggagagtcttctaaagacaaggccttctcagccagttgcggtggcttacgcctgtaatcccagcactttgggaggctgaggcaggtggatcacctgaggtcaggagttcaagaccagcctggccaacatagcaaaactccttctctactaaaaatacaaaaattagcggggcatggtggtgcgtgcctgtgatcccagctactagagaagctgaggcaggagaatctcttgaacctgggaggcagaggttgcagtgagacgaggtcacaccactgcactccagcctgggtgacagagcaagacgctgtctcaaaaaaaaaaaagaaagaaagaaagaaaagaaaaaaggacaaggacttctcttgcttttcttggaattccctacataccctatccctggtgaaagatgggacgatttgatgtggtatacagatgaagtattaagtaacaaaaaaacacagatggggagagatagtcccttttcaatgctctcttaattctttcaattcagaggagaaagtctcacttgatgctggtatgtatttacacctcattaacacttctttttttttctttttttccttgagacagagtctccctctgtcacccaggctggagtgcagtggcacggtcttggctcactgcaacctccacctcctggtttcaagcaattctcctgtatcagcctcctgaggagctgggactacaggtgcccaccaccaagctgagctaatttttttgtatatctttagtagagacgggctttcaccatattgatcaagctggtctcgaactcctgacctcaggtgatccacccacctcagcctcccaagtgctgggattacaggcatgagccaccacgcctggcctcattaacagttctaatctcccttttcaacagagagagcaggtctaagtctccctcagtggcaggtaacaaaatcaagtactctaatttaattgcttgactttgttttctttgttttaattttacagttattttctgtttacgccaagtaagcctactttcccattcatggtagtgacataaaatttattttttatttatttattttattttattttttgagacgaagtctcactctgtctcccaggctggagtgcagtggcatactctcggctcactgcaacctccacctcccaggttcaagcagttttcctgcctcggcctcctgagtagctgggattacaggcaggcgccaccatgccatgctaatttttgtatttttagtacagacacggtttcaccatgttggtcaggctggtctcgaactcctgacctcgtgatctgcccgcctcggcctcccaaagtgctaggattacaggcgtgagccaccgcgcctggctagaatttatttttttaatggatttacctaaatggaaaggcaaatttattttttaatcagtaaataaataataatacaagtgatacctagatatggcaaatatatatatatgtctatatgtatatatatgtgtatatatatgtatatatatttttagcaacaggtggccatgaatattcaaagttgagaaaccagtgctctccacccaggacctacctggtacatagtagatgctctgtaaatatatggctgttgccagattaaagccaggcttctctctgcttgatattaacgtactttttaagggaatttcaaacttgtattcttttttttttttttttgagacggagtcttgctctgttgcccaagctgaagtgcaatggcacaatctcagctcactgcagcctccacctcccgggttcaagtgattctcctgccccagcctcctgagtagctgggattacagctgcgtgcaccacgcccggctattttttgtgtttttagtcgagacgaggtttcaccatattggccaggctggtcttgaactcctgaccgcaggtgatccacccgcctcggcctcccaaaatgctgggattgcaggcatgagccacctcgcccggcctcaaacctgtttcttaaatggactattgttatgtgtgtagatgccaagtctttcaatgactagtctgtgcccaaggaaggtggatagatcaaagctcccagattccttctccttagagggttcttatatatccatatttttggcagcaatgtcaacgttaaatacctcacagtagtcccagggcagaaggtagttatgcctgagccccttcagaagtgtgttcttaggcacagacagatccactgtcacactactactagtcagggtagctcttgccacatatgtcctgtgctcattcattcattcattctatagatacttacggagcacctattttgtgccaggcattgttgtagggcctagggagacatcaatgaagaaaacaggtttttaaactccccatgctggtggagcttgccttcaccaggcaagctggagtgaaagagaccataaatacaataaatgtggaaatgacacagcatgttagaagaatgtgactgttgttttggggggacatgagcaaggtaaggggactagggattgcaagaggtggggatggggggtggcagttggggttggccttaccgggcaggcagagtctgagcaagactgaaaagaggagggagagcaagagaggcagaggatacgtttagggaaaagcccgctgggcagagggcctaccaacataaaggtggtgagatgagtgcatccctggcatattcaaagaacagcacagaggcaggagcgagggagagcatgggagatgtggtcagacaggtcgtggagagggcccttccaggccattagaaggactttggctttttcaatgaaagaagtggggagaccctggggtgctctgaacttctcaggaatgtcatgggcagctcctgatttttttttttttttttttgtgacggagtctcactctgttgccaggctggagtgcagtagcacgatctctgctcactgcaacctctgcctcccgggttcaagcgattctcctgcctcagcctcccaggtagctgggattacaggcacccgccaccacgcccagctaatttttgtatttttagtagagacggagtttcaccatgttggacagtctggtctcaacctcctgacctggtgatccgcctgccttggcctcccaaagtgttggaattacaggcgtgagccaccgtgcccggccagctcctgattgaaaggctcactcaggttgctgtgctgataaggaatgtggggtgcagagcggaagcatggaggccagttagacatccctcgggaggtgctgaactgagtagaggcagtggaagtggcgagaggagacacatactcaggacctattgtgaaagtaaaagtaaaggatttagctgcatgacccggcaattccacacctacacatacacacaagaaaacggaaaacaggctttcaaacaaaactttgtgcaggaatgtttatagcagcattattcataatagtaaaaaagtggaaacaggccgggtgcagtggctcatgcctgtaatcccagcactttgggaggccgaggcgggcagatcacgaggtcaagatatggagaccatcctggctaacatggtgaaaccctgtctctactaaaaatacaaaaaattagccgggtgtggtggcatgcacctgtagtcccagctactcgggaggctgaggcaagggaatcacttgaacccaggaggcggaggttgcagtgagccgaaatcgcgccactgcactccagcctgggtgacagagcaaggctcagtctcaaaaaaaaaccaaaaagtggaaacaacccaaatatgtatcaactggtaaatggataaacaaagcacactgcatgctccacaatggatgaaacttagaaccttaaaaacatcatgctgagtgaaagaagccagacacaaaaggccatgtatcatgggattccattcatgtcaaatgtccaaaacaggtaaacccatacagacagaaagcagtttgtgggaggggtaatgcagagtgactactaatgggtatgaggggctttgggaggtgatgaaaatgttctgaaattagtaatgatggttgcataacattgtgaatgtactggaaaccactgaattgtgcactttcaaatggtgaattttatatgagttttacatttttttttttaaagggaaatgattaggccaggcacagtggctcatacctgtaatcctagcactttgggaggccaaggtggaaggatcacctgaggttaggagttggagaccagcctggctaacatggcaaagccccgcctctactaataataatacaaaaatgagccaggcgtggtggcgggcacctgtaatcccagctactcaggaggctgagtgagtgtttcaaggcacggacatccaggaatctctattgatcagtgtggaaggagtctttttctaaggacctagaccattcagcagagggcaggacacttggggcaggtggcataattcccaatgcaaggacttgatgttggcctgtgtggcaggtggtcttactctgggcagtcagtaccctttcttggtttctctttaaagagtaggaaggctgggccgggcacggtggctcatgcctgtaatcccagcactttgggaggctgaggagggcggatcacctgaggtcgggagttcgaaaccagcctgaccaacatggagaaaccctgtctctactgaaaaatacaaaattagccaggtgtggtggcgcatgcctgtaatcccagctacttgggaggctgaggcaggagaattgcttgaacctgggaggcggagtttgcagtgagctgagattgcgccaccgcactccagcctgggcaacagagcaagactccatctcaaaaaaaaagagagtaggaaggctggagaaagcctctcatggtccagaggactctgctttccatctgtgtccagctcttggaaacccctttccatagtgagccagcctcagtgcagtggccccagtccaaaaggcctgcacaacagtaagaatcatcacttatccctccagtccatcctgtatatccagcctctaaacacactgcgtggcctgtgatagatgctcccttaaacacttgctaaataaaggagttgatatttattgagcagttaatgtgccaggcactgcgaaaagccttttatgtggattttctcctttgatcctcataacaacccaatgagaccgacacaattattatcccaattcatatctgaggaacctaaggctcagagtggggctgggacttgcccaaggtcacacagccaggggattcgaagctagatctgtcttacttgagcaagggtcttcttaatcaccacatggtggttatcaactgaccaagtttgatatctgcttcctaaaacccatgtatggaagccctgggtctggactcaggagacagtcataagctcttcctccctcccctttgggccctacacccaaccacccattttattttgttctctctttaagctctgctgctgctctccatccatcatgatttcagaaacctttatttttgttttccaccatagatgtgaaaagctggcttgtgatgtttggatttcagcttagcaacatcattcctggcttcccgagagccaaaatgtatttcgtgcctcctccctatgaattgtcagagagtcaagcaagtgagaatggacaggtaagcagaggttcctgccaagaatccaaatgattgtcatcattcccttttgcaaacagaacctcatgggagccaggggcatgtcagcgcaggaaaacattggagctgggtataaaaggtgcaggacacattgagacttcccaggaaagcgaatgtcagtgctgtcgcctgtctggcacagcacatatttcttcccaacttcgattattgccttaattgtggtatcattatctgttcagtagaatacctttgagtcactccttgattaacaacagcacagagaaatctagcagcaacctaccatctgcactgcctataagatcataaccctttcagcttttatgggatgtcataaaactgtggtttgcagtttctgtcccattaaagaacatttttatgccccacataaaacctcggcgctttatggccaagcatatacagattgagttttcagaacataatttgtgcttgggtctttctgcgatgaccgaggggtggtcagtttccatctgggtgcagctgagacctctgctacaatcagatgggaggcgttcagataacccctgctacagaaccggcgctcagcactatcaaagtctgaaaggtctcagctgctctgaataattgtccagattgtgtaactatagagaggcaaggaggagctgctgggtaattgagaacagcgttcactcagtcctgccccttggggaccactcagtggatgaatagccatcatttctctcatttatctaagtgccgttacctcccaaacgcagcctctcccattatcccagcctgtcccccaaccaccaattgagacaagttgtaatttgcgagtggagaactcaaggccaaggagataatggtgatttcatcccctgcagaaccagggcgaggatccaaaacaactgcctcaaagccaggggatattccctctggccctcaaagcctgactctctcagcctggtgcttctcaaatgttcatatgcacacagatcacccaaggcatcttgttcacacgtagcctctgactcagtagttctggagtgaggcctgagattctgctttttgaacagggcaggtcccagtgattcctctgctgctggctatactttgagtggcaaggtcttaacccaaggaagttaatgaatatccaagtcattggcctccaggaaatctagcttacagtggtggggttcgaggctgttcaaatcaacatcctgcccttcgcatcaggacattcctgggtctaaagcgggcaaggcagttgccaaccatcagagtacagaacagggcacttcccgagtggtggcatgacccggtaagtgtgtaggtccaggtgcccatgccagcaaagggtgaacctcctttaccatttttttagttagtggcaattgcaagatggacagaccacaccatcagagcattagtaatcaaccagccatccatagttcagagcactggtaatcaaccagccaaccatagttccaaaaggtaggactcccaacagctcagatctggatagacccaacactagttcttgcaggagagttccaagcctttctctttgtgactctttttgagagagctgcccagctcatcttctcagctttctctgttttcttatccccacagctcattacaggtgtccaacagacaacagagagacataaccaggccttcatggctctggaaggacaggtcattactaaaaagctccacgccagcatccgagagaaagcaggtcactggtttgccaccaccacgcccatcattggcaaaggcatcatgtttgccatcaaagaagggcgggtgaccacgggcgtgtccagcatcgccagcgaagatagccgcaaggtggcatctgtgctgaacaacgcctactacctggacaagatgcactacagcatcgagggcaaggacacccactactttgtgaagattggctcagccgatggcgacctggtcacactaggcaccaccatcggccgcaaggtgctagagagcggggtgaacgtgaccgtgtcccagcccacgctgctggtcaacggcaggactcgaaggttcacgaacattgagttccagtactccacgctgctgctcagcatccgctatggcctcacccccgacaccctggacgaagagaaggcccgcgtcctggaccaggcgagacagagggccctgggcacggcctgggccaaggagcagcagaaagccagggacgggagagaggggagccgcctgtggactgagggcgagaagcagcagcttctgagcaccgggcgcgtgcaagggtacgagggatattacgtgcttcccgtggagcaatacccagagcttgcagacagtagcagcaacatccagtttttaagacagaatgagatgggaaagaggtaacaaaataatctgctgccattccttgtctgaatggctcagcaggagtaactgttatctcctctcctaaggagatgaagacctaacaggggcactgcggctgggctgctttaggagaccaagtggcaagaaagctcacattttttgagttcaaatgctactgtccaagcgagaagtccctcatcctgaagtagactaaagcccggctgaaaattccgaggaaaacaaaacaaacgaatgaatgaacagacacacacaatgttccaagttcccctaaaatatgacccacttgttctgggtctacgcagaaaagagacgcaaagtgtccaaaaggaacaaaagaacaaaaacgaataagcaaagaagaaaacaaacaaaaacaaaacaaaacaaacacacggaccaataaacaaagaagcgaagataagaaagaaggcctcatatccaattacctcactcattcacatgtgagcgacacgcagacatccgcgagggccagcgtcaccagaccagctgcgggacaaaccactcagactgcttgtaggacaaatacttctgacattttcgtttaagcaaatacaggtgcatttaaaacacgactttgggggtgatttgtgtgtagcgcctggggaggggggataaaagaggaggagtgagcactggaaatactttttaaagaaaaaaaaacatgagggaataaaagaaattcctatcaaaaatcaaagtgaaataataccatccagcacttaactctcaggtcccaactaagtctggcctgagctaatttatttgagcgcagagtgtaaaatttaattcaaaatggtggctataatcactacagataaatttcatactcttttgtctttggagattccattgtggacagtaatacgcagttacagggtgtagtctgtttagattccgtagttcgtgggtatcagtttcggtagaggtgcagcatcgtgacacttttgctaacaggtaccacttctgatcaccctgtacatacatgagccgaaaggcacaatcactgtttcagatttaaaattattagtgtgtttgtttggtccagaaactgagacaatcacatgacagtcaccacgaggagagaaaatttaaaaaataaaaataaaaacaaaaaaaattttaaaaattaaaaaaacaaaaataaagtctaataagaactttggtacaggaacttttttgtaatatacatgtatgaattgttcatcgagtttttatattaattttaatttgctgctaagcaaagactagggacaggcaaagataatttatggcaaagtgtttaaattgtttatacataaataaagtctctaaaactcctgtgga

SEQ ID NO: 416 - DNA, 50595 bp, Homo sapiens
ttgtaaagattcaatgacaaagttttattaaataccaatactggctaggcacaattagacacattattatctcatttgctgtatctggtatcaaacaacaaagcctgaaagattaccatagattttgatggcctcattaacataattaatccgtagtgacattccctggataataaatacagttttatgtccgtgtgtcttctgtgtcttccaagttgctacagggctctatttgatctgagaaactgactgctgtttacatccaggtatgcaatgtgacattagaattgaagcagaaaggaagcaaaacaaaacagggttcatgaggaaaataatcttctaagaactaacatggcctggaggtaaaatgcaaatatatccggtaataagaagcccagattactgcagataaaagattaaaataggattcaattattcatctccatttgcaaatctacaaactaggaggaaggactaacccttttcctgggattagtaactaaatttaatgattacagcaaatataaagttcttttgtaaattattgttggttaaggattgacttgcattgacaacacactttagctctcgcccctttcattctccccctgcaagaacaaaggcaaaatgaacagtgaggaaaacctggaaacaggaccgagtgtttgctatcacttgattcctttgaaggagcaatgctttctcataatataggttttatagtatcatcaagtacatcagttaagcaaatcaagtgctttgtgttctgtatataaattacataatacaagagtctgtggcagttaagaatctggttctgcactttgggaggccgagatgggtggatcacgaggtcaggaattcaagaccagcctggccaagatgctgaaaccccgtgtctactaaaaatacaaaaattagccaggcgttgtggcacacacctgtaatcccaactactggggaggctgaggcaggagaatcgcttgaacccgggcggcagagattgcagtgagctgagatcgtgccactgcactccagcctaggcgacagagcaagactccgtctcaaaaaaaaaaaaaaaaaaaaaaaaaagaaaagaaaagaatctggttctgatcagaatccttaaaatactgtcttcttttttatcacaattgcccttttggatgtgagtgctggtctcaaaaagatttgcagttaaaagaggaacagcaaaaaagacttacaccaaaatagcaaccaactctaaaactattacaggtgagaggtagacagcttcataactcaatcttctactaccaggtgatgttaaaaaaatactttaacatcaaaatcacctacaaatattcctccactttcatatgctgagcaatttcagcttagagtgactaagtgttatttatctctctatcttcggcacctagcacatagtaggcagtcattagttatttgctgaatgaaggaaaaaaaccttcatctgaccaacgataaatttcactaaaattgactataataaaatctgtatgggctccacatgaaaactacatgaacttcacttccccacatacctgacagcctatacacttccttatgtttcatttctttaaatatactttaaaaattgcttatttacacaataaaaacaatgtccaccataaaaaaaaaagtctctagaactattggaattagtctcagaataactcatctgattggatttgatatgagatcattctcagattgttctgtggaatctcccaattccaataatgatgcttgcaatatcctttagctgtctatcagttctggtctttattcaggcccaaagagagaagaaagaagtagactaagataaaatgggtagtctgtgtattcatgtagtgaatatattcaagacataaatatgagacagaaaggtcacttctgcaacaaactaagtctgatcagagttaagttagcttccctctctgagcctttatttttctcatctctaagacagattcatcctagaagctctctggtcctttttagcttcaatgttctatgattggttctcatttaattgatgcaccaactgaaacactcactaatcatacattttgctggaggttgatcaatccttagcaaatcaggaagaaatgaatgttccacttacttcgtgcagaagctcaggaagctgggctctaaaggcccaagtttttgttgttgttgttgttgttgttgttttgcctgaagcaatgtatgtaatttaataatttaaatagtgtttaattaaatagtgtcttgtttaaatgctatataacattttcaactgcggctgcacaccagaatcactcaatgaactttattttactgctgcttgagtcccaccctcagaggttccttttaattgatctgtgtgcagcctgggcatggggacgtttataagctctccagatgattctaacctgagcaaagggaatgatgactggcatagagcaatgagtctcaaactttagcatgaatcagtcacctggaaggattacaaaaacacagattgtgagatgccacgctcagagtttttgattcactaggtctggaacttcttttttctcttctgggaacttgctttttgttttttgtttgtttgtttttttgtttttgagacaaggtctcactccgttgctcaggctagaatgaagtggagcaatcacggctcactgcacctcagtctcctgggctcaagcaatcctcccgtgtagctgggcctacaggaatgcaccactaatttgtttgacttttagtaaagacagggtttcaccacattgtgcaggctggtctcaaaactcctgagctcaagtgacccacctgcctaggcctcctagagtgctgggattacaggcatgagccaccatgcccagcctatgaacttgcttttctaacaagttccccagtaacgctgatgcttttgtcaggaccttgctttgagaaccacttccagtgagagaatatcattgatgctggcatctgaagtcctgagtttaaatcctgattctattattaccacctacataatcctagtcaagtaattttttctctcatttttagtctctttgtgacaatacttagatcccagagttatgagacatgaaataatgtaccaatcagagtttggtacagtccctggcatagaacacaataacaaatattaacttcctttttccattatacatggctagatggaacaattaagttaaatcgataacacataagttgaaacttcacaggaaaacaaagtacagctagttgaagcaaacaatatcttataattatacatgtaatacagaatgatagagaaatgttttaagtacttaaaaataccttcgttcaattttcaaaactttgaacgtaataatttaggtagtaggaacattagatgcaatctatagaagaaatattagactcaatctatgaagaacatgaatttttttacaacctataatggatcctgatacctcatctataattttagttttctatagaatcaataatataattagtgtacctgcttaaaactgtattacattgatcttcaatgctacttaatttctgagaaaacctaagttataagagtacatcagaatctctattatcaaccaaagcaaaacttctaccaacgacagaatggatactttttaaacaaatttacatataccaacaagcaaaaaactagagctttcattcctgcttgacatttttttcactttgtgtgtctcaaggctctctcaggaatcagtgtccaaaccatgaggtgaatcctgggaggtaagcaagcttgctgtagaagccgctgtacatgccttcaggaacagaaagggtaccagaggctgtgccctcctagtgtggctggttggagtgacaactagaatgttgtccgtgtttttctgtggaacctacaatgagtccagttgtctaagtgagtctcaaaggtattgaatagttgatgtcaaaaggcactttatgtcaggactgtttaaagcaagtttctccctataccagtagtgacccagaggcaaggtcttaccggacctcttattttcaaaagccttccctttccaattgagcctgatgccattatgtgacatctttttttccctgaatttctaaaagaaaatgtgatgattacctgcatatcttctttgttgctgcatcgtgttttgcatggtacccctttaatattgttttcaatacttagcctgctgatatacttttaacttctcacctgtttatgaattctcttaactaggctgtgaggcccttaagggtcttcaacttgtccctttcctccacgtaactttctcaaacgccccagttctcagtaacttttctcttttgctgtctgtaatataaacatgacccctacttacactgtcctacctatgtggccaataagagtgttgtcttcgcagttggaacccaaaagccctatgggatggaggatatgcactgtacttctttgtaaaagtgtcttgacaaagctgatgtccaatcaacatttaattaccagactgtccaagctagaaatgaaatacagttgattgcctgagtcctgataatcttgctaacaaaattataaaaggcctatagtatggccaatatatttggctaatggaaatgattttcttaaagccagaaaattcagctacccatagtgcttaaaaccagccttaaaagaacatgaacaggatggttcccaccttatcgagatcactggcattccatagtatccattcattcatatcctcctcctaggccgcatgaaacacctaccacatttccctacctcctaaagcaaacaaaactcttttcctccctcttgctgcaaaaaggtttattaaaagccgtatgtagtgtataaagcctttcaaaaatactagcaatccatgcctttctttttttgagatggagtcttgctctgtagcccaggctggagtgcagtggcgtgatcttggctcactgcaacctccgtctcccaggtcctggttcaaacagttctcctgcctcagcctcctgagtagctggaattacaggaacgcgccaccatgtccaggtaatttttgtattttcagtagacatggggtttcaccatgttggccaggctggtcttgaactcctgaccttgtgatctgcctgcctcggcctcccaaagtgctgagatgacaggtgtgagccgctgcacccggcctcattttaactaaatctgaagccagagttgatttgatgcccatcctgccagggaggcagttccttccctcaggtttgttagtagaaaccaaaaagtagcctgagagggttcaggtgccaccttggaggcactaccttatcttttgtccttttagagttttcttgctggggtgtttggctccagcactatagcccttaccacaatcattccacctggttcttcaataggactctgaggtatcaaaaaagtcactagggcagcccagagattggtacgatttacctttacacctcaaagttttttagatgtgagcagcgctggattatggcaatttaccttataataactcaccatagttggctgttataagaataaatattgttcttctaagatttttaattagttgcttcagttattacatttttttctattttttttttaaatagagatgaggttttgctatgttgcccaggctggtctcctggactcaagcaatctcccacttcaggctaccaaagtgctgggatttacaggcatgagccacctctcccagtctcagttattattttaataaatgagactgaacgtcctcttataaggctcactcccttgttcctactacatttgctctgtttaagtatctctttaaattcttcagttaagatcatcccttttatcagaaacctagacaccacaaagtagctttctcacctttaattctccatagggatcactattatactataatatttgcatacgtatgtgtatatatgtatttgcttttttaaaaaagtaaaaatgctcttctcactctttgtcgatataggcacccaggtacgtagttagaaattaaataaaggccacaataatttcccaaggaagatcattaaaaagaaaaatcctttcttcctctaatatcacatagctggcctttatggcatgccagctaagaaaaaaggtattgcctatggtgacaggaagactcaatctttctctctttgggttgtagctgaatttctatcaaaagtcctagtaaaatatataactcctcatttgttctaagccaagtcttttcttcagttttccttcaaacaatacctttactttcccattagaatatgaagaattggagactgtgaacagcaaggtttggggtgggtatcagtcacttcaaatctggctatgcagagagagggaaagacatggcagaatagcaggggtggagggtgagtgaaatgtatcttcattgggagtattgaaagagagcaagtttttcaaagttgttgccggtatctcatgaaagcccaggctgctaccatggtgagggcaaacactggcaccagcaccataaatatgggaataccacttgggtccccttcacctcgatgtcctataggtccattctgcacctgtaactggaagggaaagaaaaatgttaactctagtgactaatgtgtgtttgcaactgaaacgcccaggttgatacatcacctgggtttgtagactctagaccacccaaaactgtaacccccagcaatacctagcagaaggagtcctctctttgtcctgagctgatgcatcagtgtcacaggatctttggaaagaaaataggtctaatggggaggcatttaaccttgctgacctaaagggacccgtgagggcaagtcaggtaatttctgtttctgtactgcctctaccttgctatttgtgtatcgtatcaggaaaatgaagacatgagataaaacctatgatcttatagggaacttggatattacttggtgaggaagaagggggatctttctggaaatgtttacttagataatcagtcatcaaaatgtagtaagagcagatgtgggcaatgtcaacataggtgcaataccaacatacgtccaatgccattacttgaaaaatgctttccagatcccagaaggcacccaactccctccaaagatggggttttgcccttcatctgctcatttctaatactagagagagatgaaggtgaatctatatggaacagatgtaaaaaagcaaaaagaaattatatcctagtgcttataattttctattggctaagtgtttccttttgaggctggatggtcttcattttagtgatggttttcagggtagctcttcttaatatcaacttttagtggctaacttgcaataattatggcatcatcgtatttcagttaaactgcctcattacaactcataaaactgacacttcaatctgaaaggcaagactgcatgaaataccattataccctctattccacctctatgtttttcattcatttgctgatgagctgtcctgaaaggacatgctcaataagaaggcatggtttttagggctaggccaattgcctgaacataagggtcttttttattaggaattatttatggatgtttccttaaaagtgaacactggaaataacttctcacataccttccaaaagaattgtaatcatattgaagtgtgtccctatatttacttgtttttatctactgcacaaatgctcccatgctttagaaagagaagagccaaggcagaagcaactgatgaccaatattatctcttattaacctgttttctaatccattacacccagattctgcttgcaactggttgttttctcaggtatctttcacgttctgccttctctacttttttaggaactcctctaaatgttcttaagcttctaaatccttagccactgagtgaggaagagtgcacctatttaagaagtagcaaattgatttaatttaaaggcacatggaacctgttttgtgaatatgctcagaaattctcaatgctataggaggaattatatctacccaggcttccctttacatcatcatccaaattataaaacacttggaaataagaaacagatgcagggataggtgctgccttgactgaattctgaattccatttcctttttcctggagttctcctatgaacactaaagatttggttaagagggtcaccaagttgataaatgaagggttcatggcagtgacagggaaaagcatatagtgggtaccagaaaacccaccatctttgtagtgttttatccaatggttttataaataagttttcagcggtagacatatggttccttccctaccaaaaagtaaaattggctacgtttttttaccatctttttaattaattaatttatttattttccattggtccatgtcactcttaaaattttttatttatttttattattatttttttaagagatgaggtctctctatgttgcccaggctggtcttgaactcccgggctcaagcaatcataccaccttggcctcccaaagtgctaagagtacagatgtgagtcaccacacctggcttttctttaatcatctgttttaatttggttgtcaagctttatctttaaggcatattatcttgaagcaaggaccttggttataagccatactgttgtgaatttctcttttttttctctttttttcttttttttttttttgagacagggtctcactctcttgcccaggctggagtatagtggtatgatcttggctcactgcaacctctacctcctgggctcaagcaatcctcccaccttagcatcccaagtagctgagactacaggtgtgcaccaccgtgcctgaattttttgtatttttagtagagatgaggttttgctatgttggccaggctggtctcgaactcctggcctgaagtgatccgcccaccttggcctcccaaagtgttgggattacaggtgtgagccaccgtgcctggcctgaatgtccttcaatgataagcagaagtaccaatggacccctccctttgcctgagaaactcttcaggggagtgagggtaaaacaaaaagcaacactgaagattacacacattgggcttattcagaagtacagtgcaaaagcctggtgccaggtttctggctcaaagtgatacctaccctgtgctgcactctcagagacacagcatagcctgcattacgaaagaggtctacagcatcctggtgcagcaggttctttaggtcttggccatttacctgtcaaaacaccaaagagtagtaagaaaggaagaaggctattagaagtcaacaatttattttcaaatggccaaactttaaataacaaactccttcagagcaaattgcaaggactaggagtatgggcaaagttacttagagctcagaacttagaacttttttcattttcaaaactatgttttcctagaactgaagttccacaggccatctgaagagaacctatgtaaaataaaaagtggtctctccttcctcttagcttctatgcctgtctcgttttgacacttgggaatctgttaccgtattagcatttcttccatgagtgttaacctgcttccttaaagatagcatggtcttccaggttaccaccctaacctttatattcctaagccctggcattgccagctgcaactgtagaaatataactctatgaaactctccaccaatttattttgatgtcatataaatctatactagcccattctattgggcttttcatagtgaacaacttcctgtgattccacggatactcctatccattatatccaaattagtaaattagtcattttttaatcaaaacttagtaaaaaccatattcctgtgatgatataaatccttaaaaaaatttcagtgtaggtcactcctaccacttagaggtgagagatgtgaaggaatacttgtattaatactttttgcagttaggagtgacatcggccacaagtaataatctatctatcctatgctgtattcagtgacacagcacagcccacttagtgcaagattacatatcttttatacttgtcaatgtcatcgttaacagtagcagcaataagaacatctgatatatttcttttgataggttctgtactttacatacattatctcttttaattctcatgataaccctatgaggtagacattatttttatctcgtttccacagataaagaaacttgaagctcagtgagatttgtgctggagctagggctaggatttgtaaataatgaaagaaagatcaaagtgtccttgcatttcactgttccttctgcactgttattcttccatcttgactcaccaactatcctctgctcagctaatgctcaagtcactcccttactcaactctctcattttccttgtcgcaatcttccttctccaaggcactcataatcttccctctactctctctcttgccaatacagttggtgaatgaatctaccaacacttctgccctatagacagtctacctttgtaaaccaatagtttccaactccattccacttcagtcaccaattgacgtaaacttagacttcaatattagacatgcttcagctccaatatctcaaactcttaaaaacctgacaacaatttccactcttttcatactttctattcatctactgaatttcctccttgtaacctttttagactttacttgcatccttgcccatctaggagttcctgttgtaatttcaacaaagcacttggtaaatcattagaatcctttgtccccaagatcttctgccatctttccagtcctgggccatattctgcaatccttttcttgccatcattaagttgaatattctgggagaaaggtatattctcattctccaccatagacccatactagctgactccagctcatccttaaaaccgcttctactcatttgctgaactccttaataaacacgcagtgatagctgttccagacctttttccaccaccgtctccaaccccatttctacctctctccctagctgattcctttatcttttgtgagaacactgaggacttctgataaatgctttctacattttctttccttctccctcaaagtttctttatatcttctcactactcctttcccctagtctctgaattagatctatttccttttcaaggtgaaaccatccactgatgatcttgatcatacttcttctaacctccttacaaaactcacagacactctgtcttcttgattacttaactattatctttctctgctccttctctcaactaaaattatacacctctataaagaaaacaatacaactatttcttggaacgcattatcactctcctcccatcttctttcctctttctttgactgctaaatttgttctaagaactgtttgcatgcactacctctatttcttcagcattcattctctattcccctgtaatctcacaatgtatgaggtagaagggaagaacatgtttttctaaaggtcaccaataacttccaatcaccaaatcctatagccgtttttgtcttcagaccacctcctcccttttgtaattttctcctatcttggcatatgaacacttagcattctttgttcttaaattattcctttccggatttcctcttccctttctttctccttaaggtgagtcaaggtttttcagtatcaatcctctatcttctttctttctctcccactgtgagctttaacagtttcaaccataatctgtaagataactcccaaatttgtatccctacttgtacttctggatttgccagtttcttgctggatgcctacacctgtatactctgctagaccctaattcaacatatccaaaacctctttattacttcccacaaaaatcagaatacataccttgcttcttattgccactatcattccttcaaacttttttttttttttttttttttgagacagagtcttgctctgtccctcaggctgtcacagtggtgtgatcatggctgactggagacttgaactcctgggatcaagtgattctcctgcctcagcctccgaaagtgctgggattataggtgtgagacattgtgccccagcccaggctaaaattttaataatagttttaaactctctctgctgtcaactttcatatacaatagattgccaaactccacagtctaacactatgacatctctcatacagtattttctttcctattgcctattttaggctgttgacactaaaaacaaaacaaaaacttgggaccccaatccaccatgtcaagagaaaaaattaagctgcaagctgagtcatgcaataaactgcttttccttttgttcccaagcagatagctacagataacaggttaaatatctccacaggtaattactctatgttcaccttatcttatgtaaagtcccaacttactaagcaaaagaaaatacgtaattgactattcccttgcctgctcctttcctctggcaacatgtggattaccataccttccctctttgctcttcagcctactttaaatattaaagccctcaaaatcatctttggagaaaggaacatacctgtctcccaggcatgtccttaaccttggcaaaagaaacttcaatcaatttagaagactcttggtttaaaatactcttagttgaactactgtgatcacttctctctgatttacttttctctaggttggaaccgattcaaatactaggtctccagattaatcttcctaaagtacaattctgttactaccactttactgctcaaaaaacaaaaacaaaactggggagcaaggaaagagtacatacctcgtttcttatgctgatatggaaagtcttccaggaaatgactctaacctatcttctcaggttaatttctatttcctttcctatatcctatactctagctaagtcacataactcactgactgggacataaaacatattttttacctttatacctgtgctcaaactgtatctaccacctaaatgcccttcccttttaaaaaattctatttatcttccaagattgatctttaaaaaggatcagtcctgctacctacagtgtagaaatgaatacagttttctagtcgagggactttaatttcatgttatgccttggttttcttgttagatatgctgtaggaaaagaacttcaggatttctataactatcacaatgaattctcaatgactcaattttctagttaactcctgacagaataggtgtgagattgctgactgtcatgggaatgctcacttaagtaatctagcccatgtgatagctctatttctcattataaagaaataagtactttctttagaggcagacaagtaagttaatgatgcagtcatgtcaatgaatgccaaatgatgtcacagctcaatatcagagccaaggtttcatagtaatataaatgcaaatgagataactgggtcactatattaaatggtagaaatactgggcttaaaataatctttgccatagtagtcagtaataattgcagagaattattgaacataaccatgtctggagctgtctgttcatcttacatgtattaactcatttagtcttcacaatagttctgtaagttaggaacccctattttataagtgataaaactgaagtgtagaaaggctatcaatttatctgtgagcaaacagaatgaaagcagcaaagccaaggattcaaactcaagcaggctggcccaaaagccttcactttaaaacactaatctatatgaatttacatggcaagcaaggattttatttcagcaacatattactgcctatcacatatatgttgtaaattaaatttttattggttttgccatttagtttgtatttaatgttacacatttaaaaagtgttaagagttgaggccaggcatggtggctcacacctgcaatcccaacagtttgggaggccaaggagggcgaatcatgaggtcaggagttcgagaccaccctgaccaacatggtgaaaccccgtctctactaaaaatacaaaaataagctgggcgtggtggcgcacacctgtagtcccagctactcgggaggctgaggcagaagaatcacttgaacacaggaggcagaggttgcagtgagccaagattgtgccactgtactccagcctgggcaacagagcaagactctgtctcaaaaaaaaaaaaaagttagagttgaataaaaacaaggtatttatatattaatattactattcatttgtatatacagaagtagcattaaaattaaaaaagcaatttagttaggtgccacttcattgacaaggcctttctagataacgtcactagatatgactgatttacttctttgaatactctgtaactctgaatactatgcaactatatactttgaatactgtgtaactctcttaaagtccaaattgaactctgcctgacaccactttgcattctattgtaacttcaacatgtatctcagctgatcattataactctacaatacctaagagaactttgtacacttgagcataataaatagcacatgctttcctgaagtttggctgcagagtgcaccctgaaaaagccataaatacacaaagcctgactgacataatctcagtactacataaagctgcaaggcctggattctaatagtagctttacctgccaatgattcagtgtgtaatcctgcccctccatctgagtctccttctgctaacagggaagaaagacattggtacatcaggcaaaagaagatgttataaagggcataggccagttaagccaattatgcctttcaaccctcctagttaaggctaaaggtattctaatttaagagacgttattctaatgactactttaaaaccccaaataagagaccttttagaaatgcaaagataattctttcttaaagaaccctttcgcatcctttacccaaggtaaaccagcccctaaaacatgtcatgattacgactttctcccttgacaatatcatttctactccaaaattgaatttgctctccaatactgacatcctctaagcatttttagattccagctgctcagtgactaaccaccaagttctgtagatttcacccttaagtatctgtggaatccactctttttattaccatccttactaacatagaccagtggttctcaaagtgtggtcccaccaccagcagccttagcatcacctgggaacctgttaaaaatgcaaacgtttaggcctcatcctagctgcactttaacactccttcaaagtgattctcaagtctgagttagttcttacctaatctgcctgaaacagtcttttaactggtctccactcccagactacttcccctatttaatatacccctttctacatatcccttgcatctacagatttcattagtacttttccattcactggagtagtaatttttcaaatattgtgaaatcaatccagtgggtcaagaccagttgtttggccgggcgcggtggctcacgcctgtaatcccagcactttgggaggcaaaggcaggcggatcacgaggtcaggagatcgagaccatcctagctaacatggtgaaaccctgtctctactaaaaatacaaaaaattagctggacgtggtggcaggcgcctgtagtcccagctactcgggaggctgaggcaggagaatggagtgaacccgggaggcagagcttgcagtgagctgagattgcgccgatgcattccagtctaggtgacagagggagactctgtctcgaacaaaacaaaacaaaacaaaaaagttgtttattttttaaaaagtgaaattagaagaaaacaaaatatcaaaattcatcacatatagaaaagtattgttgtgttaaacttttgcttcaaatacacacacacactcatttgacgaataggaaatgtatgtcattcctgttataggttataatttaaaaggtctgaaaaacacttgcctacagcagtggttctcaaactttactgtgcacaggctcaccacgggatctcataatgcagagtttgattctgtaggtctgggaagggccctgagattctgcatttctaacaagctcccaggtgatggccagactgctggtccttgaacctcacttttagtaccagaagctactcggctgagtaatcccagaattaacttgctacttcagcttccttaactcatgacataataaggtttattgaacctaagatatggcagatttgcaatgtgctagaaaatttcgctgactctgaagtttcagagaatgagcatggtgttgttctagttaactgatgaggaaacatacttttttttactttaactctggttgttagcatgttaaaatgtgtttcctatttcctgccttatgaaatcagctgagttaaaattagttttctttgattaagaattttgaattgcctcaggatattctaaaacaagatctctgacttgtaaatgtagagacatagagaaagaatgggctcaatttaatacgcaatagatgtgagaatatactctggatattgtaattttttactaagatcctgcaatgaaccacattttttggtctcttttttcatcaatttttgaagaaaccataaaaatagattatttagatccaatccaaaaaagtcagtgtgttataatgcaggggttaattcacggaactaacttattagatgcttactcagggccaggtacaggactagatgctggagataaagagatgataaggcaaagatccttccctggaggtattttatttaaagaatgctgctgtatatttcaacatctctgcagctgattggatgagggtttctgctgggtctttctcactgatttctaaggtaagcgcagagaccagtgtttcatttcctttgtaactttcccatagcacttggcacagtgctctgaaggccattaagtacaatagttgataaatgttgatgactaaccaactctttcattcaccaaattaaaaactgtactcacacagaatatgaaatgaagctggctaatggctcaatctgtgccattttgttatataaggggtttgttccatgttaaaatggaacattcaactgtgtagtatgaccagctacgtcacccttagcttaataaaaatgtcatgttcactgaggaatgactattcttcacctcccttcatttaggcagacacacaaggaatgagaaacttagttcacttttctaaaaataaaaattaaattattccaggttccataatggtttattctaataataaaccattctcgccagcatacacacacaaaatgaaccatgggtgaggaatttccagccttcgtaatagccatttttatttcatggttgtcagatgcaacatggccttaaaaatcatttactgtcattatttaagaaaatttttctttcttaagtttaaatcatctacagtgatcataaaaaatgaaatttcacttttgatgagaaagaggaaactatttttttttttttttgagatggagtcttgctccattgcccaggctggagtgcagtggcgcgatctcggctcactgcaagctctgcctcccgggttcacgccatgaaactacatgataaaccatgcagttacttaattttagaacttgaaagcaagataatatgtgggaattacttggggagaatgaaaaggttaaattaatagctaataataactctaggaaatttacatgtcacataatgttacttaaatcagctatctaaaataggtatgtgctaaggaagagatacatttttagtttatctagcaaacattactagaggaaaaatggggcatattttataacatggagaaataacctatgcgtggagcataggaaaatacataaaaactaaatgagaatttagactaatacataatttagcatcatttttacagagacttcaaagccaataataaatgaatacttaagtacatttcatagttatggcctagaagttcacttaaggacagagagggaatacgatgtcacgggtaagtgatggaacaggctgtttcatagtatttcttaacgaatgggatctagaaagaagaattttgaagcaaactcttgtaattctcacatgtcatgggaaggacctggtgggaggtgactggatcatgggggccacttccctcatgctgttctggtgatagtgagtgagttctcattagatctggttgtttgataagtgtctggcacttccccctactctctctctcctgccaccttgtgaagaaggtacttgcttctccttcaccttaaaaacatgattttaagtttaaacttaaaacttaaaaccatgattttaagtttcctggggcctccccagccaagtggaactgtgagtcagttaaacctcttttctttataaattacccagtctcacgtagtatctttatagcagtgtgaaaacagattgatacagcccctgatatgtcttctatctctgcctctccttcccctggcttttcccctctcttctttggatgccttttccttaaatggccaaaacataaacatatcattccttgtaacatatctttgtaatatttaatatctttttacatctttatatttcttatattttggtaaagtaaaatcttctttgctataaatttagacatctacttttctcttcattgacatttatctcccatcatttatcagcagctccagcccttttttaaaacttgagaggcctttcaataatttattttctctgtgaggaaatggtccacataaggttctcaacttgtatctaataatcttctttacattgaggtttatttccttatttctgattctaccctttatagaaagacgaatttcagtttttatcttattttatttttattttattttattttattttgagatagagtctcactccgtcgcccaggctggagtgcgctggcatgatctcagctcactgcaacctctgcctcccaggttcaagcgattctcgtgcctcagccccctgagtagctgggggactacaggcgcgtgcaccaaggcgcgtgccaccatgcccacctaattttttgtattttttttttttagtagagacggggttttgccatgttggccaggcaggtcttgaactcctgccctgaagtgatccaccctcatcagcctcccaaagtgctgggattacaggcatgagccactgtacctgggctaattttagtttttatataaaaccatacatgcaatctactattaattcaccatgtaactttgtctttaggataactaatcctagctcctcatttaccttttaggaggcagtataacagtataacatagtggtttaaaaaaaggctacaaattcagacaaaccagtttgagtcccttgctgcttactaattgtgtgaccttgggcaaatggcttgggcacaataatcatgcccacctcataggattactataatattaaacaaaataaatttcaagttcttagcatgttacctgacatttagtgctcaaatacttctcaccattctcattttgcaataatctacgtttaaccaaagcttttaaaataatacagctctcttctttctcttcttaactcctatactattcttcatccacagagcccaggttccagtgttctgaggataatgtaatttatgtgtcaaaatattaagctgcatagattctaactaaatgctacacctttattttaacaacccactctcagcattccttacagtaccactgccaagttgattcatattggatgaatgtctttccttgggagctaaaggaaataatctgcttctaaacttttcactatccttttgagaagacaggtatattatcactgtctccatctcactgattaataaacagggtctaggagaagcttaatggactgaagagaggcagaatagtcaatgagaaggactgaaatactgcagtgcttgatactatatttatattatggatcagcgaggacacatgcttagacattcttgagctaatttaggtggctctaatagctacttgttctgattttctttctttttgggggactaagtggagtcacagtcttcctgaagaggcattcagaaccatactgctgagcctgatcactcaaatactcagatgccaaatgaagaaaaggtggatgttctctctctcttttcctttgtatctctgccttcaggttctgctaccaaatgggcttcatggcagagaggtgttcaataagctgacaactaagaagagcaagagatttcacacatatgacctttaatcactaatcacctgaactgcatgagaagtaatgtgaaagggaaaattcaaatgaaactatatagcaaaaaatttttaagggatgaagctaactcattatagaggtaggttcaaaatcatgtatctgagaccaatacttaattctgccaatcaagacttctcctgtctgtacttcattcatttatttcaacgttttcccaacgtggccatcttgccctattcagttctaaaagaaaacagggaatagttttctcctcttcggaccatgggcttatggcccatctggagaggatagggctccgaagccctatcctatttcaatttccttttatttaagtctagccctttgaagccagctctcccaagaatattctagataatatctcaccccctcagcatttttccattctttataccaatcatctgcactgtttccatacaagtaataagctggccatttttcactagtcctgaagattaataaaaaaagaaattctacagaataattatctccaactatactcccttatcccccagcaaactgatagtatcataggattactgtggcccatggtaaggtagagaaatgaacaatagggccagagttatattttgcattttaatagttttgactgtatgcttgttctaatttattttaagacctgaggtctgtgggcccatatttatcagtcaacctttttaggtttgcctgaatttcttaacttgttcatttcttaaacattattaagcactgtgctatgattcaaaaggttaaaaaaagatcttaggccgggcccggtggctcacgcctgtaatcccagcactttgggaggctgaggtgggcgaatcatgaggtcaggagttcgagaccagcctagccaacatggtgaaaccctgtctatactaaaaatataaaaaattagctgggcgtagtggcaggggcctgtagtcccaactactcaggaggctgaggcaggagaatcgcttgaacccgggaggcagaggttgcggtgagccaagattacgaccctgcactccagcctgggtgacagagcaagaatctatctcaaaaaaaaaaaaaaaaggatcttttcactgcccttgaggaaatattctggaaaatagtaagattaataattaccatgtagtatgtcttcgtagagacattagcaggatgaaatgggaacacagcggacaggtacccaaatcaactgcattccaaattttcatgttaataatgggtgaaaaagggctctgagtctgaaaaggacacttaactccaaccttccttctttctgttttgtgatgttaaatccaattataagggctgacattcccccaaaggaagatacacattagtgttttaatcaacaaaaggaggtgataaagtaatggatgaaagacaaaatttgtggattttaaatctcttttccccatatgagtccctcgctgcttcctgccttgtgctttttgaacaagtaacttcacattctgggcttcacattctcatctatcaggtgagcataatgttgccctccatgctcaatgatagggttggaaagaatgactgatcaaagttgttcccattcaactctacaacctgtatatttccagatccaaatcttttcaaggaaaagggatagggaggggtaggacctagggcttagggagcaaaggacagtgaaggaggccgaagcccattctcaccgaaaggatcttatcaccctcctggagccgcccatccagggccgcagccccattttctttgatgcggctgacgtagatgccactgtcgttggagacatactgctgatctgtcccaccgacgatgttgaagcccagccctgagaaaatcatggaggagtaaaaagatgggggtgaagaagaaagaaagagattagagaagatgaagagaaagggagggaaagcctactggggaggaaaggctgatggagaggagatgctggcgagtcagcctgtgatggagctggtgaatggtcatgaacaaggtcagccatatcaagagtattgagttgctcactcaaatgaggcacgactgaaaatataaacacagtgatccacctgttttgttcaatatataaagaaagatctatatagaacttaaagaataatggtgattactctaagttcgttcttctttttctttttttttttttttcagagtcttgctagtgggcatagtggtgggcgcctgtaatcccagctactcaggagttcatagctcagttgcccaggctggttatgagctcctggcctcaagcaatcactattgccttggcctcccaaagttctaggattacaggtgtgagccaccatgcccagcctagatgtaagttcttctactcacatttagttttgatcctgttgatggtattcaaaggacccaattcctgacattcctgatattactacagcagggttagctgtgttcatcaaaagaagctatgcatttttaccaattatcaaatgaactgttcctaatttagtgtgagagatttctaaccataccttcccttccacactttccttctcccaagcttctggagaatttatgtatgatagtgctttagaaaaatctcttgagagtttctttttttttttttttttttccattttggtggtggaggcagtggtgtaggtattggcagagaaacctcagaaccagaaaggtaactgctatttcatggtaggactaaatcaccaaatttactctcccttccttcgctacttcaagtacaaccatatataggttgagtatcccttatccaaaatgcttaggaccaaatgtgttttgaattttgaatttgggggattttggaatatttgaattaaacttaccagttgaatatccctaatccaaaaatctgaaatctgcaatgcttcaatgagcatttcctttgaacgtcatgttggcccttaaaaaattttggagttggaagcatttcaaatttcagatttttggatttgggctactcaatctatacttgggcatagtaattgacaacttttattcactgtagaaaaaactgactactcgttgattagcaactccccagttcctcttccctaagtccttggaaaccaccattctaatatttgtttttatgagtttaactattttaaatgcatataattttagttatgcaagatgaattaagttctagagatctgctgtacaacattgtgcctacagataatactatatcatacactgaaaaatctgttcggagtagatctcacgttaagtgttcctaccacagtaaaacaaaatattaaaagaaagaaaaaagagaaggaaagaaaactgagtaccaaagtgctatttctatggaccaatgactaagtgctggaaaggattttactgtacagaaaccgttgttaggaaaggattttacctatgcataaaaaaataaaaaggaaaaaggaacttctctagggctttcttaatgtcagctactggtagaattcaggggcacagtgtaagacaaaggagatagtttggaaacaaaccaaaaatctagcggtgcaattggaaggaataaccataatcaccagcctacactgttctcaatagaaaagatacttaaagagacatatgcggggggccgggcgcggtggctcacgactgtaatcccagcactttgggaggccaaggcaggtggatcacaaggtcaggagatcgagaccatcttggctaacacagtgaaaccctgtctctactaaaaatacaaaaaatcacctgggcatggtggcaggcacctgtagtcccagctactcgggaggctgaggcaggagaatggcgtgaacccgggaggtggagtttgcagtgagctgagattgcatcactgcactccagcctgggcgacagagcaagactccatctcaaaaaaaaaaataaaaaagagacatatgcgggctttctgaaagttctccccattggtgggagaaaagcttacacctgaagctcacagtattaacataagcactagcaaatcaatttgtaatttaaagaaaaacatgaccaaacaaagacacaacaggaaacatttaagttaaaaagcataccttagccaggcatggtggctcacgcctataatcccagcactttgggaggccaaggtgggtggatcacttgagctcaggagttcgagaccagcctgggcaacgtggtgaaaccccgtctctaccaaaaatacaaaaaattagacacgcgtggtggcacatgaccaacattgggaggctgaggtaggaggatcatttgaccctgggaggcagaggttgcagtgagccaagattgtgtcactgcactccagccagggtgacagagtgagacccccatctcaaaaataaaataaaatacataaaaagcataccttgtgcataaaatctctgcagctagataatagaaagaatttattctctaaaataatatacataatagaaagtgctacttctggagtttgtgacctggctgggcaacatagcaagaccctattctctaaaaaaataaataagaaggtgctacttctggaagatgctattttaacttccttgaagggctgggtattaaaaatagtagcttaacttactaaatgattttcttagagcaccctcaatttgtatcatagaaggtaggaagtattggagaaggtacagaaatgtaagataaggtggaaaagcagatggaacaagattatcgaaggttttgaaatgacttcaaaactgtgacagctttgaacaagggggccaaggccaacccacctctcccaagctggaacaaactatgtagaaaaatcttttgatgaaatccaacaccctcatcaaatgctacagttgcctctggtgatcttgggaacaggaagcaaatgttaagcagctgaatgcaatgtagtagttagcaacagaaaggactttgctactggttattcaaagctaactgtagaaaaaaaaggaagagtagaagaaattttaccgagatttaccataaacaaaaaagagccgtctactacacaccccatcgaagtcatattatataggtacatttataacccgttgctacttctgttgtaaatgaaccaaactatttaacatgagaactcctggactgacctgaagccctttgttcagccagaatatttacagaactgggtgtatctataagccaaagcattgctgcaataaaagagtcaccacagcattaagtagtggcatgaccaactgaacctgggctgtacggatacctacataatccccagttcacttgctcagtaaaaattactgattgaatcttatgtgtaagatgttgtgttatcatctgaggaagacataaagttaaactgcacactccctgctttgatcacaaactggagtttttcctttttcctgtccctttaagatattgcagaagcaaatcaacatttactatgtgttaggcattacgttatgctctgaggaagatataaagctaacctggacagttcctattttaaccacaaacccaaatttatccttttccctgtcccttttagatattgtagaagcaaatcaaagtcagaagacttggttctaagtttataacttaccagatatgtggactgaagcaagtcagtttacctctgatcctcagcttccttttctacaaaaataagaattataaattctgccctgtctacatcaatgggtaagtgttaggggccaataacataaaatacgaaaaaaaatcttcataaactacatagtagttgctctattgggataaggcgctaggagtagttgtcaataaactaatggctgctaaagctccaaactagatagtttgacagagaaagaatgaataaatatacagtagaaatgcaaaatctcctaaaaaatgggaagacagattttaaaattccacccatctataaacaggaactcaaacttattaagtacgtctatggcatgtgacctagaaatcccccttaagagtagtttctagcaagtgtgatatctaaactctgcggcaatcatccagcatatggaccaaccaattgaaacagatgtcagttggaaaccaccagaaagggaaaggctattcaatacgtatcttgctaatcattggctatggcccagaaaaatcttgcataagtagggtgaccacatatcccaaaagcaattgccacaaaagccaaaattgacaaatgggatcaattaaagagcttttgctcagcaaaagaaactatcatcagagtggacaggtaacctacaaaatgggagaaaatttttgcaatctatccatctgacaaagggctaatatccagaatctacaaggaacttaaacaaatttacaaggaaaaaacaaacaaccccatcaaaaagtgggcaaaggatatgaacagacacttctcaaaagaagacatttatacggccaacaacatataaagaaaagctcatcatcactgctcattagagaaatgcaaatcaaaagagatgccatctcatgccaattggaatggcgatcattaaaaagtctggaaacaacagatgctggcgaggatgtggagaaatggggatgcttttacactgttggtgggagtgtaaattagttcaaccattatggaagacagtgtggagattcctcaaggatctagaagcagaaataccatttgacccagcaatcccattactgggtatatacccaaaggattataaatcattctactataaacacacaggcacacatatgtttactgcagcactgtttacaatagcaaagacttggaaccaacccaaatgcccatcaacaatagactggataaagaaaattggcacatatatatcatggaatactatgcagccataaaaaagaatgagttcatgtcctttgcagggatatggatgaagctggaaaccatcatcctcagcaaactaacacagaaacagaaaaccaaacactgcatgttctcactcacataagtgggagccgaacaatgagaacacatggacacagggaggggaacatcatacaccagggcctgtcagggggtggggggtaaggggagggagagcattaggacaaatacctaatgcatgcggagcttaaaacctagataacgggttgatagtgcaggaaaccaccatggcacatgtatacctatgtaacaaacctgcacgttcagcacatgtatctcagaacttaaaattaaaaaaaaaaaaaaagatttgaaaccaaaggaaaaaaaaaagatccttaataatatattcttagtttttcattaactcacaggaaaagtctgaccacccatgagacagaaacctattacagctatttacaaggtaaccaggcttgtaaaaatataaaaatgtaaaaaaaaagaaacatggagttttaaaatgtaatgttcatattcataacacaacacctccctataaataaaaacatacacacaaatattaactatttacaaaaatgcatgcatatttaaagaaatataaagacacattagagtgggtacttatggggagaaagatacaggatagagtttaggtatgaagggtgaaaaaagaacctgagaggaacatactgatgataacagtgtactttggagctaaagggtataattaattcagctcttagcatttaaggtccaaaaggagttgaggggagaggcaggaagaaaaaagactgggattcaacttttttttttttttttttagtgaatgaatgaagagcttagtgagctctggttataatgtgccaacaaattttaaaatatggcaagattaaaatgggttgctgggtgtctattttgcagtctaaatgcaaaatagtaaaggtagcataagaatgacaccactataggattaagagagaaagaaagtgtgcctaatagaagaaccttggaaagttaaacaagaaatcccttcttttgaactcctgactataggtctggaccctaagcctgtttaaaagagcaatggcagaagcaacagctaatgtttaccaagaccttattatgtaccaaataatatgctatgtactttatatatattatctcatttaatcttcttgacaaacacaagtactcatttttcaaagagtttaaaaggtgaggcatggacaggttaagcaactttacaaaaatgtcacacagctctttgcaaagccaagacttaagtcaggctgtgtgattccaaagcatgaatttttaaccattttgctacaatacatctttgcagaaaatataaactgctttaagaaaaaaagtcttctaagcattgctggctatcttaggagctaactggtctccaggctggctctgaacaagcaatgctgggataatggttgtagaacaatctccaagggtaatatattctagaggaagaattcaccactatagagttttgtaactgttgtcaaggttcctattatttaccttcagaccagaaaaggaaaagcccttcatttcattcagattcttatctacaaaatctaaaagttataaagtaaatgaccagtgttaacctgttattctagaaataacaattctggacataattaaaatgaaacaaaatagttcattaacaccaaggattatagccacttgttgagttatgaagactagagtaacaaacaccctattttcccttttctttcccaagatcaatccgactaattttctcccagacatcaatcaaactccattggatacacaacccccctgtctgtcttttatgaagactagagtaacaaacaccctattttcccttttctttcccaagatcaatccgactaattttctcccagacatcaatcaaactccattggatacacaacccccctgtctgtctttatctatatcatggtaaaataaacttaacataaaatttaacattttacccatttttaaatgtataattcagtggcattaagtaccttcacaatgtcgtataatcatcaccaccacctatatctggaactttttattcaaataaaaactctatacccactaaaaaatagctccttattctcccctcccccaaactctgacaccatctattatactttctgtctatattaatttgtgtattctaggtaccccatataagtagaatcacacaatatttgttattctgtgtcttgtttatattgcttagcataatgtcttcaaggttcattcacattgcagcacatttcagaatttcattcttttttttaaggctgaattataatcttttgtatgtacataccacattttatttacctattcatctggcagaggatatctgtgttgtttccacatttggcggctgtgaacactggtgtacaaatatctgttttgagttccttcctgcaattcttttttttattttttgagatggagtcttgctctgtcgcccaggctgaccagcagtggcgcgatctccgctcactgaaagctccgcctcccaggttcactcattctcctgcctcagcctcctgagtaactgggattacaagcgcctgccaccacgcctggctaatttttggtatttttagtagagacagggtttcaccatgttagccaggatggtctccatctcctgacctcatgatctgcccgcctcagcctcccaaagtgctgggattacaggcatgacccaccgcgcccggtcccttcttgcaattcttttgggtatatacctaggagtggaattgcagaatcacatggtaattatatatttaataatttgaggaggtgataaacttttccacagtggctgcaccattttacatcctcacaaacaatgcacagctaccccaatgatatgtgtgtatgtatgtatgtatgtgtgtatatgtatgtatatatatgtatatttatatatatatgtatgtgtatatatatatgtatgtatgtaaaatagtcatcctaatgggtgtgaagtggtaacaaattgtggttttgatttgcatttccctaacagctagtgatgttaaatatttttttcatgtgcttattggccattggccatttgtattaccttctttggagaaatgtctactcaggtcctttgctcatttttgaattgggttgttttctgtcactaagctgtaaaagttctttatatatgctggatattaacttcttagcaaataaataattggcaaatactatctcccattctgtgggctatctttaactctcctcatagtgtcctttgaaacacaaaattttttacttttaatgaagcccggtttatcttttgttttgttgcctgtgcttttggtatcacatccaagaaatcatagccaaatcgaaggtattgaagctttttccattcttctaagagttttatggttttagctcttacatttaggtatttaataaatttctagttaatttttgtacataatgttaaggcaaaaatccaactttcacatacttctgcatgtgaatatacagttttccaaacaccgtatgttaaaaatgtgtactctgctgttatttgatgatgtgttctatatatatatatacgcctgttaggtctaatttgtttatagtgttgttcaaatcctctctttccttattgattttctgttggttgtcctatccattactgaaaatgaggatactgaggtctaactattattataaaatggtctacttctccagatcaatttttcaacatttgcttgatacattttggcactctgttgttttgttatgggaactttggggtgtcacttttctggcaggagacctctgtgtggctgctgcagcagggtgggcagctccaggtgctggctctctgcaaggctacagctggaccaggcgtagcgcgagcagcttctacagctggcactggggaacacgatggcatctggaagcttggagatgccaggaaccgtagggtcccaaggagaaagtcacagccctggctcagggagctcccaggtctcagatacatgaagggttgcagctcttctctctttctcttcacccacaatgtggcaagcaaggggcatgtctcagccctgactgtgttacagctctcttagcctcaccattcgatggatcctgagttcttgtccagcaaccaggaagaatgagatacacagacaagtggagtgtcagcaagtcaaagaggagctttactgagtgacagaacagctcagaggggacctgcagggggcagctcctttcagcatccagggtgtgctgatgagtgttcggctcctagcagagacagtagctcttctctgctagggaggtcatcccaatgagtgttcaactctcagcagagagggtagctcctctctgtaggcaggtcatctcaacaagtactcagttctcagcagagagggtagctcctctctggagctggtcatcccatcttctctgctgtggctgaacctggggcatttatgggcctcagagcagaagtgtatgccgactggtccatgggcagccacagacagcccagaaaaggcaccacatgtacccattccagtctgtgggactagcagcccagccctcagccttcaggcccaccttggcctgaaggtggggcctcaccagggaccaacccccttccacccaggagactgtctgcctcctgccaccatccatggcgaccagcctgtttgtgccaaggggcacctgcaggccagtgctgagctgccctcagcacccccaggattcccctcatgcttgttggtgcccaaagtccagagagggctgaggcagcaaggggctggtgtgtcagcactgccctaagtgtgtacacactgggccgggctttgacagcactcagattggcccaaaccctgcactgagatcagagcaggcactgggagcagggagaggccaggcagcaggaaaagacacccctgagcctgtgggtgcagggggaaccttcctgggcccctgagggtgaagagtgcagaaatgcctaggtctttgcacctgggagggcagagctctcatctgctccatgaagtgtgcagccagcactagctgtgcctcctcacagcctggggtgggggctccaggtcctcattgggccggggcaaatattcagagcaggagtgacatcaccacaagctccctgctgtcgccctggcgctgaggggtggcctgggactcactgtcgcttggctcacagccctgcctatagggggcctctaggagcagatagggggcctccaggagcagatagtgggccccagtcctggccatcacaagtgtcaggctcggaagtcacccagatgcagggtggaccccggggatgcggccccgcggaggctgctcccaaggtgcaagaacccactgcagtgcccgtggtgggtgggtgtggtgggtgctccgctggccaggtccccaaagcaggcgccgctcccacttcccaccctggggccccaacgtgcggccccagctctgcacccctggcccagcccccatgctctgtgtagaagcgtggcactgccccaggcccaccctggcctcacggcccctctctgctcgaccacactgctcacctgctggcgcccatctcggcctcgccccatagcgcagcccccagggcagcaggctccagtggggttcctgcttgtccctggctcccactggctccatggagcaaggcactgcccggggcccagccctgcctcctccccacactctccctgcagtggcagcaggcaagagaggcaatgcagggccagggtctggagcaacagaggctccggacctggggatgggtcctgcctggccatgtgagggtgggggacacacagttggctgcctcagggacgcaaggcataggggacccaccactgccattgctgctcccgcagccactcctgctgtcactgcccacgcctccccgctgcagccagtgtgatggcactgccatgaattccccctctgaagaggaacatctaactgctgttaagatagggacgatgactgctcttaactgcttcatgctgacagagggtgttaatttgtggaaaacaggagattttctctcaggatcctatctaagggtcagcttcatgctgattggtgttgttttggggaaaacagcagatttcctctcagggtcctacctaagggtccccagtaaaagggagccatcatccgaggctccatttccatgaccatttggagtttgacagcccaccccttttatttcttttgagctgcagtcagagatcactggttggttcacccctacaattgtcaaaagctgcaaaaaagagaaaagtttccttgactctgaaatacaaaacaaatgagcagcaatgttccaagcaaaaagtcaaaaaggattatttcagtcttccattagttcagatcactcagtcaactcctgttcacaatctccaaagttatcagaaacctgtactcaaggactataatccatcttttgaagaggatcaaaacaagacaacaattgtctgtgaatgccaaaatatcctaaggtcgtttcattcaaaaacacaaatgactaagaaatttggtaacctctgtggattacaataacccaatacgataaccctaattatgattgacagcatatactcagacatttggatttttgaagtcccatacaattttggaacatacacaagtattattcaccaaaatataacctgaagaagactaaaccctatctttatcttgacaatccctttacaaatttttgttaaagagtagaacagtgcctttagaaacccttgtggttttattcccaagttcactttataaaaaaaaacaaacaatacccttttgaatttagtattcccacacagaattttgtttttaagattaacctttacaaatcttccacaacttgtttaaacatttagctttatcttacctaatttaaaacaatcatttaaccccctaaactaggcaaaaatgtatattcccatgccttcttatacttttactaaagacacgttttacattctttacacaccttgcatgtaaatctatcctcagtagtctcaattacatgttataatggtaactgttagcaattcttaattttgatgaaaaatctggtaagttattttaattatttacttagatgctgataaggtctatttctaacatagctaggggtgtggcatatgttccccagccttaccaaactgtaaagcaggcaagttgaagaattttcaaaagccaaagaagcagtttatgacttttgaaaagtccgtaaattatgaaaaattaagcttcaaaattcgagtgctctttttagaaacaccagcatgacttatatataacacttatgggacatcctcttgtaaatatctaggaaagtggactcacttaacttgggatgctgataagcagcaacagccaaaacagggatcctctgaaatgtataaaataattcatttgcaagcacaagagggaaaaaaaaagctggttttagaaccgtacaaactgaatgagagacctactttataattgtcttggttaaaatctgataataagagatttgaaaagattattttttagagttctctggtcagaagtcagcttacttagggctgggcatggcagctcacacacctgtaatcctagcactttgggaggccaaggagagaggatcacttcaggccaggagtttgagaccagcctgggcaatgtatttttttttaataaaagaaaaaaagcttaattaaaagtaatatttaggctatcttttgtgggggggaaaggactttctgcttttttcctctcttggatcctggttcttggctttttttttttttttcagtcaattgagacccctttttaaatatgtttgataccttgagtcttctgtttgtttccaatcttgctggcataatttttgctgagaaaaatataaaacttcactggccttttacaaaatttaaaatctccaggctcttgctctgttgcccaggctggagtgcagtggcacagctcactgcagcctcaatcgcccaggctcaagtgattctcccacctcagcctcccaaatagctcggactacaggagcacaccaccacacccagctaatgtttttcttttctttttttatgtagagacagggtcttgctattttgcccaggctggtctcaaactcctagctcaagtgaacctaccacctccgcctcccaaacagttaggcttacaagcatgagccactgttcctggctaaacttgttctatttctttccactctgctcttccttccttttgttattttgataccacaggaagaaatctaaaggagacttctaacgactcagacccctcaaggaacgctgaaaaaacacaccattcactccctttttggggtattctgtcttcttgtggagtctgaaaagtcatggacaggttcctctcaggtctaaaactctgctctcttccatactgcattacttgttggcttttgagagtaccagagattactttgtactgtgaaagagacctttgtgtatgttatggctggtaagtcactgacaagagctacagtattggaggtgactaacagcagttgtttatggtgaatggttattactataggcagctactcattttattttattttttaaacatttaggtaagaaaggtgtggcttaatgtctttgtagtgaggtgcgctgtggaggtttgtgtggcctggtatcatggcattttgctctttgtggagacccaagattcacgtaaaagtggtttccttgatttttaaagatccagatgcactgccctgcaaatctgcctggtttttagacacttaatatcaggccctgaggcagtcctcactgggacaacaggtggtgcacctgtagtcccagggaggctgaagtgggaggatcacttgggtccaggagctcaagaccagcctgggtaacataatgaaagcctgctttaaaaaaaaaaaaagaaagaaatttttaaaatatatatctattaggccctggaaactgcaaatactttcctggtcccattcatgaaagggctccactttgaagtcagtaatctaatcaagaaacgaactaagtatctaacaagattatagtctccaaaatacaactttctagcacttagctggctactttgaaactctatgtaaaataaatttacttctataaaggaaatctccatttgtaaggacatgcccctatacccaagcagctagaaatttttacaatgggaaagacactggcttaaagttgacataacaaaccttacctatgtttaaagatacttttcctggcaatcttatcttgactgattctttttgtttcagcaaataatggtatatagatataagttctatgcctctaggggtatcaattttcacctaagagtaatgtttgcaatttagggttacctagctaaacaactgtttagggcaatggaataagtaatcaaggaactggtagtctaaacagggagagattatctgcaaactggcaaatgaagaatcttataaagctataagatctgtttctgtcactgtgtctgtatgtctctatgtttatgtgtcatgtgtatgtgatacttcactaccaaaatacatgaaaacattctaatgaatttgtcagaggcgtttaaaccagagcaactccatcttgaataggagctaggtaaaataaggttgctgggctgcattcccagtaagttaagggattcttagtcatggcgtgaaaaagaagtttggcacgagatacaggtcatgaaaaacttgctgataaaacaggctgctgtaaagaagctggccaaaagccaccaagatggtgatgagagtgacctctggtggtcctcactgctacactcccaccagcgccaagacagtttacaaatgccatggcaatgtcaggaaattaccctatatggtctaaaaaggggaggcataaataatccaccccttgtttagcatataatcaacaaatagccataaaaatgggcaaccagcagctctcagggctgctctgcctatggattagacattcttttatttgtttactttcttaataaacttgttttcactttatggactgcctcaaattctttcttgcgtgagatccaagaaccctctcttcgggtctggatcaggacccctttccagtaacaaaatggctttaaaggtaagcacttaaatcaagtattttatcagaaatatagaaagtaactcaaatgccttttagttcacattacaaaaataagactactttgttggtttaatgaaaatggctgtttcttctgatcagcaaaatatgcatgtatgtaacgtcagggtttctttcacaagctgtggaaactattaacaaagaaataacttgaggccaggcatggtagctaacatccataaggccaggagctcaagaccagcctaagcaactggcaagatcctgtctctacaaaaatgaaaaattaaaaaaaaaaattagcagggcatggtggtgcactactgtaggcctggagtgagccataatagcaccactctactccagcctaggtgaccgggcaagaccctgtcttaaagacaaacacaaaaaaataagtaacttgggatgacggccagctttgtttaatgatctatacaagtctaacttttaaaaatgaataaattaaatgaatataaatggtataaaagtgtataagcaagtttttcataattttaagaatctttttcagaaacttaaaatcatgttatgctaaattaagtaacagataattataaaatgtctgagtcatttacatggtatagaaaagctaaatatatttagatctgttaacaaacagattgagaaggttatctttctagaaattatgaaatggttctatctacaaatactggtataaaactgttcaaaattaccttacttcctaggttcttcactggaaattagggttactaagagttaaagttaccgtcaatatatacaattaaaactactgaacacaagagaaacaattctaaatacagtgcatataaagaaagtaagatgtgaagaaagttgacaatagagatcacttttctttacatggtaactttgtgtggacaaaataaggaggaaagaaatgtaaattaaataaggagggccaggtatagcggttcacgcctgtaattccagcactttgggaggctgaagtgggtggattgcttgagtacaggagttcaagaacaacctgggcaacatggcaaaaccccatctctacaaaaaatacaaaaaattatctgggtgtggtggtgtgtgcctgtagtcccagctattcaggaggctaaagtgagaggatcatcaaagcccaggaggatgaggctgcagtaagctgtaatcacaccactgcacttcaagttgtgtgacagggtgagaccctgtcagtcaatcaatcaatcaaatcaatcaatgataggaaagaaggaaatgtaaatttctgtcttaaggtagaatgccaatatcagaaagtcagtataggacaaaactaaagatttaaacaggttgtagaatgtctacggaaaaaaataaatgaatgaatgaatgataatggggaaataaatgtataataaatttctgtcctaaggtagaatgccaatatcaaaaaggaagtataggacaaaactgaaggtttgaacaggttgtattaggttggtgcaaaagtaatggcaaaaactgcaattacttttgcaccaacctaatagaagttttgtggaacatgaatcttatgaattttgtgagtgatcaagttggctaaaattagaaggggattatttcactttttaaaaaactgagcatcaaaatcaaaattgagcattaatatcaaaagcacactgatgcaaggccagactcaaaataatgggttttgggggccactgatctgctctttaatagattaaaaaagggttatgggaatcttgtgtgttcaaagctgattgagattagatggatttgtttattaaagttagctttagcattaacaacatactgatgcaaaggtagaatatggttctctcttttaaacaatattttcatatactaagagataataaaagacttgttcaccttttgagtaatctacaaaaataaaaagagaaaaagatgtgttggtcttgtgctgtctttattaggtcttttgattgtttgggaaaccaagtctcctttctattcaagagtaaaggtctttgctttcaattatcaccttgacttaattaatgactattatttattgtgtcttgtgatcctgtttagattaagtgttttcaacctgcattatttgacatgctttccaaaactaaatttcaaattctaactttaacccttttccaaaaggaacccctggaagtccaacagatacgtattaggcttatatgttaaaatcatattgttatagtaggtagccagtcaggcataagcagggcaggagggggcctaccaccacacacacacaccaggaacgtcaggttacctttgcagaataacacacccaacaactacaaaataaactttatatttaaaatgcttatgaaactgcctttccaaaaattgtaactgagaaaattatgatggtgaaagagatctgacctaactgactccatcttgcttctaatctccaattgtccttgttcattcctgggtgtaggccaaactaactttgggaggaacttagcttacagtttaactttgaaacaaagataacagccctttgctgaaataaacccccttcttgcttggggactatactgccgttgcaggactaacaaattagccacaagattagaaattatgatttaggagtcatgcagctggaggctgcaagattctgaacttccccgaattgctccaggggataacatcgcgattgtaaaacctaagatcagtgcttctgatattttgcagaccctgcactcaatggatcaggcagcaccacttagatctataaactaactcatctagtctttgtagtgcccacccaagaaacaacacagcacaagaggacagcttcaactccccatgatttcttctctgacctgaccaatcagtgatccccactttccaaccccccacctgacaaattatccttaaaaaccctgatccctgagttttcagggagactgataataaaactccagtctcctgtacagctagcgctgtgtgaatgaaactctttctctattgcaattcccttgccttgataaattggctcagtctaggcagcgagcaagaagaacccattgggtgattacacctgcacttcattgaatgtgaatcatgcctcaaaaaagttgagatgaacctggtgattatgtacaaaaatgcaagcattttaaacatttattaatgactcctacttattaggttggtgcaaaagtaattgcagtttttgctataaaaaatggcaaaaaccggccaggtgcggtggctcacacctgtactcctagcactttgggaggccgaggcaggtggatcatgaagtcagaagatcacaaccatcctgactaacatggtgaaaccatgtctctactaaaaatacaaaaaattagccaggcatagtggcaggcgcctgtagtcccagctacttgggaggctgaggcaggagaatggcgtgatctcctgggaggcggagcttgcagtgagccgagattgtgccactgcactccagcctgggcaacagagcgagactccgtctcaaaaaaaaaaaaaaaaatggcaaaaaccacaattacttctgcaccaacttagtcaataataaaaggctaaagtttctcaaagcaccaattttgtgttaattaagcaaaaaaaaaatttgttatagtatcctccttacagtagactttttctactatttcctatgcaaatatgataaaatgatttttaaataaattctaagtatatccccaagataaaatcaaagtaaaaaaaaaaacatagaagatgaagtttaaactcaaaatcaccataatctacctttctagccatctttggacattctctactttgcattatacagtaaacaaaatttaatatttgctatcgcttttcaccctatcatccccgcccacagctactgcttatctccgtgactttggatgtcttcttccctttgcctgaaaacatgaaattacttgtttaattgtctcattaccctattgcaatattcgttcctagaagacaatgtaattagcttatattcatttttgtacctcctgtgccaatatagtacctagtacatacacaaagcccaactggtgtcaattgactattattggaattgaaaattacacctaggtcaggaatttctaacatttccagttctagggaaatctcacaaggttaaaaatgtttctgggagcttctaacaggttttttttttttttggaggagggggaaggactattgcagtaatagggtttttttataaactaaggcataaaaggagggaaaaagagaaacagaagccccatatccctgaaattactgacacagcttaccctacccttcctagatgactcaattcttgccccataaagtctactccccacatagcagtatccttaaagcacttcaatgaattaaatgagttgttttgtggtaaagtgcttaagacagtacagaatcgtcactacaaattatttataaaacaaaaatcggacaggcgtggtggcttatacctgtaatcccaacactttgggaggccgagatgggtggatcacctgagatcaggagttagaaaccagcctggccaacatggtgaaaccccatctctactaaaaatacagaaaaattagccaggtgtggtagcgggcgcctgtaatcccagctacttgggaggctgaggcgggagaatcgcttgaacccgggaggcagaggttgcagtgtgctgagactgcgccactgcactccagcctgggcaacaagaacaaaactccgtctcaaaaaaaaaaaaaatcattgaatcctcacaactctataagtagattctaataatactctcatattatagctgaggaaactggggcagatagaagtgaggtgacttgcacaaggtcacacagtgagtgagtgatagagtaaggatttgaactcaagcattctggcactttttcttttttgagactgagtctcgctgtatcgcccaggctggaatgcagtggtacgatctcaggtcactgcaaccttcacctcctaggttcaagcaattctcctgcctcagcctcccaagtagctaggactacaacaacctcgaactcctgggctcaagcaattcttccacttcagcctcccaagtagctaggactacaagcatgcaccaccaaacacagctaatgttttgttttgttttgctttgttttgttggcagagatgggagtcttgctatgttgcccaggctggtcttgaacttctggcctcaagcagtcctcctccttgatctcccaaagtgctcggattacaggcaagagccacaatgcctggcttgaactgcaaaattcttaaaaatggggatcatttcttattctttattctagtgtccatgattcctaatcatagtgtaggcacataataaatgctaaataaattttaaaaaatagttttactttacttttcagtcttctgaaaccagcagttctgaccctatcatctaagtatagtttggctatttttccctcaataaataattgtgtacttatcacatgtaatcattgaccacttttctggctagtcacatggcttcgcaaaatgtttctgcagttgaacatctatcagcttgcctttctatttccccaaagtaattcctagatattttactgtacagtttttctttagtattgttttgaaaagatcttaatactgatccttgaagcaatctttagagaactgttccatttacctgactctctccaagaggtgttccatctactccttctccttgtttctgatatcttagccagtttcctatccatcataatacaatgtgtccatcctcattctctctttctcaaattgtatttagtgaagaaccatgtttaccactttttgaaagctgaaacagatcatgttactgcttctctttatttaaaacatcccattatggcaggcacagtggctcatgcctggaatcgcagcactgtgggaggctgaggtggaggatcacttgagcccaggagtccaaggcatgactgggcaacatagtgagatctcgtctctacaaataattaaaaaaaaaaaaaattagtcaagtgtggtggtgcatgtctgtagtcccagctactcaggaagctgaggcaggaggaccacctgagcccaagaggtcgaggctgcagtgaactgtcatagtgccactgtactccagactgggggacagagcaagaccctgtctcaaaaataaataagtacattgggtgtggtggctcacgcctgtaatcccagcactttaggaggccgaggtgggtgaataacttgagctcaggagttggagaccagcctgggcaacatggtgaaaccccgtctctatgaaaaatatggctaataaaaacattaatcaggtgtggtgacacacacctgtagtcccagctacttgaggggctgagacaagaggatcacttgtactcaggaggtcaaggctgcagtgagccaagatcgtgccactgcactccagcctcggtgacaaagtaagaccctatgtcataaataaataaatataaaaacattccattatattattatgatatctatcagtttgctcagtcatttaatgaacacttactgaccactgtgtgtcatgcactagacaaagcattaaaaaaacattaaagacacatgcatgcatgtgttcactgcagcactatccataacagcaaagagatcgaatcaacctaaatgcccatcaatggtagactggacaaagaaaatgtggtgcatatacaccatggaatactttgcagccatgaaaaagaacaagatcatgtcattcgcaggaacgtggatgcagctggaggccattatccttagcaaactaacaaaggaagagaaaaccaaataccacatgttctcacttataagtgggagctaaataataacacatagacacacagaggagaacagacactggggcctacttagggtggaggttgagaggaaagaatcaggaaaaataactaatgggtactaggcttaatacctgggtgacgaaaaaatctgtagaacaaacccacatgacactgtttacctatataacaaacctatacatgtacccctgaacctaaaataatagttaaatgaaagaaaataagaaataaaatatatgttctttgactcagaagagctcaaagtgaagtagaaggaggagacataagtgagaaagcatatagaaaaaaaaagttatttataatgattcagggcttggaattttaagtcacacagacctggatcgaaatcttcacttaaagagttgtataatgcagaagtcaaggtttcctcatttctgaaatggggataataaccatttcatctcttcctttttacaaggggacaagatacagtgcttagcttggcaatacatgggaatacattacaggcaatctgtaaatgatgtataatatagacaataagagaacatctatcctaggtaaagcctgcttcctggaggagctaactgttgaactgagtcctaatcaatggctaggaagtagaaagaatccagatagaactttagagaaagattaagtttccatactaacactaaagactccataatctgatctccacctactcaggttactactcagctacctcttctctcttgaatctcctaaaggaaactttccttctgtccaggctggtttactcactaacctcagaatatgctctgcttattttcttctctctattattgcttaggccatactcatccctgactctggccctagcctaaagcctgtccattccagaagacccacaagttccacgttcttttaattgaccattttaatggttctcagcagtgtctgcattcttgaactttcccaacacagggtcagattaccatgctcctttccgcacttcctttgccctcccactaactacctcctcatcattttccttaactatctgcacctttgcagtgagatttaatttttcatatgtgaacatcatatctctattggattgtaaactccatgaaggcgagactttgtgtaagcaagagaaaatagggcaaggatatagcatttagcctcacatctatttgatatgtgaagaaaggaatagatcagaaaactgctagcaacagtttcagttagcatgaaacccaaagcctatgacaggtctacaaggcttaaatgatagaacttaatggggcatcttgattttaggtactcaccttgatatgccctcagctctatcaagagcaagcaataaaaactttccactgtaggttgtattagtcatttaagatgcctcaaatgcttctgggaataaggcatgatataataaaataaaggtcaggggaaaggttggcagtcaacttcttaaacatggctactgcagtggaaagtagtatatggtatagcagaattaacacacctgggttaaaaatcctttgaaatttactggcattagaaactgggcaagtccttaacctccccaaggcaatttcccaatctaataatgtggattaaatatttattactcagggttgctgtgaagattaaatgagtatgtatgtatgtatagtatatatacagtatatatatgtatgtatagtatatatacagtatatatacagtatatatgtatgtatagtatatatacagtatatatatgtatgtatagtatatatacagtatatatatgtatgtatagtatatatacagtatatatatgtatatatagtaactagcacactaccggaaagacaatacctcctttagtattcattattaaaacactgccatcaacccatcatcttttccaaggcctttaaagaaagtaagaaaataaatattctcttccctctttaaagatggcatatcaggagtaacttgctgaaacccattgaggactcggacctaaaaacaagattcctaatcatagtactcaatgtacagtaaggttgtctttatggccaatctcttacctgttgcagtgcaaaaaaacatattaaacagtcttgtcacactttttagagtaactgagttttgagacgcattaagagactttcaatttgataaagaaaaagtgagagccttagatactataatcaagctggactcctgtagaaaaaaacaagattccactaaagataaaaggtaaactgttcaacccttgaagacatttgagattgtagccactgcctttgtaattcttcagctcatactattagtctaaaatggcaggaaataaaaacaaaacgaagttccaaatggtaggaaacataaaataacataaataatcataaaatgagccaaagaatgaactcttagagatggaagagacctctgaagtcatctagcccaagtcccttcttacagttgagaaagcagacaacaggagagattccatgctattaggttggtgcaaaagtaattgcggttctgccattgaaagtagtggtacttatggctgggcggggtggctcacgcctgtaatcccaaaactttgggaggccaaggcaggtggatcacttgaggtcaggagtttaagaccagcctggtcaacgtggtgaaaccctgtctctactaaaaatacaaaaattacccgggcatggtggcaaatgcctgtaatcccagctacacaggaggctgaggcaggtgaattgcttgaacctgggaggcagaggttgcagtgagacaagatcgtgccactgcactccaccctggtgacagagtgagacgcgtctcaaaaaaaagaagaacaaaagaaagtaattgtacttttgcaccaacctaatacatgtcaagcttcttttgcctcttcactctgttgtcataatttccccaagatttcattacttcccttgcagtaagcagatcagtcaggaacaggttcgactgccttataatatgggcccaaacactggaaatatccacaattcttgtccctgacagaacacaaagggggaatggtacacatgttctcggatctgattaaacatcaggttcctgagtacacagctatacaaacacaaagagtgggcaatgctgcctacaaaagaaatgcatacttagaggattttcatatttcttccatagatagaaagatccttatgggaccatcaaaattatgtggaagtttctagtggtgattagtttctagtggtattttgagacagtctcctccctatatatcttcatgatgataccatgaagaaaagctgaattagaccctgagaagaagagtatcacatactaggaaaccagttctggtaagtgattaacatgaacttgaaacctttctttgttaactgaaccaaccaaatttcaaatgactgttttcacccaagttcattcctaaacttgaggctttactctcccagtaagttcactgacttatataattaatacatggaaatgcttatgaaaatttaggaagccactgagtgaataaatacattcatttgtaataaatatgtgatacagaaatcaaaccatttttgggtgaaatatattagctagatataattattccctttaattagtccttgaagcttgtccgaatgccaatgttttgggaaaatactaacactaggaaatttatgactacaaatgccaaaaaagatgaagtgatattatactgaattttaaaaagatttcatctttagaacaagagataatatcagggtcctgctctgctttagacaggagatctgaaaatactttggatgccagagcaaaaggactatgtcaaagtacattaaattcttaagcaaaaggcaagaatcaaatctcaaacatctcaagaggtagtaaaataaccgaagatatttaggataaagaagaaagaggcaaaacaggagcagaacaactagagcctttaaataaatacttgcacagcaatcagaaaaggaactagcattgttttaattggtcctaagagaacaagttatcaatggatgaaaagtacaaaaaaacagattttgattgaaaagtaactttctatgttagcctcaaaagtcaataaatattaacagtgagtgaaggatacatttatataaaatagcaaaaaaatgaatccaagaaacttgggcataccaaatgagcctttgacaaaagtttaggcgcacatatggagcatgacactaatccattaagattagtgataggccaggcatgatggctcatgactgtaatcccagcactttggaaggccaaggcaggaggactgcctgagttcaggagttcaagaccagcctgggcaacaaagtgagacctcgtctctaaaaaaaaaaaaatattaataatggtattagtgatgagttatattccgataagtaaaaccaacttccaatttttaataatagaaaggaaggcagggcacagtggctcacacccgtaatcccagcactttgggaggcagaggtgggtggatcatttaaactcaggagtttaaatgagaccagcctgggcaacgtagtgaaacatcgtctctaccaaaaatacaaaaaaattagccgggcgtggcagtgcacacccatggtatcggttactcaggaggctgaggtgggaggattgcttgagcctaagagggagaggctgcagtgggctgagatcgtgccactgcactctagcctgggcaacagagtgagaccctgtctcaaaaaaaaaaaaaagaaaagaaaaagaaagaaagaaaagaaaagaagacacaaagtatggataattctgaaagttatattttataaagaataatctatccatgattaagctactgcagaactgcagatgagaaaaggtgatggactgtcctaggtagtggcaagggaaacaggagtgaaagaatttcaggaacatttcagagatggagctcagagtacttgatgatttattagagactcttggaatacagtattagtaggatttactgtgtcagtttagctatttatccattaacagtaacaatagtaggaaacacatactgtttaccataggtcaagcaatgttgtaaacattttacatggattaactcatttcattctcacaacactatgaagtatatttataaccatccccattttagagatgataaactaaggcttacatcagttaagttagccaataagtatcaagaatcagtaagaggttagatacaagatttagacccagatactgtaattccaaagctaaagagctcttaattgatcaactaaatagttgtaaaggaaagtaaacaaagtcgaaagcaggcagaatgtagtaatgtcaagagcccggtttaatgaagagccacagtgggggaagaggatagcagtttggctgctcaaaatcacatgaggtgttcataaaaaataaataaataaataaaataaatctgtattaaatccaaatccctgcagatgggagataagatttaactttttattttcttttttttttttttttttaaagccctgggtaattttgtggcggaaccaagtttgggaacctgtgtaataaaagatttctaagggctcttcctgctttaacattctagttgacattgtaaatgaagttcccagaaatcaaaggagcgagggagggatcctagctgcaggaaaacggctatgcattcagagtccacaccgtttatgctcccattttactaaacggtccctcatagggggagggatagaacaggcaacggaaagaaggatgtggtatccacgataagcaggctaaaaaagcaggcttttaaaaaggcttttctagcacgatttgcacaaagaaccccttcttgactatatatatttgtgttcatccaactggattttgaggtggattcctcagacccgtatctggctaatgatggatttcaatatattttctctaagcaccccgaagcgttgcacgaaacctctaggttgtggcctgcccgccccgaggccaggtgaatccggctcagcagcagaggtgtctgcaattacaccctctaatcccctactgtcagatatgaccctttccgcacatacctgagggccctctggtaagattgatctcttcctcagtgaccaaataatccactcttccgttcatgttttacagctcgtctggcttcctacttgggtcagctggagtgcagcacaggtgaaggtgaatcaatctcggcgctgcgcccacagcacagcggtttcggtttcagcagcctcgagacccggaaaag

SEQ ID NO: 417 - DNA, 92010 bp, Homo sapiens
tcaacttaatttactttttattaaaaccaacctgctgaaaagaatacaaattttgactaggaggagaaagggggagtggatttatgattttatggcaattataacaggagtgtttcaatggagactttaggcaactagaactcagcatgaaaccagaaggtagaagctgataaaggcaggggtaaaaaggagaaaatgagttcaaaacaactaactttcggccaggcgtggtggctcacacctgtaatcccagcaatttgtgaggccgaggtgggcggatcacaaggtcaggagatggagaccatcctggctaacgtggtgaaaccccatctctactaaatacaaaaaattagccgggtgtgacagcatgtgcctgtagtcccagctactcaggatgctgaggcaggagaatggtgtgaacccgggaagcagagcttgcagtgagcagagatcgtgcccctgcactccagcctgggcgaacagagcgagactatgtctcaaaacaaaacaaaaacactagagggcaattttgcatgcaaattatgctaaggcataatttttagtattatcttagtatttctcaaaatgtagtcatctatggatttactgaacaaatttgccatatctgcttataatcatacactacttcataatttttgacaaccataaataatataatttccttgacatgttaatggtatcattgtaattatcatgtgatgctttggagactgattatcatactatgtgaggcattacaaagaaaatcaagactcttagcagactgtgatcatttttctttccctaatagatatgagagaaaattactgcttgattttactgtgagaatttggatccagacctactgtcctcattaggaatcagaaatcagagaatcagaaatcagaatgaaatatcaaaatgatgccctaatggctattgcaaaaggaatatgtgggtagttggagagtggaatacgtgactctgtttttggagcagtattcacattttttatttcgaggtgtaaaatatacgtggccaacattgttactttcatccacagatggaatagctgggaagtataaaaacctgtacatgacctttagtgaagattatttgtcatcaaattacccatatccaagtttccatgggcctggaatttcctttccacttgatagaagtatatattaggaagtccagttaataatatttttatttaaaaaaaaaaaaaaggaaaaaagaatcagcagagtcaagttgtcttagtcttaaggctttctggatttcttccttggaggaggtcaggatcttcccaaggcctgggtcctcgaatattcttccagtcatcaaacttggagtctttgattttctatagaaccacaaaaaattaaagtataaatattagtataagagcctgtggctttgattaggacacaactaactcaatgaataaatgagtagaaagtatccgataggtcctcgattacaactgtagcaaataaatcaactacaatcattgatgaaatgtcatcttaagatttagaacttttcatttgttactgatgttaatgcctatcttacgccaccttaaccgtaaaactattaaaatagagaaagagtctacatgccttatttttgagaggacaaggaaaaggctgaagctgggaaaacaaaagtacaaatctgaaggctgatccagcacagtgactgaaagggttatcagggatgatggtagaaaataagaagaaaagaacaaagggtggagaccctaaagtcttctacaaaaaagaaaagagaccaagatcatttgtcttacgcctgggcttaggaatgaaaagactttcctacagctatctatcataagcaaaacacttttgggcaactgaaactaactgcaactacattatggatcatcctaccttcatttagtctgaagtacctctcaagcacaaaaatagttggaataaaagggaagaaataaatgtttcttcacctttctcctactgaccaccactctgacattaacttttacatatctgctgttttggttgttctgaaataattgagtaagatggaaaaaaaaagctgtgaaaacataggatagcttatatccagagacagggaaaatggaataaatttaccttgacacttggatactaagcattactctcttactaactagctatataacctttggaaagtaatttaagccacctgggcattaactctctcataagtaacaatgaaaaggttggaccaaatactctacatttgagagtcttcagctctcaaattctacaggtcctagaagaactagaaggaaaatctactcccagacaaactcttcatagcatcattactggtatagcacttgtagaactacaagttagcaagttacaggatttttttttttaatcaatgggaaagtagtaaatgaaaatactgttcacttatagttttaccaggagtctgtattacatatatacatgaaggaacaaaattcaactaatttagcatacaagaagaatttagattatttcataagtatagttatgaaatgatctaaagttattaaaagattttaataaagaataatggccattatccaggtaacgtaagatatgtatgcttaacagaactgaagaaaattcttaaataacaagttcatgtaaaagtagtctagcctttacagatctttggtgaaggagattccttgtagaattctacaaaacgtgcacagtggctgaagaatgggctatgtaaatgtgctgagaaaaaccacccaagacataacacttcacagccaactggtataggcctgagtgtggaacagcgtcaagaaatgctgagaaaaaacagtgtcaagaatatggagtttccaggcctgccagagtggagacctttcttttaacattttgttgctaccctgacatccacctaagacaccaaaaggactgttcttcaggagtaaaaattatgcctgagaataagatttttttttttttttttttttttttgagacggagtctcgttctgtcacccaggctggagtgcagtggcgcgataagattttctttagactcaccccaacaaagcttaaagccaagccttgacaagattctctggggagatagtctggagattgagtcccaacaagggagaagggccaaggaaagatagctagcccttcaacagatacttccctacaaagcacaaaatgaagtttaaggtgattagctaacaattaaattgtcaaaataaaaatcaacactcttcagaattttcttcagtgtattattcacaatgactacctttcaatacaaaatgaccagacatatacaaagaaacaggaaaatataatccagtcaaaaaaatgacaaactcaaagacatgaagaacatcctcaccacatcccataatatagcgtgctgttaaactccttgatttttgctaattagatgggtgaaaagtgatacctcgttagactttgacattcctattatgataaattgagcatctcttcatatgtttaagaatgatacttatttccttttgtccaaaagttttacatgctatgctttcccatgttcttactgaacaaatgaattgttgaactttttcacattgatttggagatggtcttcatatttaagtaaattaatgtgccatgataagattaaactatatctgtaggatttctcatgtaatctgtgactttatatacttttttcattcttaacttttgaatttgtatgtatgaacccattgatctttacttttagagcttctgggttttatatcacatttaaataggcttttttgactcaagacaacaaacaaaattctccatttatattctcctagtactttcagcattttgttttttactttcaaattcttgatccatctggaatttatttatttgtagtatattaagtatggatccatctttttatttgcttttcaaatgattatagtttatcaaataccatatatattcaacgtaatttttttctgtactactaatacttttaaggcagataaaaccagtaactgattgttataagacagagactatattaacataccgtacctcatattccgactctaaagatattttattctctttcagttttttttcaagctcaggatccatctgtagaaaaggaaaaaaagtaataagttatctaagtctgtttgttagactcaattttcaattttaagttatagaagagatggctgaaatactatagccaaatacaaacacatggcaaaatctccaccatctactctgatcacataatgataactaatgtactactgccagcattattcaactaaaaagagttaatatctactgattacttgttatgtgagaggcattttgacatatattatcttgtttcatcctcacaaaatccatgagatctgtattatatgtaaggaatatgggacacggggtttgaataacatgtcaaagaagcagagcttggctttaagtattagttctctgcctccagagttcacactattaaccaccaatctaaattatattatggagaaataacaaaaatactaatataatgctgcacttgaaaacaaaaaggaataccttccatgggccagaagtagatatctaccaaaaaaaaaaaaaaaaaatccatagaggtaaaaaggagctaatgctatattaactgtataaaaagcctttctgtatgtggcaaagccttcaggaaaaagagtatgatggctgaaatcaataaacaacaactacaaaaaagcaaagatcaaataagtaaaatagaagcataaccagaggatttcactggaataatgcatgaagagataaaaatgagatgaatgaaaaaaagtattttacaaaagctagacctaaaagttctaacacatagctagaagttccagaattagaaaataaaggggagggagagcaataattaaataaaaatagcaaagaattcaccactacatagcaatgagtcctcagactgaaagaacatcataagaaataagcacaacaaaacaaaaacatttttaatcaaagtgaagttgattaagagaaaaaagagaagtcacaaataaagagtatttagatgaaaaggtcaacagcacaaattctataggcaataaagagtataataatatgaataattttatgccattaatttgaaaacttagataaaatggacagattaatagaaaaatacaactttccaaaactgacaaaggcacaatagacaacctgaatagttttacaatctataaagaattaaatctataatgaataacctcacacaaagaaaagtccagggtcagatggctttgccagtgaattctcccaaggaagaaataatgccagtgtaacaaacactctgtatgaattatgtggtaagcataaccctgatatcaaatttcacaagaaaataaaaataacaggccagcttcatatatgaacacaaatgcagaattcttagtgtaaaaagaattcagcaacataccaaaaagacagcataccatgatcaagttgaatttattccagaaaggcgaagttaatttggaaatcacaatgtaatttgcaaacaaactaatgcgacagaacagagaatcctgaagcagacttaaaaacttatatgaacagttgatttatgacaaattaggcacagaagagcagtcacgaaacaatgcgattgtcaatatttgatgattgcacaatttcttatctattaagagaatatattcctcacatcacatacaaaaaaagaaaaaaatcaattccacatagaatgtagacccaaatatgaaaggcaaaaatcaaaacttatagtaattcacatagaaaaatatttatactttggagtagggaaaatgtttcttaaaaatcataaagtaaaagaagaataaaatatattgtattgaactttttttctttgagatggaaatctcactgtcaccaggctggaaagcagtggcacgatctcggctcactgcaacctctgcctcctgggttcaagcaattcctctgcttcagcctcccgagtagctgggactacaggcatgtgccactacgcccggctaattttttgtattttagtagagacggggtttcaccatattggctaggatggtcttgatctcttgacctcatgatccacctgcctcggcctcgcaaagtgctgggattacaggtgtgagccacggcacccaaccaagtgtattaaacttaagaaaatttgtttatcaaaagataccattaagaaagtgaagactaaaaggtttataatctggcatgcataaaaagactcctaaaaaatagtaggaaaaaaacccaataatccagtagaaaaaaatgagcaagaggcctcaatagacacatcacaaaaatgaatatacaaaatagaatacaaaaatggccaacagacatataaaaagtgattaacttcatcggtcaccatggaaaatttaaattcacctcataattggatagcaattcgtaacacacccaccagaatgattttaaaaaacaaaacaaaattaaactgacaatacaaagtatttggagccttaacaataaattgctggtaacagtatagatggatagtcattctgaaaaacagtttggaattatcaaataaaattgaagtatgatacaacaccctataatctagcaattcctttttgtacatgtacaggagaaaagcatacaagaatgggaatgttcaggatgtcaccaagatggcagaatagaaggtaacctgctcatatccccccatagcaacaagaatcctgcacctatccacagtaaaaagtcttgctgcaggaacctcagaattcaggtaggaggttgtcaaaccctgatggagccaaagacctaggaaggtcgttttgaatgcattcacacctaggtggatgatccactgagcttgcttctaagttcaagcctggaaacagcccagtccttcaacgggcttagctatagccccatttggccttcagtctacaaccaaaaccagctgccaagaggtccagaaggactcatacatgctagtgacttaacagaaaggcttgtctgcctgatgatattggtcttgacagtgagcctgaaagtgaccctgtggctctgctccagccttcagctgcaggtcccagctcagagctgtttacacaaggacccaaagggagactcaacatatctggcagcccaggagtataggcctcccctgtgggcttgccaacctcctgtcacagcagatcctgagggggcccagcgtcagctgcagcccctcttgctgtagttgagaaacgatcctgtctgcgcaggatcctccagggagacaagtgccccacttgagccaacaagatccagctctctagcctccaggccacagcagatcccaggggggcccagtctcagttctagcctctcctgccacagttggggaactatcctgtctgtctagggacctgctgggaaatgcacacccacctgagccaatgtgacaggcatgccatcctctcttctacagtagatcccgaggcagctcagtctcagcttcagcccctcctgtggaagttgaggaactaccccactgatgcagtgacctgccaagtgacacatgctcatccgtggcaatgagaggggatcatcagccttcccacagcagatccagaaggggtccagtctcaactccagtcccttttgctacagtcaagaacccatcctgcctatgcagagaactgttgggaggcatgcttgtctggtacgctgagacagtcttctggactcaagtacctggtcagcattcccacacagccccagtacctaccttggatcttccacagatccatttgggccaaaaagccatgccaaccttggagccttcataagactcacggcaagcctgggctttgggcactctctagggctgaggcagctcaggtggacacaggctcagggaagacaacagtcagtgtgcttagaatccctggaacaccctctgaagaaggacaggcacaaacaaaaccagacttgcacagactaagataaatacagaggctctcaatgtgcacaaactgtcacatttccttgagtatcagaaacatttaggaaaatatgacctcatcaaatggacaaaataaggcactggaaaccaaccctaaaatgatggagatgtgtaatctttcagacaaaaaactgaaaatggctgtttcaaggaagttaaataaacttcaagaaaagacagagagccatttagaaatttatcagagaaattgaacagagaggttgaaataattttttaaaaatcaaacagaaatcctggagctgaaaaatacaatgaatgaaacaaaaaatgcactacaaagcatcaacagaagaattcagcaaacagatgaaagatcagtgagctcaaagagaaacgatttgaaaatacacagtaagaagagaaaaaaggaaaaagaatgaaagtaataaacagctcacaggatctatggaacaacataaaaacagcaaatattcaggttattggagttaaagtgggaactaagaaagacaaaggagcagaaagcttattcaaagaaataataacagaaaactttctaaacctggagaaatatataagtatctgggaaaagcaaggtaaaatgtcaccaatcagattcaacccaaataataccccaagacatattataatcaaactctcaaacaccaaagtcaaagataagaggctaagagcaataagagaagtgaagcaaatgatagaaggggcatccatatgcctggcagcagacttcttagtagaaactataaaggccagaagagagtgggacaatatatttagagtgctgaggaaaacaaacaaaaatactgtaacaaccaaaaatactgtatccagcaaagttatccttcagaaatggagagatgaaagactgccaaacaaaagcagagggaatttattgttactagacctgtcccaaaagaaatgctaaagagagttcttcatactaaaagataagaatactgcatgatatactaatactgcaatcatgatgtttaaatcacttttatctttagtaagacaaaactattaaaaatagtaactgcaacaatttgctaagagattggcaatacaaaaatgtaaattgtggccaggcgcagtggctcacatctgtaatcccagcatcctgggaggccgaggtggatggatcacttgaggtcaggagttcaagaccagcctggtcaacatggcaaaaccccgtctctactaaaattacaaaaattcatcggttgtggtggtgcgcacctgtagtcccagctacttgggagtcttaggcagaagaatcgcttggaaggcagaggtggcagtgagccgagattgcaccactgcactccagcctaggcaataaagcaagactccatctcaaaaataaataaattgtaacatcaaaaattcaacatgttgggggaaagagagttaatgtgtataggtttttattttggtttttcctttttctgtaatcaaagttaagttggtatccatttcaaataagttgttatatctataggatgttttctgtaagccttgaggtaactgcaaagcaaaaatccgtaacagatacactaaaaataaaaagcaacaagttaaaatatactaccagataaaaatcagttaatcacataaaaaggaatgaaaaaaggatgcgaggagttacacaactagaaaacaagcaacaaaatggcagtagtaaggccttacctatcaataataacagtgaatgtaaatggactacactctccagttagaaaacagagtggctcactgaattaaaatataacacccaagtatatgctgcctataggaaactcacctcatctataaagatacacataaactgcaagtgaaggaatagaaaaagatattccatggaaatgaaaaccaaaaaaagaacagaagtagctatacttatatcagataaaatagacttaagtcaaaaactaaaaagagacaacgaaggaaattatataatgataaaagagtcaattcagcaagagaatataacaacagtaaatatatatgcacccaacagctgagcacccagatatacaaagcaaatattaacaaatctaaagggagacagactgcaatacataatattgggggatttcaacaacctacttttggcaatggacagatcatctaggtacaaaatcaacaaagacacattaaagttaaactctaccctagaccaaatggacctaagacaaatttacagaatgtgtcatcagactgctgcagaatacactttttctcatcagcacatggaatattctccaggatagaccatatgttaggccacaaagtctcaacaaattcaaaaaagtatcaatcatatcaagtgtctactctgaccaaaacagaataaaaatagcaatcaataacaagaggagctttggaagctgtacaaatacatggaaattatacacaacgctcctgaatgaccaaagagttaaaaaaaaaaaaaaaggaccaaatttttaaaatttatggaaacaaataaaaatggaaacatgaacatagctatgttcatttgtttacctttgtctatgactgccttttgtactacaacagcaaacttgagtaaatgcagaagttcaaatttactatctggctctttacaggaaaagcttgctgatccctgacttagatttgaagcacaaatgaatttcacatatataatattgaataaaagaagtcagcacaaaagaatatatataattccactgatataaaattcaaaacaaagaaaattaatcaaaggttttgggatgtattctaaaatggtaaaaccaaggaagtaattactataaaaagcacagtagggccaggtgtggtggctcatgtctgtaatcccagcactttgggaggccaaggcaggtggatcatgaggtcaggagatcaagaccatcttggctaacacagtgaaaccctgtctctactaaaaatacaaaaaattagccgggcgtggtagcatgcacctgtagtcccagctactcgggaggctgaggcaggagaatcgcttgaacccaggaggcggaagttgcagtgagccaagattgcaccactgaactccagcctggaccacagagtgagacttcgtctcaaaaaaacaaaaaacaaaaacaaaaacaaaaaagcgcagtagtgtttatgctagggccaagaggaagacatggagcggcaggaggagagattaggaagcagcacacagaatgggtctggaatgcttaacaatttttactttttgacacagatggtggttacttgggttttcagtttatgataatttattaaattgtacatgtatgttcaatatactccttggtttctgtattgtgtttcacaacaaaacaacttagataaataaaaataaaataatgaattactatattaataattgcatgtatgtaaaagggataaaacacaaacctacaatacaagttaacttcctcatatgctttcaactaagaaaacagcaaatgacctactgttggtgggcacgaggaactgactgtattattgagagatatatctgtactttgtgtgatttaaaagaaatttttagtgctaattttgattgtgtgaaatttctgccttaccagcatacattaaaatcaaacctctacctaagatgctactctattgtataatgctttgataaactttcttcctgtatctttattttctgtacaaaatttatccaataatctaaaatttatccaataatgtcaaagtaatttgcaaaacaaaataatcaaccaaaaaatgctattactgcagtctcttggagtttaagagataaagacccactaaaggaagggttccaaaagagcttagagttgaaagcccattttttccctggaaacccttgacacacctggtaaacccataggataagaacaaaggtttgaaaccaggcagatggctgctactggaggtcacagaaaccaccacacagggctataatgacaaaaagtagagatcaaaacatgcaacagttttgaaattctagaactgcataagatagaagtataccactaggttgaaaattctctgaaaagtagagcagaatttcctggagtatcaatttaaagccatgtaggtccatggacattatttataaacaactatagaggttccagatgatattgttttcctccaggaaaggcttatccttttttctgcaatacagacagattgggggctaggaatagtgaagaaacagagaggatagcctaagtcttaattaactgaagtcaagccaggacctggctcactcctggatgatagtaagatggagcagccctcaatctatctgcattgcagaaaaaaggataagccttttatggaagaaaacaataccatctggaacctctataattgtttataaataatgtctagtatttaatttaaaaattatgaggcatgtttaaagatagaatcatataactgaaaaaacaagagaaaaataaagcagatctatagtgatccttatgttggagacaggccttttaagtaacaataatttgtatatgttcaagatatcaaaggaaaaaatagattaaaatatggcatcatagaagatttctccagactactagaatgtgtaataaagaattaaatgcattttaaaactaaaaaatatagtaactgaaatcactaaatcaagggatggcttcatgtggagattgaacacagcaaaaaagaggtttagtgactagaagataacacaatagaaaatatacaaaataaagtacaaaaaaaaaatgaggggaaaacaaaacattgaaaaatcataatagaaatgttgggcatgaagaatataacacacatctgattggtatcccataaagaaaactcggcaaaagcaacaactgacaagataatgaacaatttttggttttacattttctgtggtttcattaaaatcttcaaagaaatcagaagataatttggctttttgggtctcttgtttttttgagacagggtctcgctctgtcacccaggctggagtgcaatggcacgatcacagctcactgcagtctcaaactcctgagctaaatcaatcctcccagatcagcctccgagtagctgggactgcgggcacgcaccaccacgcctggctacttttttcattttttgcagagatgaggcttcaccatattgcccaggctggtcctgaactcctgattcaagtgatccaccaaccttggcctcccaaagtgctgggattaacacatgtgaaccaccatgcccggccccagaagataatttgaaagtcaattttttctaaatcaagtacctaagagctaaggtggacatttcttggtgccatttttctgtttagcattgatatactatagaaagcacgatccttggtaaaatttaacagtatacataggaggtcaacaaacctggtaccagtcccccttttgttcacccataggatattttagtagttctaacctctgaatcagaaaaatgtcactttagtcagtttcatagagcaatcaagagaacaatatgataatgcatgttctcactggtatggtatacacaagctaactcagcagctctattttagactgagtatagtgttgtattttggggagatgagtaaacttatgattgatttataagtacttgcctgcctcatcgtggacctgtgagattcagtcttcatatctgttttcacattcctgtctccaccatgcccaatctaatttcttgtttgcgtattgtgcagtatgctccgttttggttatttaactccttaatccagttgtatgtgtccttccatatgtcattaaagtaacagagtcatttagctttccttttcagtgatgtctgaatcatactggcactgatattataattgttctcattttcattatctaatcttagaaaacacggtcacaatatttataatgttaaaaattaacaccatctgttacaaagcacaacaggcaggcaaagtcgaagacttactgctcgcaattgcaatgtacttatattgcacacttaaatcacatcttttggtgtgatccaacaatgtatgacccattattgtggatccttggtggttagaatcagcactcatgagaaaaaaacagcaacagccactagggacagcagataaactattccaaatcattttctaaaacttgaaagctgttgcttccagcccttacttttttaggcttatactttcccatgaactttgcacatccattactgagaagcaagatttttttttcctgggatgccaaactttcagtacaaaaatcaggactgtctcaagcaaacaatgacggttggtcaccccaaatccatattgtgctttctacatccttttccaaacttctcaactgaacccatcctctcttgatccaatttgttcctttagaccacagtgtcaaccccccttgacctcagcaatttaccctcttgaccaccctaacctcaatctctcaacccatgcaaccactatcagcctcaaacaatcttatcctttcaatcctgaagaacaaaactcaacctcttaactcctctcaacattacctcatcctctctacctaactggaactcaacctcacccaaacactgactcttgatcacctgagtttgacttttcaacatcatcaaccaacctcggcctctaaatgtcataagccttgtcttctgatccttctcacctcaaccatgtcctctcatcttcctcctacagaccttaaccatcctccttcttttaacctcattcccttgacttcaactgaccttgtcctcacaacttcaatcaacctcattctcttaaccttacctaatcttgttccgtttactttgactccatttcctaaacctcatctggtagctcaacctcccctgttctccttaactgggtgatatggtttggctgtgtctgtacccaaatcttatcttgaattgtagttcccatgtgtcatgggagggacctggtgggaagtaatcaaatcatggacgtggtttcccccatgctagtctcatgatagtaagttctcacaagatctgacggttttataagggatttccccctttgttaggctctcatttctctctcctgccgccatgtgaagaaggtcatgtttgcttccccttctgccatgactaagtttcctgaggcctccccagtcttgtgaaactgtaagtcaattaaacctcttttctgtataaattacccagtcttgagtaggtctttattagcagtgtgaaaacagactaatacactgggttattggcaccaccatttacctagtcctcaaaaccaaaaccttgagacatcttagatttattcatatttttgtattacatacattagtcatcaaatactatcaatttgctgctaaaattattgctggaactcattaatttctctttatcatcgttgcaaatattttatttcaggttccattattgttcatctatgctactgccccagaatcctaacagatctctttacttccaacctaaacaatattttctcttctctcttgctcccccaatacccatccacctgtactccactgccagagagttagttctaaaatgaaacactgaccatgtgcccaataatccctctaccttatagaatataagtcatttctatcatttagctaattcctactcattcttaaagcctaattcaaaggctaatgcctttagaaaactttctctgattctccttttccaagttaaaactatacacctctccttgaacgtctagtaatggcattttactggcattgctatattatatgtctgggtacatttttttaattagctgtcttccagcctcaattataaactttataagtactagtttctgaatactttacttgcagcatctaacaagtattaacacatgaccactattcaattatttttcaaatatatacttattttctcccttccaaatgtcatatactaccataattttcatcttaaagggaaaaagaaaaaaattccttgataaaataattgggatgctaactgaaagcttttaacacagttaaattgaaagttgctaactgaaaattaagtaaaattcctcattaaataaaattgttctaatccttcatagaaagtacacatttttttaaatttaaaatttaccctaatacctactgtccttaaaactagctgatgttggtttctctaaaaccataaaattaactgaggaaactgaataggactttatactctacttttctatcaatattactgaggtctgctaataaaatacatatattacttgagaaaaaaactacaaatatcagatatgtgccataaacaaaagctatgtacttctgaatgaaaaaaccagagttcttatgtgtcctgaatttcacaattgtgtgattagagggtgagaatcctagctctacccctaagtagccatgtgaccttagccaacttagataagctttatttttcttcagttttttcaagtaaagacccactatagttaatgtatagaccccctcagtttcctcacctgtaaaataaagacgataacatatagccccaacttgcaatgtttcaacgtacgtttcttttactttacgatccatttaatcagatattaaatgcattttttacttatgatattttcaatttacaatgagtttagcaagacataaccccattataagtcaaggatcatctgtgtgtgtgtgagtgtgtgtgtgtatgaactaatatagtcctactacaaagtagatactataaatgtagctgtctttatttatactgaaaaatagttttccttttagtaacagttattaaagatacatatcaatatactttatacaattactgatattaatattaaattaagagaaataaaataaagcaaaattattgacctctgttttttaatcccttctaaattctaaaaacagctacatcagatcatattttgtgggagaatgctaacaacattgcaaatttcctaatgaaataagaaagattactagactgggcacagtggctcacacctgtaatcccaacactttggaaggccaaggcgggtggatcatttgaggtcaggagttcaagaccagcctggccaacatagtgaaaccccatctctactaaaaatacaaaaattagccgggtggtagtggcgcacacctgtaatctcagctactcgggaggctgagacaagagaattgcttgagcctgggaggcagaggttgcagtgaaccaggataggccactgcactccagtctgagcgacagagtgagaccccgtggcaaaagaaaaaaagaaagattacgaaattagttacatttcatgattcactgccatgtgatcactaatgttattttaaagaaaaaaacaaagatcacatcttagtgttgaaaagcaagacaaactcagactacttagtatactgagtatacaattctcctaaaccagaacatacatatagacagacacatgtcaaactctaattatatttcttactttactcttcacagcatcatatcggatttgagaaaactcacgaagaccaaaagaacctccaacaatcagcaactaaaacaaagaaaggaaacatttaagcaaaacagaagaccagaattcaaattcagcctatctatagattgcttttctaaacaacaatagaggcacattatacaaaaattctatagattatttttcctggtgagtcaccattcatcttttagagtaaatgcagtatatactggctaggaaatcattatagcacatcattaccaaataccaaaatcgtcaccctatacctgtatttgaccttatgatttaaatgacatcataacaagcattgtattatctgactcttacaatagacctatttttgttttttgctaagaaaaaaacaaaaacaaaaacaaattcaacaaatgaggaaataaaagcacagccagctaaatgacttgtccattgttaacttaaattttgcccagggatgtctctgtaattccattgctatgcgatcttccttagtaagtaatgaaattgaaacctgatcaactgatcagaccatgtccaaataaggcagatgcctagctataaccaaccaagctatttctgtacttcactttcctgttttgtctatactcattgcccatattgcagaatggagctctctcaacttctggttctgagtgctgcctgattcatgaattttctttgttcaaataaactctataacattattgtttttttgtttaaggttttccttcttttcgtactatgattacacaaggtaaacccagcagtaaaacttgccattttttccttcaagaccagaattcttttgattttatgatttttcaaaataaggcaattggagttctcattaccttaccaagtgataaagaaatctcatgaaaacttgctgcagaatattctgtatatcacattgtattcccagggacaatatggctatacaggtcacaggtaaagaaagtcttcaaattcttactatatagtgaaattctgaaacatcatcttaagatatacagaatcactttcatgtttttgctggcacctatttgaggcacagtattttcaaaagatttaaacttcataataaagaattgtaaccaccgaatgggttcaccttgcgtgctacctagacagagctgatttatcaagacaggggaattacaatggggaataacaatggggaattgcagagccagctgtgtggaaaccggagttttattattactcaaatcagtctccccgagcattcagggatcagagtttttagataatttggtgggtaggggcttgggaagtggggagtgtgctgattggtcagtttggagttggactcatagggggcaaagtgagctttccttgctgttttctgtcactgggtgggatggcagaactggttgagcccaattacccgtctgggtaatgtcagctgatccatccagtgcagggtctgcaaaatatctcaagaactgatgttaggttttacaatagcgatgttatccccaggagcaatttgggaggttcaggctcttggagccagaggctgcatgacccataaactgtaatttctaatcttgtagctaatttgttggtcctgcaaaggcagactggtccccaggcaagaagggagtctttttgggaaagggctattatcaattttgtttcagagtcaaaccatgaactgaattccttcccatagttcggcctatgcccaggaatgaacaagggcagcttacaggttagaagcaagatggagtcagttaggtctgatttctttcattgtcataatttcctcagttataattttgcaaaggcggtttcagtattgctacaaaagttaatgaccacaaggagaaactcactcaccattacttattgtgtgtcgctcttataaaacaagcttagaatggactttggatttcagaagacacctgtagatttccctgacatctcagagcagggatgaatagtgtaagattctccctgggacctgaaagcttaaggagatgaacaactcatcccttctcaggcccagtcccaaggcacaaggctacttgtaccagcagtgtgcaccagcaagatagcagaagcaggaagagagccggccggaaaatacgtacccctgaagattgagaaagaggccatccaggtacaacagagcaattatgtcagactaggacacttcctgtttacaggagactataaaacctttgtcccatcctcacttggggctgatgccattttaggcctcagcccacctgcacccacgcgctcatcaaaacagcatgttgctcctcaccacctcatgttgtctgttggtgcgctctcagggttccaaccgatacaagaaccgtacatctggtgctgaaacccgggagaggttctggtccacgtcccctgtgaacctacccctccaccccagacagcaggccacagcagccagacaaaggaagctcctcgatctccagttgcctctctgtgcatgcacattggtcactgatcttgcttactggtaagtttcctcaggggcccagttagcagggaaaattcacacggcctctcttagtttctctggtccgaatatccagtgttggtccaagaaggcgccggcgtgtgccaggcactcgctgatcatctggtcttagggggatgcctctaagccatttgatcgtgttccaggaacgaaaaaggcagcggtgacagttgctccttttatcatctccctccaggatggtctcctttttccctgttctcctgagcctaccctctgttatgggaaactccggtcctccattccaaacaacagccctctaggctgcttcataaaaaacctgcaaaccttaggcctcaggcaagatattcgctctaagtacctgtcttttttgcaatacagcctggccacagtacaaattaaataatgggtccaaatggcctgcaaatagaacattcaactttacaattttaactgacttaagcaattattgccgacgactggaaaaatgggaagaaattccttatgtccaggcctttttgcactcagttcacaacccaacctctgcaattcttgcttacctgttcaaatccttcccctccattctcaccgccctgatcgcctttctcctcccgaccctacctcatttttctcgttcgatccaactgactgctatccacccctcccaacccctaccttttcctctcaaccatcttttttaaccccccaagcctcctcgttgtcttctcagctgccatcttcccagctgccatcttcccagtcagctgtatccacttcttttcctacaccatcccctcctcgggacaattctagtattgcctgtacccattctcctcccccactgccctctcctaaagcttgtaaactcatcccgccaccttacgcccctgcctatcctccactgcctgttaaccctccttcccccttcaaaccctcagaacgaaccattatcttaaaccttcggttcatctcccaatccacccccgatattcggtgcaagcttcagaagcttgatgatggccctcaaacctcacaagaccgtcttaatttagccttcatagtctttaacaatcgtgatagggaaagtaaaaggcaaaaacaggcggagtttcaaatgcttgcctccgccatcaggggccctgcaggcccacgggtccgcagctccacacggaagcctcctagcaacctacctccacttggcaccttttcaagtgcggcaatgaaggccactggtccagacaatgcccaaatccaggtaagcccaccaggccatgccccctctgcagaggaccccaatggaaattggactgtgagcggcccctgcaagggcggccccatcacttcctaagccggccaaaacctcctacttggatctcattggccttgccgctgaagattgatggtgccctggaatggatgccccggcaactaccatcgcttcatccgagccaagggtaaccctgatggtggcaggtaggccagtattttttttttaattaataccgggcaaactactctgctttacctaatttttcaggacacacccagtcctcccttttctccgttgtgggaattgacagacaagactccaaaccctgagccacccctccacttttctgctccctgcacaccttttccttcagtcaccctttcttagtcctgccctcataccagagacatcctttcaaaactccacactactctccacttgcacattccccatagtacccaacgcatcaacccagacccctcggggcatctaactttcttctactcctccaacctgccaccttaaaacatgcaactttaccttatcccccatccgtagttaaccccgctgtttagaatatttccacaccttcagtcgcaaaacaccacacccccgtccgcattacccttaaagagtccacccagttcctatcacagaagcagtatcccatcccccaagcagctctcataggcctaaagcctatcatttctcgccgcctcaccagtcacctactccacccaagaaactctccttttaacacaccagttctacctgtttaaaagccagatggaacttatcacttagtccaggacctcaggctcattaaccaagctgtactcccagtatgtccagtagttcctaacccatatactttactttctgcaattccctccaataccacccattttcctgttctatacctaaaggatgcttttttccacaattcctttacaccctgattcccaaaacctctttgcctttacatgggaaaaccccgacacccacctttcacatcagctcacctggtgcgtactacctcaaggtttcagagacagcccccatctttttggacaggcccttgctcatgacctctgtaccttatccctaaaaccgtccactctccttcaatgtgttaatgatctgctcctgtgtagcccctctcaaagagactgcaacgcccatgctatctctctcttttaaacttcttggcagaacggaggtatcgggtctcccctaagaaagcacaaatatgagcccccttagtcacttatctaggcctggctcttaccccatgaacccgagggctcacaaccgaccacatatccctcctccagtctctcccacctctgcaaactaagcaagaaattctctttcctaggactagtgggatatgttaggctctgggttccctcctttgctctacttgccaaaccattataccaagacactaaaggccctctccatgagccttcaaaccctgcatagcctattacccaacctttccatctactccagaagactctcatctcagcccccatcctcactctcccagacctcaccaaacctttctccctctataccaacgaacgtgtagagttgcactaggtgttctaacccagtctaagagacccaccctccaggttatcgcctacctctccaaacagcttgaagccacagttctcagatggtctgcctgcctccaagcactggaggcagctgctgtcttcatccttgaaagcctaaaactatctctccatgccaacctaacagtttattcaacccataatatcaaagacatgctagctcaccacagtgtactaagtctcatctctgccccacggctcctccaactgtatgctctgttcatagaaaccccccaaatcaccgtgctaaccagctctcatgtaaaccctgccatgctctttcctgaagctacaaccgcccaataccctacacacttctgtgtgaacactgttcaaacctttcttacaccttttccaaacctaacagcccaaccccttccagatgcctcctttacttggtttgtagatggcagctccttcctatgtcaaggatgccggcatgctggctatgatatagtgtcaccccctcacacacactactgaagccaatccgctcccccaggcaccacctcccaaaaagctgaatgcactgctctcactcaagatctcactctagtaaccagacaacaaattaacatatattcagattctcattatgcgttccatatagtacactcacactcgtctatgtggaaagaacaaggttttttaactgcaaaaaacactcctgtcataaatggctctcttaccagcaagctccttcaagctgccagactcccgcagaaagctgccttcattcattgcaggggccaccaaacccgggacaatcctatatcggctggaaatgcgctagcagatcaggtagccaaacaagtagccctgcaacccatgcaaggccagtttctgtccctgtccttgttctctcctctttactcctcagaagaaaaggaggacttctgagcccaaaaccttcaaaagcaaggaccatggtatgtcaaggaaaggcacttcattcttcctcactctcaaagccttcctcatctccaaagcctccccaacactttccatgttggttacaaattctcttgcaacttctccgccctgttctcacttgtcctcacctttccagctatgttcaagatattacccagtcctgctctatctgccactcagtgtcaccccagggctccctccggccaccgccttttcctacccaccaagcccggggccagatacccaggcacgattggcaagtaaacttcactcacatgccgcccaataaacagctccgctatcttctagtcttggtctgtaccttctccaggtaagcagaagtgttcccaacaacttcagaaggtgcaaatgtcacacaaactctcatcatgcatataattccccatttcggcctcccaacatccatccagtccgatacaggcccaccttaatcagccaaattatccaaggcgtctctacgtccttaagaataaagtaggttctccacacaccctacaggcctcaatcttcaggcaaagttgaaaaaatgaactctgtccttaaagcccaactcaccaagctggctctaaaaacccagcagttgtggacaaaaaaaatctcccttttgccctcataaggctctgcgcaacaccaaaagcaccctctttttatagtccctttgcaatcatgtatggctgaacttttgtcttggggcctccacccttaccagactctgagcccttcaggaattaccttccctccttaatccagacagggtctttcatttgtgaagcagcaaatgaggccatgcctctccctgtccacaccgccttgtcctctcaacataactgtcttgcaggcacagatgtgtttccagacaatccagatgatgctcctgatacaacgacatggtggacaccagcccgtctctcaagaatacccaaaaaattaaggttttctttttccaaggtgcccacgccacccctatgtcacgcctgaagtagttattgagaaagtcatcccttttcccttttctataaccaaatagacaggaatgtaagattctccccggggcctgaaagcttaaggagatgaaagaaaaactcttcccttctcaggcccagtcccaaggctcaaggctacttgcgccagcagggtgcgccaggaagatagcagaagcaggaagagagccggccggaagacacacccctgaagacccagaaagaggccaatccagttacaacttagcaattacgtcagactaggacacttcctgtttacaggagactgtaaaactttcgtcccgtcctcacttggggttgacgccattttaggcctcagcccgcctgcacccaggcgctcattaaaacagcatgttgctccataccgcctcagtgttgtacattggcgcgctctcggggttcaaaccaatacaagaaccttacaaatagtcagctgggtcacctctcacctcatattgaagcaatacagcagtgacagctaactaagagttatcttctcctatgcaaagaaaacatatttacaatactgtcattgcatttataaatgtattctctaaaaacaacaacacacaaatgattttgtccaacttacacctaactatacgtgtttagtagaataacaattttaatgtttaatattttactttctgttctcctatcattttcccctaataagaaatataatttgagtacaattaaaaatgaacaaacaatagttcatccaattcatttggttaattcatctttttgtgcttttaggtcaatttgctatcttcagtgctgcaatgtattacaaaggtttatgttgtggaactttgttaataccaaatgctgtatctcaaagcagctaactgaaaacttctatagactggacttcaaatatttttgcatcagcctaactgtggaatttacacaactcagaaaaagcagacatacctgacattttgctgatttaacaaaagaagaaaataatattttcaaaagcttagcccttctactaaatgactgaagccattcttcaaggggggatgaaaggggtagggagccctcattagggtagtattttgcctgaactcaaagggtacaatttctatcttatttatgtctttccccccaatataaccactgtttccaacttattggttgtccttcaaaaaatcatcaatccatgtataagcacagacattttaaacataccacactctccctttaatacaaacggagacataatatgcatcgtgcttaccatcttgcacactgcattaatattttattaataaatacacacaaaagtgtatataaagcattaatttagagataataattgtaacataaactacaatgcattaactacccagtttaacaaatagaatactgccaacacatataccccttgcagataaaagggtaaccttcctctctttaccgttaacacaaaagctagattttattgcattcacttcttgattttcttctttactttaccatctatatataataactaaattctataattaagccttttctgtttttgaattttattaaaactattctttggtgtaactttttttagtgagaaattatgtattttagattaaagtatattgtatgcagctatagttaattttctttgctatatggtattccattataaaaacagaacacagtttatttactcattctcttgtttgatagttgaatgatttctggaataatgtcacagcttcaaggttttgttggtattcttaatttcaaaattataaaagtttatgttttatagtgttttataccttttaatatttaatcatttaattggtaatacaagtatatttatataaaaaggaaggtagggatcaaactttatttttttgcaaatggctagaactttcagcttcagaatgagggattaaagctaattagatttttggatgacatgataaagcagcaatgacaatttggggatcttttaagattactgcatactgggaagtgtggtaaatttcatgtgatttcttttttcttttgaaaaacctggcaatatttatttaagaagtgaagatgtcatttatttgacccaggaattgatacttacgtgtagtatataatactggtctgtacttttttatttatttatttattttttgagaccaagtctccctctgttgcctgggctagagtgcagaggagcgatctcggctcactgcaacctccgcttcccaggttcaagcaattctcctgcctcagcctcccgagtagctgggattacaagcatccactgccatacccagctaatttttgtattttcactagatacggggtttcaccatgttgcccaggctggtcttgaactcctgggctcaagtgatccacccgcctcagcctcccaaagtgctgggattacaggcatgagccaccacacccagtggagatctttttatatttgtatgtgtgtcatacatatgatatttttataactacatgttatataattatatatatgtaaacataatgcatattacatacattatttatgtgcactactcactcatacattttctaacacaaatatatttctttttttttcttttttttttttttttttgagacagagtctcgctctgtcactcaggctggagtgcagtggcgcgatctcggctcactgcaacctctgcctcccgggttcaagagatcctcctgcctcagcctcccaactacatttgtttttgtacacatatactggagaaaaaatatccagtaatggaatttctgggtcagataaatgacatcttcacttcttaagtaaatactgccacttttttctaaagaaaaaaagaaatctcatgaaatttaccacacttctcagtatgtggtaaccttaaaagatccccaagttgtcattgctactttatcatgtcatccaaaaatctaattagtttcatgcctgtaatcccagcactttgggaggccaaggcgggagaatcacgaggtcaggagttcaagaccagcctggccaatacggtgaaaccccatctctcctaaaaatacataaagtagccgggtgtggtggcacgcacctgtagtcccagctgttcgggaggctgaggcaggagaatcgcttgaatctgggaggtggaggttgcagtgagccaagactgcgccactgtactccagcctggtgacagagtgagactctgtcaaaaaaaaaaaaagaaagaaaaagaaaaaaaatctaattagctttaatccatcattctgaagctgaaagatgtagccatttggaaaaaaataaagtttgatccctacctttcttttaatttaatttatatataattttatatatatatacatacacatatatatacacacacatatacacacatatatatacacacatatataaatatatatatatacatacacacacacatagagatagatagatagatagatatacacatatttttttgtgtgtggcagagtcttgcattgtcacccaggctggagtgcagtggtgtgacctcagctcactgcaacctccacctcccaggctcaagtaattctcccgtctcagtctcctgagtagctgggaccacaggcgcctgccaccacactcgactaattttttatattttcagtagagacagggtttcaccatattggccaggatggtctcaaactcctgaccttgtgatccacctgcctcagcctcccaaagtgctgggattacaggcgtgagccactgcgcccggcccctaccttccttttttttataaatatatttatataccaattaaagaattaaatattaaaaggtataaaacataaatgtttataattttgaagttgagaataccaacaaaaccttgaggttatgaatttcattttttttcccatcagaagattttatcatcagaggctataaatttcaaaaccaagtatatgtgaccacataaaaatttaaaacttctgggtgggtatggtagcttatccctgtaatcccaactacgccggaggctgaggtgggagaatcacttgaggccaggagtttaagaccagcctgggcaacacagcaagacctcctctcttaaaaaaacaacaataataataataaataaaacttctatgctgacaaataaatgaaataaaaacaacataaaatcaaaagagaacaaatcagaaaaaatatctgttatagataagcagctaatacctgcaatgtcaaaatgtaagatttgtatacgcaaaataacttttgtttcagtttcaatgaaaagatacaggcaggccatgctgaaaagtccagccatgtgactagagggctggggctttgagctatgtgatatcaacccaacctccaaacctcaagggagaagaggagagctggagacagttcagtcacatggccaatggttcaatcacccatgcctatataatgaaaccccagtaaaaattctggacagtgaaacttggttgaactccctggttggtaaacacatcaatgtgcaaggagggtgacatgccctgatcccatggggacagaacacagaagctctgcatgcaggaccctcctggacctcgacatatgagtctctttttttggctgttcctaatttatatcctttataataacactgtaatcataagtatagtattctcctgagttctatgagtagttctactaaattattgaacctgagggggtggcttaaacctggggttatgcctggtgtaggaagttaggggagttttgtgcaggactatgcatagagtgtgtgtgtgcgtgtgtgtgtgtgtgtgtgtggtgtttgaattgcactgcaacacttactgcctgttaccatagaatccacactcctaactaaatatcttcatttatctccaatcttctcttatctactgaaggacactgattcatcaattctctcctttcctgtatcatcaaaatcttgctcaccactgcaggatccagcataaaaatgctattatttctcctatcttattaacaaactttcctggacaccactttcccaccagataccaacctctttctttgttcctatatgcagaaaaatttctcaaatgagttgcctatactagctgctcttcctactctctcttagatccattccaaccatcaatgacatccacattactaaatctggtgatttacttattttcatctgatttcatgaataaaatttcatacaattgatcacactctcctcctcttccctcatatctggtttttcttttgccacagagtcactctttcttagtctccttgattgtttcctcctgtatacctcaactctccaatgttggcatacctcagggcacaatgttttctcttcttctctattcacttattttgtaatcttaatcaatcttatggctttaaaagcatatgttgattacaacattccatacagacatgatcaagcacgaatcccagtaccaccgggtgaacaaagcagaccagattagtactgcaaaatctggaacctaagttccaggaaagggagcccaaaatattatagtaggctactgcctacaagttaaacatgacgacatcctgctaaactagaagacttaaataggatatcatttcctaatatttaaaatgttcaagatataatacaaattccattgtcatgacaagaaccaggaaaataactttactcaagtttggatatttgaccctccaaacctcctgttgaaatctgacccccaatgttggagggaaggcctagtgggaggtgtttgggtcatggggacagatccctcacgaaaggcttgaggctgtccttgtggtaatgagtgagttctcactctattagttcccttgagagctggttgtcaaaaagagcctgccacctccctcccctctctcttggcatgtgatctctgcacatgctggctcccttttgccttctgccacaagtggaagcagcttgaggcccgcaccagaagcagatgctgtgccgtgcttcacagtatgtacagcctgcagaaccatgagccaaaagaaaattctttcctttataaattacccagcctctagtattcctttatagcaacagtggtccccaaactttctggcaccagggaccagtttcatggcagaccatttttccacagatggtggcgggggtggggggtgggatggcagtttggggatgaaactgttccactttagatcatcagacattagatctcataaggagcatgcaacctagatccctcacatgtgcagttcacaataggactcgtgctcctatgagaatctaatgccacctctgatctgacaggaggtggagctcaggcaataatgcccactcacctactgctcacctcctactgtgcagcccagttcctaacaggccacaaaccagtaccagtccgtggcccaggggttgaggacccctgctttctagcaacacaaatggactaagacaaacttgaattttaaaaaggctatggagagatgctaacacagagataaatcagagattagaattatctgacaaagatgacgaagacctcaaaggaaacatcataaaaatacttcaaacaacaacagattttcttgaaacaaatggaaaattagaaaatctcgccaaagacatagaagatataaagaagaaccaaagggtgatatcagtgacatggtggagtatctccaaaaatcctttcctccacaaaaacgagaatatttgtaaaaaattgtcaaataaacttttttagaactctgaaaattaagcaaaaacttgcaacaatgtgcacagtatttacctaagaaaaatgcctgaatctcaggaagaacagcttggtggcatttttaatttgtcatattctcacccctccacccaagctccgtaacaaccatgaaaaccaacagcctgcaaacatgatgtaaagcctggcaccaagtgaagagggtagagaggttggagctctttaaaacaccattctgtgagaaatgtcatcatttcaccagtctggtacttcctggaagatgctattcacaaagctctctgtagtttacctgacatggagctcaactagtatgaacagacttctcctaggaagcgtttgtcaaaaaaaaaaaaaaaaaaaaaaaaaaaaaaaaattcagaggtaattgtttaacattatgactgtctgatgtggtagataataggaataaggtgtccttagaggactctgaaaagctcaaatatattcctgagaatttagaaagtcatgcaaataactagaactgtgtacatgcccagagcaatgtatatgcccaagaaagacctgagaaggccctaaattctcaacttatgactaatttgaagctctgagcaagtaagaagtgaaggctatacatggagctgtaaattgcatggctgaatgttgaaagcatgcccaaaaaagcatgcagagcctctcgacaaagactggcagatttgttggttttgggttttaaagaaacctctgtccaataaaaggaaacatagtccaattaaaaaatgggcaaaggatttgaacagacatttctccaaaaagatattcaaatgaccaataaacatttgaaaagatgctcaacataataagtcgttagggaaatgaaaatcaaaaccacaatgaggtatcacttcacacctactagaaagggtaataattcaaaagatggacaataacaagtgttggcaaggatgtggagaaattgaaaatcatatcttgctggtgggaatgtaaaatgatgcagccactttggaaaacatctggcacatcctaaaaagttgaagagttaccatatgacctagcaattccacgtctaggtatattccctacctgagagaaatgaaaacatacttccacacaaagcgtgtacataaatgttcatagcagcattattcataatagtcaaaaattgaaacaacccaaatgttcatcaattgataaaatatatccaaacaatggaattatatccatcaaaaggaatgaagtattgatatatgttacaatgtgaatgaaccttaaaaacattctaagtggaagaatccagtcacaaaaaacccacgttgtattagtgtgttaatatgaaatgtgcagaataagcaaatttacgggtagaagtagattagtggtttaccaggccagcattaagaggcaggaagaaatgggaagtgactactattagttatgatgcttttttgggggcaatgaaaatgttctaaaattgtggtgatggctccataactaagaatatactaatatacgaatatattagtatactaatatcgaatttgctaaaaacaacaatttttttttttttttttttttttggagagacagaggtcttgctggtttggaactcctgacctaaagcgatcctcctgtcttggcttcccctaacactgggattacaggtgtgagccatcgtgcttggcccagatacttcaaatgggtgaatcttttggagattcctaaaatccacatttgatgaatgtggatttttcaaaactgtgtaaaatatccattacctttctaagatcacttctttcctttagtctgcttaaatggaaaagctggtaatttcatctgcgccaacattcatacaaaataaaaatatagtctgtatttaaaagcagcttttgttcatatgctttaattatttcatttactaacacatcaaggcttgctgaagcaaaataactggcccgtaatcaaaaagcaaataagagtcatctggatttcaactctggttgtcttaagccagcctcagcctgcatttcatgacatccttagggaactcagtgtggatatggatgaaaccatataaacacggaagctgttttcaacgtgctttagaaattataacacagcaatcattctggctacaatgtggcaggcaccgtactcaacactttattcacaaggtgttattagttcatcacaactctaagtattaagctaattcacaaactagaaagatgaaacagaaagataccaggaattcgtgcagttaaatggaatacatctagtcccaatgatccacagtatcgtcaaaacatagctaagttgggggcgaggaagcaagcttagtaatcatccaaacttggcttaaagtgtggttctgactgaattctctgagcttcaatttacttaactgtgaatcaagggtagtaacaatgaccgcgttcgacgatgggaaagacgccacgctcacaagcagacagatcctagtacacctgaaatccaaccgggagtgggggacagcggcggggaagtgggggtgtggaaaagactggtggaagagcttttaggaaagctctcaccccgtcgctagctccttcctagcccgagtgccagcccttaacttcacattttacagattccctcccaggtcttgatcctgccaaggaggagggtcccaccccttgcggaagatcctcctcactccactcaccaacatggggactccatagccgagagtcttgttcttgcgaaaagcacgcatcaccgcgggtgcaaacatgagtgaactcttccatcggctcagaactccaagcgggcctagcgcagactcccaaatctcagcagctcacgctctcaccaagacgagtacgtccttaactcacttccttttccttggttatttggtgctcggtccttagtgaatggtttccgctaggcaaaagcaatcgagccatcgtaacatacttgtgcgtccgcccagaaatgtgggcgtcagcgtttttggttccgtaacgtcggcgtgcaattgggatttagagatttgaatcggtttacgatcaccaccaaattgatctggaaaccagtacttcccacgttctgggtcctaactaacgtctgcttagaacactcccttaggcacatagccactcgataaaatcagctaaggaaaaaagtattttgaggccgggcgcggtggcctgggtgggtggcctgtaatcccagcactttgggaggccgaggccggtagatcacctgaggtcaggagttctagatcagcctggtcaacatggtaaaaccccgtctctattaaaaaaaaaaaatacaaaaattagccgggcgtggtggcaggcgcctgtaatcccagctactggggggccgaggcaggagaatcgcttgaacccgggaggcggaggttgcaatgagcagagatcgcgccatcgcactccagcctggggaacaagagcgagacttcgtctcaaaaagaaaaaagaaaaaaaagtattttgaagctggtactccagtctttatggctatttgtgggatgaggaatttgccagtttaatggagacttttaaaaataaatcgcttttgaaagattaggttgaaatgtaatcagtgtagtgtctcatcagtcattactgaacttttaatgctaatgattttactgtgagataacctgtaatctttagtcatttatgaatgtctatttaccaatgattcagcaaccatacaggccacctttcagcgtgtctttgaaagggttctaggaacacagataaaaatatatgatccttaccttaaagacactggcgatttcatgggcacagaaacaaacatgtgtgaagtactgggatagcttaggaagccgatcccccacgtgtcccatttaccagagtgaatcagagtgcaggtgatgcggaatattatcttccatgctattcctgaaatatttccatctgtccctgcctctctgttaccactgaaatgttcctttttttaattccttatcatcttttcacctattaaagtagcctcttaagtggtctccagaagagaagctccagatctactgcaggctactccagtgaaacttatccttttggctaagatcaagtgtagtatctgttcttaacagtttaatatttgacacattctctatccaaggaaaatatgttaaatgggtttttgaagcaaggagatggaataggagtttgctccaccactctacacatcaacctgtatttcaatacctccagaaacccaggaacggtgcatctctcccatcttatttacttccttttgatatttcaaaattcatgcagaccaggcatggtggctcatgcctgtaatacctgcagtttgggaggctgaggcaggaggatcatttgagcccaggagttcgagaccagcctgagcaacaaagcaagaccccatctttacaaataataataataataataaattagccaggcatggtggggtctcagctacttgggaagctgaggtgggaagatcacttgagcccaggaggtccaggctacagtgagccgtgatcatgccactgcactgcagcctgggtgacacagctagaccctgtttcaaaaataaataaataaatctcacgtggcatccaggttagttaagcgtatcacatctcctactttccctaagatcctagaagccaaaggcgctgctctaaaactctagcgttttcctacatcttcactacataaaacatcagcctactggatactactccatcaaaacccggcacctaagtagtagctaataatgggttaaatcgtatacatatattcaaaataatgctagagtcgataatcttacacttttcagataaggcatctatccaatttaaggcactctatgtctttagtatcttgtttgttcaatcactcaaataagcatttattgagaaccttgaaatggccctgaaggagtaactgtgaacagtaggaattacaggtatgccggcagattgtcaggggacaaaatctgtgacactgaggaatgtaagcacctatcaaatcatactacataggtggtaaattttaccagctatgcatagcgcccttcttaagcatcactactgtatacttcagtttttccatctgttaaatcggaatgagtgatatttgtcatcagtttacgattctcacaaaaagggaacacaaaatttcttaccagtatggaatctgttgccttcccagaaatatgactcaaattccatgtgtttccattgttaataaacagttaaaatgctgactcagctatcttaactgtaagaagttacaaaaaatgtatattcaggaaatggggcatctccaccatctatgccagtccctgaggactggtatgtacttgatatccaggcaggttatattatcctctagtatctgctctaccagcatttaactcatgcaagtacatgggagcgttgttataaaacaaaaacaaaaacaccagtcttcttgagagctttagtcctgaagttaggttttagaattatggccagaactggccagccacagtggctcatacctgtaatcccagcactttgggaggccgaggcgggcagatcacctgaggtcaggagtttgagaccagcctggccaacatggtgaaaccctgtctctactaaaactacaaaaattagccgggcatgaaggcgcatgactgtaatcccagctactcgggaggctgaggcaggagaatcacttgaactcgggaggtggaggctgcaatgagccgagatggtgccactgcactccagcctgggcaacagagcagaattatggccagaattcatggctatggtaatcgaaagattagttacttcatgaatctttgtttactttgataatgccattgaatctactaattgttttttttttttgagacaggttctgctatattgttcaggctggtcttgaactcctgggctcaaacaatcctcctgccttggcctcctaagtagctgggactacaggtgtgtgctaccatgcttggcttaccatctaatttgattcactcaaaaaccttatgataggggcagaacatgatgccagactcatcttataggttaacagactaaggctcagaaaagttaagaggcaaacacaaggtctcactttggaaggggtacaaatatcccaaacagaactaaatttcctgtagaattggacaatactgactatctccttgaaattctctcctcctgtggcttttatggaagtttcactgccatggctcctctccaatggtgagacttctttttgttgtcttcagacttacaaaccttaaactggagtccttagtcccattttttccctctgtctcagttactctcaaactttagtgtgcaccagaatccctgggagagcattaaaacagactgctgggccccatcaccagagtttcagatttagtagatcagggatggggcctgaaaatctgcccttctaacaagcttctgggtgatgctgctggtctgaggaccacactctgacaaccactgctccatcctctttccctaggtaaactccactttcacattggcttcaaattttatcacagcatggaagacttctggtacacttccaggagcctgaacgattttctaacacctcaaggtcaacatgccaccaaggtttattttaatccttttctccattcaatctaatttctatggctagaactagagtagctaagagttggtctagttcagtccaacttgaaaccagttaaaattgtccttgatattgttcagccagaaaatcaactgtttcttctttaatgcactttctcttatgatagtgatcatgaacattccaagtttagaattattgctgtatttgccttattactttttatggagtataagatatggggtaaacaggaccatgcctaatacatttctgttttccatgacttccttcatagtacaaaaccacaatgcataattttctggaaaaacaaatgaaatgacaggagcagccaggagtggtagctcacatctgtaatcccagaactttgagaggccaaggcgggaggatcacttgaacccaggagtttgagaccagcctgagcatcagagcaagaccctatcttaaaaaaataataataataaataaaacaaaccaacaaacaaaaacaaggaaatggcaggatcttcccatatcatgctatacagtgaaggatgaagaatacatggctcactgcagcctcaacttcccaggctcaagtgatcctcccacctcagcctcccgagtagctgggacaacaggtccatgtcagcacacctggcgttttttgttttttttttttcattttttgtagagacgaggtctcactatgttgcccaggctggtctcaaattcctgggcgcaagcagtcctcccaccttggcctcccaaagtgctgggatttcaggcatgagccaccatgcccggccagtaattctcaaaccaaacaaaaatctgctttgtaacactttggagagaatcaaaggtaactattccatacaaaagtgctagaggtctcttctatacagacagacaaaagaaaccgaaaggaattcaaagacaacggcaatgtcctaaagtacactattacttggattacaaatttcatcaggtagagcaaagcaggaactctagcctgctggttgtcacagggttaagccctatctgaaagctttctgtataaatattgttaattaactagggtttcctttttgggtaggtggatgggtgcttttgtaatataagtcagtggtgaaacaggattttatctattgaactttatgttaaaaaaaactttacagaaacacttatatttagaaatatgaagacaaatgtttgaattgagagcaagtgaagtgcacttttatctcaagataaacttcctggaaaggaaaccattaaaaaatgtcctgtctgtatgtgtgttttgtgttgttttaaatgcttgaataacatctattgtctaccactggttttaaaaaaaaaaaagattagtcaaataccattgtacacacaaagtttcctataaaacaaaacacaatgcacatccaatagaattggaacttgatgcctcaaaaatgaatctatttcctaaaataatcacttccaaatcaaacaacattttgaataacccccaaactgaggaggatatcaaaatagaacttatgttacatggcagttaataaaaaggaaaaaaacttcatatgaagtcctatgattgcacataactgaaaacaaatatccaacttatgaaaaggaaaagtacaacaaaaaaaagcccaaaaccaaaaacacaaacaaaggaaagcataacgagggaattaaccaaaataaaagctaaactaaaaaaataggaaacaagcaaaaatacaagaattgattagtaaaaccatcccaggtgatatcagcagaacaaatagtcaattgacagaatcttttaaaaaattattaatatgctttaagccacttaagttttgcagtggtttgttacataattggtaactgacacacctttgcctatcaagaaagaacatggccattctatacatactgtagactaccaatttgatttcaggcctgaactgcttaacatgggtgacggagcaatgatgaccaatgtaaactgccttttctcttcatatcaaagtcagctgtatgcaaactaacttagaataaaggtcaacaatattcagttctgacaagtcctttttcatgctgtggcacaaacccacttctgccttctatgtatcttataaggctttgggggatgaaggggatacaagtaagatggtaaatgttggcaactgcttgcaaacattgcgaataaatacacaatgatactgctactgctattatagaacatttaacctagtgcagtcaatttcctgttatccataatggaaggatatgatagcatggttgaatcaaattgagtatagtaaaccttaattttctagaatagtggaagggcagtggactcattggcttgaagtaaattcccaggtctggaactgactagttatgtatcttgagcaagttattaacttctttaagcatcaagttacctcccctataaaaatggaatattgacactgccttgcacagatatgagaatttggcattaagttatacaaaagggcagcctaatgcagtgcctggtaccatgggaagtagagacagtaaggtgttatagttatgaatgcaggttttgaagccagattgcctgggtttaaatcacagctttggcacttagtagctgtataacttgggcaagttacttaacctctctatgccttttatctataaaatgaagataacaacagcagttatcttaagagttgttttgaggcttaaataaatattatacatgcaaaggccttagaacaaaagctggaatattgataagagctccataattgttaacaggatatcaatgtcctgttccttatctcctatgtcaaagcctcaaactgatcatttagatttcttcctctttccacaattctgtcagaggtgttaccctaagaatatctagtacatagtaagcacttatcagatatttgctgaatgaaggaaaaaaccctcatctggaagaaaaaaaaatgagatatttaatcaacggtcttcaaaataaggtgaaaaaagattgtaaagattcaatgacaaagttttattaaataccaatactggctaggcacaattagacacattattatctcatttgctgtatctggtatcaaacaacaaagcctgaaagattaccatagattttgatggcctcattaacataattaatccgtagtgacattccctggataataaatacagttttatgtccgtgtgtcttctgtgtcttccaagttgctacagggctctatttgatctgagaaactgactgctgtttacatccaggtatgcaatgtgacattagaattgaagcagaaaggaagcaaaacaaaacagggttcatgaggaaaataatcttctaagaactaacatggcctggaggtaaaatgcaaatatatccggtaataagaagcccagattactgcagataaaagattaaaataggattcaattattcatctccatttgcaaatctacaaactaggaggaaggactaacccttttcctgggattagtaactaaatttaatgattacagcaaatataaagttcttttgtaaattattgttggttaaggattgacttgcattgacaacacactttagctctcgcccctttcattctccccctgcaagaacaaaggcaaaatgaacagtgaggaaaacctggaaacaggaccgagtgtttgctatcacttgattcctttgaaggagcaatgctttctcataatataggttttatagtatcatcaagtacatcagttaagcaaatcaagtgctttgtgttctgtatataaattacataatacaagagtctgtggcagttaagaatctggttctgcactttgggaggccgagatgggtggatcacgaggtcaggaattcaagaccagcctggccaagatgctgaaaccccgtgtctactaaaaatacaaaaattagccaggcgttgtggcacacacctgtaatcccaactactggggaggctgaggcaggagaatcgcttgaacccgggcggcagagattgcagtgagctgagatcgtgccactgcactccagcctaggcgacagagcaagactccgtctcaaaaaaaaaaaaaaaaaaaaaaaaaagaaaagaaaagaatctggttctgatcagaatccttaaaatactgtcttcttttttatcacaattgcccttttggatgtgagtgctggtctcaaaaagatttgcagttaaaagaggaacagcaaaaaagacttacaccaaaatagcaaccaactctaaaactattacaggtgagaggtagacagcttcataactcaatcttctactaccaggtgatgttaaaaaaatactttaacatcaaaatcacctacaaatattcctccactttcatatgctgagcaatttcagcttagagtgactaagtgttatttatctctctatcttcggcacctagcacatagtaggcagtcattagttatttgctgaatgaaggaaaaaaaccttcatctgaccaacgataaatttcactaaaattgactataataaaatctgtatgggctccacatgaaaactacatgaacttcacttccccacatacctgacagcctatacacttccttatgtttcatttctttaaatatactttaaaaattgcttatttacacaataaaaacaatgtccaccataaaaaaaaaagtctctagaactattggaattagtctcagaataactcatctgattggatttgatatgagatcattctcagattgttctgtggaatctcccaattccaataatgatgcttgcaatatcctttagctgtctatcagttctggtctttattcaggcccaaagagagaagaaagaagtagactaagataaaatgggtagtctgtgtattcatgtagtgaatatattcaagacataaatatgagacagaaaggtcacttctgcaacaaactaagtctgatcagagttaagttagcttccctctctgagcctttatttttctcatctctaagacagattcatcctagaagctctctggtcctttttagcttcaatgttctatgattggttctcatttaattgatgcaccaactgaaacactcactaatcatacattttgctggaggttgatcaatccttagcaaatcaggaagaaatgaatgttccacttacttcgtgcagaagctcaggaagctgggctctaaaggcccaagtttttgttgttgttgttgttgttgttgttttgcctgaagcaatgtatgtaatttaataatttaaatagtgtttaattaaatagtgtcttgtttaaatgctatataacattttcaactgcggctgcacaccagaatcactcaatgaactttattttactgctgcttgagtcccaccctcagaggttccttttaattgatctgtgtgcagcctgggcatggggacgtttataagctctccagatgattctaacctgagcaaagggaatgatgactggcatagagcaatgagtctcaaactttagcatgaatcagtcacctggaaggattacaaaaacacagattgtgagatgccacgctcagagtttttgattcactaggtctggaacttcttttttctcttctgggaacttgctttttgttttttgtttgtttgtttttttgtttttgagacaaggtctcactccgttgctcaggctagaatgaagtggagcaatcacggctcactgcacctcagtctcctgggctcaagcaatcctcccgtgtagctgggcctacaggaatgcaccactaatttgtttgacttttagtaaagacagggtttcaccacattgtgcaggctggtctcaaaactcctgagctcaagtgacccacctgcctaggcctcctagagtgctgggattacaggcatgagccaccatgcccagcctatgaacttgcttttctaacaagttccccagtaacgctgatgcttttgtcaggaccttgctttgagaaccacttccagtgagagaatatcattgatgctggcatctgaagtcctgagtttaaatcctgattctattattaccacctacataatcctagtcaagtaattttttctctcatttttagtctctttgtgacaatacttagatcccagagttatgagacatgaaataatgtaccaatcagagtttggtacagtccctggcatagaacacaataacaaatattaacttcctttttccattatacatggctagatggaacaattaagttaaatcgataacacataagttgaaacttcacaggaaaacaaagtacagctagttgaagcaaacaatatcttataattatacatgtaatacagaatgatagagaaatgttttaagtacttaaaaataccttcgttcaattttcaaaactttgaacgtaataatttaggtagtaggaacattagatgcaatctatagaagaaatattagactcaatctatgaagaacatgaatttttttacaacctataatggatcctgatacctcatctataattttagttttctatagaatcaataatataattagtgtacctgcttaaaactgtattacattgatcttcaatgctacttaatttctgagaaaacctaagttataagagtacatcagaatctctattatcaaccaaagcaaaacttctaccaacgacagaatggatactttttaaacaaatttacatataccaacaagcaaaaaactagagctttcattcctgcttgacatttttttcactttgtgtgtctcaaggctctctcaggaatcagtgtccaaaccatgaggtgaatcctgggaggtaagcaagcttgctgtagaagccgctgtacatgccttcaggaacagaaagggtaccagaggctgtgccctcctagtgtggctggttggagtgacaactagaatgttgtccgtgtttttctgtggaacctacaatgagtccagttgtctaagtgagtctcaaaggtattgaatagttgatgtcaaaaggcactttatgtcaggactgtttaaagcaagtttctccctataccagtagtgacccagaggcaaggtcttaccggacctcttattttcaaaagccttccctttccaattgagcctgatgccattatgtgacatctttttttccctgaatttctaaaagaaaatgtgatgattacctgcatatcttctttgttgctgcatcgtgttttgcatggtacccctttaatattgttttcaatacttagcctgctgatatacttttaacttctcacctgtttatgaattctcttaactaggctgtgaggcccttaagggtcttcaacttgtccctttcctccacgtaactttctcaaacgccccagttctcagtaacttttctcttttgctgtctgtaatataaacatgacccctacttacactgtcctacctatgtggccaataagagtgttgtcttcgcagttggaacccaaaagccctatgggatggaggatatgcactgtacttctttgtaaaagtgtcttgacaaagctgatgtccaatcaacatttaattaccagactgtccaagctagaaatgaaatacagttgattgcctgagtcctgataatcttgctaacaaaattataaaaggcctatagtatggccaatatatttggctaatggaaatgattttcttaaagccagaaaattcagctacccatagtgcttaaaaccagccttaaaagaacatgaacaggatggttcccaccttatcgagatcactggcattccatagtatccattcattcatatcctcctcctaggccgcatgaaacacctaccacatttccctacctcctaaagcaaacaaaactcttttcctccctcttgctgcaaaaaggtttattaaaagccgtatgtagtgtataaagcctttcaaaaatactagcaatccatgcctttctttttttgagatggagtcttgctctgtagcccaggctggagtgcagtggcgtgatcttggctcactgcaacctccgtctcccaggtcctggttcaaacagttctcctgcctcagcctcctgagtagctggaattacaggaacgcgccaccatgtccaggtaatttttgtattttcagtagacatggggtttcaccatgttggccaggctggtcttgaactcctgaccttgtgatctgcctgcctcggcctcccaaagtgctgagatgacaggtgtgagccgctgcacccggcctcattttaactaaatctgaagccagagttgatttgatgcccatcctgccagggaggcagttccttccctcaggtttgttagtagaaaccaaaaagtagcctgagagggttcaggtgccaccttggaggcactaccttatcttttgtccttttagagttttcttgctggggtgtttggctccagcactatagcccttaccacaatcattccacctggttcttcaataggactctgaggtatcaaaaaagtcactagggcagcccagagattggtacgatttacctttacacctcaaagttttttagatgtgagcagcgctggattatggcaatttaccttataataactcaccatagttggctgttataagaataaatattgttcttctaagatttttaattagttgcttcagttattacatttttttctattttttttttaaatagagatgaggttttgctatgttgcccaggctggtctcctggactcaagcaatctcccacttcaggctaccaaagtgctgggatttacaggcatgagccacctctcccagtctcagttattattttaataaatgagactgaacgtcctcttataaggctcactcccttgttcctactacatttgctctgtttaagtatctctttaaattcttcagttaagatcatcccttttatcagaaacctagacaccacaaagtagctttctcacctttaattctccatagggatcactattatactataatatttgcatacgtatgtgtatatatgtatttgcttttttaaaaaagtaaaaatgctcttctcactctttgtcgatataggcacccaggtacgtagttagaaattaaataaaggccacaataatttcccaaggaagatcattaaaaagaaaaatcctttcttcctctaatatcacatagctggcctttatggcatgccagctaagaaaaaaggtattgcctatggtgacaggaagactcaatctttctctctttgggttgtagctgaatttctatcaaaagtcctagtaaaatatataactcctcatttgttctaagccaagtcttttcttcagttttccttcaaacaatacctttactttcccattagaatatgaagaattggagactgtgaacagcaaggtttggggtgggtatcagtcacttcaaatctggctatgcagagagagggaaagacatggcagaatagcaggggtggagggtgagtgaaatgtatcttcattgggagtattgaaagagagcaagtttttcaaagttgttgccggtatctcatgaaagcccaggctgctaccatggtgagggcaaacactggcaccagcaccataaatatgggaataccacttgggtccccttcacctcgatgtcctataggtccattctgcacctgtaactggaagggaaagaaaaatgttaactctagtgactaatgtgtgtttgcaactgaaacgcccaggttgatacatcacctgggtttgtagactctagaccacccaaaactgtaacccccagcaatacctagcagaaggagtcctctctttgtcctgagctgatgcatcagtgtcacaggatctttggaaagaaaataggtctaatggggaggcatttaaccttgctgacctaaagggacccgtgagggcaagtcaggtaatttctgtttctgtactgcctctaccttgctatttgtgtatcgtatcaggaaaatgaagacatgagataaaacctatgatcttatagggaacttggatattacttggtgaggaagaagggggatctttctggaaatgtttacttagataatcagtcatcaaaatgtagtaagagcagatgtgggcaatgtcaacataggtgcaataccaacatacgtccaatgccattacttgaaaaatgctttccagatcccagaaggcacccaactccctccaaagatggggttttgcccttcatctgctcatttctaatactagagagagatgaaggtgaatctatatggaacagatgtaaaaaagcaaaaagaaattatatcctagtgcttataattttctattggctaagtgtttccttttgaggctggatggtcttcattttagtgatggttttcagggtagctcttcttaatatcaacttttagtggctaacttgcaataattatggcatcatcgtatttcagttaaactgcctcattacaactcataaaactgacacttcaatctgaaaggcaagactgcatgaaataccattataccctctattccacctctatgtttttcattcatttgctgatgagctgtcctgaaaggacatgctcaataagaaggcatggtttttagggctaggccaattgcctgaacataagggtcttttttattaggaattatttatggatgtttccttaaaagtgaacactggaaataacttctcacataccttccaaaagaattgtaatcatattgaagtgtgtccctatatttacttgtttttatctactgcacaaatgctcccatgctttagaaagagaagagccaaggcagaagcaactgatgaccaatattatctcttattaacctgttttctaatccattacacccagattctgcttgcaactggttgttttctcaggtatctttcacgttctgccttctctacttttttaggaactcctctaaatgttcttaagcttctaaatccttagccactgagtgaggaagagtgcacctatttaagaagtagcaaattgatttaatttaaaggcacatggaacctgttttgtgaatatgctcagaaattctcaatgctataggaggaattatatctacccaggcttccctttacatcatcatccaaattataaaacacttggaaataagaaacagatgcagggataggtgctgccttgactgaattctgaattccatttcctttttcctggagttctcctatgaacactaaagatttggttaagagggtcaccaagttgataaatgaagggttcatggcagtgacagggaaaagcatatagtgggtaccagaaaacccaccatctttgtagtgttttatccaatggttttataaataagttttcagcggtagacatatggttccttccctaccaaaaagtaaaattggctacgtttttttaccatctttttaattaattaatttatttattttccattggtccatgtcactcttaaaattttttatttatttttattattatttttttaagagatgaggtctctctatgttgcccaggctggtcttgaactcccgggctcaagcaatcataccaccttggcctcccaaagtgctaagagtacagatgtgagtcaccacacctggcttttctttaatcatctgttttaatttggttgtcaagctttatctttaaggcatattatcttgaagcaaggaccttggttataagccatactgttgtgaatttctcttttttttctctttttttcttttttttttttttgagacagggtctcactctcttgcccaggctggagtatagtggtatgatcttggctcactgcaacctctacctcctgggctcaagcaatcctcccaccttagcatcccaagtagctgagactacaggtgtgcaccaccgtgcctgaattttttgtatttttagtagagatgaggttttgctatgttggccaggctggtctcgaactcctggcctgaagtgatccgcccaccttggcctcccaaagtgttgggattacaggtgtgagccaccgtgcctggcctgaatgtccttcaatgataagcagaagtaccaatggacccctccctttgcctgagaaactcttcaggggagtgagggtaaaacaaaaagcaacactgaagattacacacattgggcttattcagaagtacagtgcaaaagcctggtgccaggtttctggctcaaagtgatacctaccctgtgctgcactctcagagacacagcatagcctgcattacgaaagaggtctacagcatcctggtgcagcaggttctttaggtcttggccatttacctgtcaaaacaccaaagagtagtaagaaaggaagaaggctattagaagtcaacaatttattttcaaatggccaaactttaaataacaaactccttcagagcaaattgcaaggactaggagtatgggcaaagttacttagagctcagaacttagaacttttttcattttcaaaactatgttttcctagaactgaagttccacaggccatctgaagagaacctatgtaaaataaaaagtggtctctccttcctcttagcttctatgcctgtctcgttttgacacttgggaatctgttaccgtattagcatttcttccatgagtgttaacctgcttccttaaagatagcatggtcttccaggttaccaccctaacctttatattcctaagccctggcattgccagctgcaactgtagaaatataactctatgaaactctccaccaatttattttgatgtcatataaatctatactagcccattctattgggcttttcatagtgaacaacttcctgtgattccacggatactcctatccattatatccaaattagtaaattagtcattttttaatcaaaacttagtaaaaaccatattcctgtgatgatataaatccttaaaaaaatttcagtgtaggtcactcctaccacttagaggtgagagatgtgaaggaatacttgtattaatactttttgcagttaggagtgacatcggccacaagtaataatctatctatcctatgctgtattcagtgacacagcacagcccacttagtgcaagattacatatcttttatacttgtcaatgtcatcgttaacagtagcagcaataagaacatctgatatatttcttttgataggttctgtactttacatacattatctcttttaattctcatgataaccctatgaggtagacattatttttatctcgtttccacagataaagaaacttgaagctcagtgagatttgtgctggagctagggctaggatttgtaaataatgaaagaaagatcaaagtgtccttgcatttcactgttccttctgcactgttattcttccatcttgactcaccaactatcctctgctcagctaatgctcaagtcactcccttactcaactctctcattttccttgtcgcaatcttccttctccaaggcactcataatcttccctctactctctctcttgccaatacagttggtgaatgaatctaccaacacttctgccctatagacagtctacctttgtaaaccaatagtttccaactccattccacttcagtcaccaattgacgtaaacttagacttcaatattagacatgcttcagctccaatatctcaaactcttaaaaacctgacaacaatttccactcttttcatactttctattcatctactgaatttcctccttgtaacctttttagactttacttgcatccttgcccatctaggagttcctgttgtaatttcaacaaagcacttggtaaatcattagaatcctttgtccccaagatcttctgccatctttccagtcctgggccatattctgcaatccttttcttgccatcattaagttgaatattctgggagaaaggtatattctcattctccaccatagacccatactagctgactccagctcatccttaaaaccgcttctactcatttgctgaactccttaataaacacgcagtgatagctgttccagacctttttccaccaccgtctccaaccccatttctacctctctccctagctgattcctttatcttttgtgagaacactgaggacttctgataaatgctttctacattttctttccttctccctcaaagtttctttatatcttctcactactcctttcccctagtctctgaattagatctatttccttttcaaggtgaaaccatccactgatgatcttgatcatacttcttctaacctccttacaaaactcacagacactctgtcttcttgattacttaactattatctttctctgctccttctctcaactaaaattatacacctctataaagaaaacaatacaactatttcttggaacgcattatcactctcctcccatcttctttcctctttctttgactgctaaatttgttctaagaactgtttgcatgcactacctctatttcttcagcattcattctctattcccctgtaatctcacaatgtatgaggtagaagggaagaacatgtttttctaaaggtcaccaataacttccaatcaccaaatcctatagccgtttttgtcttcagaccacctcctcccttttgtaattttctcctatcttggcatatgaacacttagcattctttgttcttaaattattcctttccggatttcctcttccctttctttctccttaaggtgagtcaaggtttttcagtatcaatcctctatcttctttctttctctcccactgtgagctttaacagtttcaaccataatctgtaagataactcccaaatttgtatccctacttgtacttctggatttgccagtttcttgctggatgcctacacctgtatactctgctagaccctaattcaacatatccaaaacctctttattacttcccacaaaaatcagaatacataccttgcttcttattgccactatcattccttcaaacttttttttttttttttttttttgagacagagtcttgctctgtccctcaggctgtcacagtggtgtgatcatggctgactggagacttgaactcctgggatcaagtgattctcctgcctcagcctccgaaagtgctgggattataggtgtgagacattgtgccccagcccaggctaaaattttaataatagttttaaactctctctgctgtcaactttcatatacaatagattgccaaactccacagtctaacactatgacatctctcatacagtattttctttcctattgcctattttaggctgttgacactaaaaacaaaacaaaaacttgggaccccaatccaccatgtcaagagaaaaaattaagctgcaagctgagtcatgcaataaactgcttttccttttgttcccaagcagatagctacagataacaggttaaatatctccacaggtaattactctatgttcaccttatcttatgtaaagtcccaacttactaagcaaaagaaaatacgtaattgactattcccttgcctgctcctttcctctggcaacatgtggattaccataccttccctctttgctcttcagcctactttaaatattaaagccctcaaaatcatctttggagaaaggaacatacctgtctcccaggcatgtccttaaccttggcaaaagaaacttcaatcaatttagaagactcttggtttaaaatactcttagttgaactactgtgatcacttctctctgatttacttttctctaggttggaaccgattcaaatactaggtctccagattaatcttcctaaagtacaattctgttactaccactttactgctcaaaaaacaaaaacaaaactggggagcaaggaaagagtacatacctcgtttcttatgctgatatggaaagtcttccaggaaatgactctaacctatcttctcaggttaatttctatttcctttcctatatcctatactctagctaagtcacataactcactgactgggacataaaacatattttttacctttatacctgtgctcaaactgtatctaccacctaaatgcccttcccttttaaaaaattctatttatcttccaagattgatctttaaaaaggatcagtcctgctacctacagtgtagaaatgaatacagttttctagtcgagggactttaatttcatgttatgccttggttttcttgttagatatgctgtaggaaaagaacttcaggatttctataactatcacaatgaattctcaatgactcaattttctagttaactcctgacagaataggtgtgagattgctgactgtcatgggaatgctcacttaagtaatctagcccatgtgatagctctatttctcattataaagaaataagtactttctttagaggcagacaagtaagttaatgatgcagtcatgtcaatgaatgccaaatgatgtcacagctcaatatcagagccaaggtttcatagtaatataaatgcaaatgagataactgggtcactatattaaatggtagaaatactgggcttaaaataatctttgccatagtagtcagtaataattgcagagaattattgaacataaccatgtctggagctgtctgttcatcttacatgtattaactcatttagtcttcacaatagttctgtaagttaggaacccctattttataagtgataaaactgaagtgtagaaaggctatcaatttatctgtgagcaaacagaatgaaagcagcaaagccaaggattcaaactcaagcaggctggcccaaaagccttcactttaaaacactaatctatatgaatttacatggcaagcaaggattttatttcagcaacatattactgcctatcacatatatgttgtaaattaaatttttattggttttgccatttagtttgtatttaatgttacacatttaaaaagtgttaagagttgaggccaggcatggtggctcacacctgcaatcccaacagtttgggaggccaaggagggcgaatcatgaggtcaggagttcgagaccaccctgaccaacatggtgaaaccccgtctctactaaaaatacaaaaataagctgggcgtggtggcgcacacctgtagtcccagctactcgggaggctgaggcagaagaatcacttgaacacaggaggcagaggttgcagtgagccaagattgtgccactgtactccagcctgggcaacagagcaagactctgtctcaaaaaaaaaaaaaagttagagttgaataaaaacaaggtatttatatattaatattactattcatttgtatatacagaagtagcattaaaattaaaaaagcaatttagttaggtgccacttcattgacaaggcctttctagataacgtcactagatatgactgatttacttctttgaatactctgtaactctgaatactatgcaactatatactttgaatactgtgtaactctcttaaagtccaaattgaactctgcctgacaccactttgcattctattgtaacttcaacatgtatctcagctgatcattataactctacaatacctaagagaactttgtacacttgagcataataaatagcacatgctttcctgaagtttggctgcagagtgcaccctgaaaaagccataaatacacaaagcctgactgacataatctcagtactacataaagctgcaaggcctggattctaatagtagctttacctgccaatgattcagtgtgtaatcctgcccctccatctgagtctccttctgctaacagggaagaaagacattggtacatcaggcaaaagaagatgttataaagggcataggccagttaagccaattatgcctttcaaccctcctagttaaggctaaaggtattctaatttaagagacgttattctaatgactactttaaaaccccaaataagagaccttttagaaatgcaaagataattctttcttaaagaaccctttcgcatcctttacccaaggtaaaccagcccctaaaacatgtcatgattacgactttctcccttgacaatatcatttctactccaaaattgaatttgctctccaatactgacatcctctaagcatttttagattccagctgctcagtgactaaccaccaagttctgtagatttcacccttaagtatctgtggaatccactctttttattaccatccttactaacatagaccagtggttctcaaagtgtggtcccaccaccagcagccttagcatcacctgggaacctgttaaaaatgcaaacgtttaggcctcatcctagctgcactttaacactccttcaaagtgattctcaagtctgagttagttcttacctaatctgcctgaaacagtcttttaactggtctccactcccagactacttcccctatttaatatacccctttctacatatcccttgcatctacagatttcattagtacttttccattcactggagtagtaatttttcaaatattgtgaaatcaatccagtgggtcaagaccagttgtttggccgggcgcggtggctcacgcctgtaatcccagcactttgggaggcaaaggcaggcggatcacgaggtcaggagatcgagaccatcctagctaacatggtgaaaccctgtctctactaaaaatacaaaaaattagctggacgtggtggcaggcgcctgtagtcccagctactcgggaggctgaggcaggagaatggagtgaacccgggaggcagagcttgcagtgagctgagattgcgccgatgcattccagtctaggtgacagagggagactctgtctcgaacaaaacaaaacaaaacaaaaaagttgtttattttttaaaaagtgaaattagaagaaaacaaaatatcaaaattcatcacatatagaaaagtattgttgtgttaaacttttgcttcaaatacacacacacactcatttgacgaataggaaatgtatgtcattcctgttataggttataatttaaaaggtctgaaaaacacttgcctacagcagtggttctcaaactttactgtgcacaggctcaccacgggatctcataatgcagagtttgattctgtaggtctgggaagggccctgagattctgcatttctaacaagctcccaggtgatggccagactgctggtccttgaacctcacttttagtaccagaagctactcggctgagtaatcccagaattaacttgctacttcagcttccttaactcatgacataataaggtttattgaacctaagatatggcagatttgcaatgtgctagaaaatttcgctgactctgaagtttcagagaatgagcatggtgttgttctagttaactgatgaggaaacatacttttttttactttaactctggttgttagcatgttaaaatgtgtttcctatttcctgccttatgaaatcagctgagttaaaattagttttctttgattaagaattttgaattgcctcaggatattctaaaacaagatctctgacttgtaaatgtagagacatagagaaagaatgggctcaatttaatacgcaatagatgtgagaatatactctggatattgtaattttttactaagatcctgcaatgaaccacattttttggtctcttttttcatcaatttttgaagaaaccataaaaatagattatttagatccaatccaaaaaagtcagtgtgttataatgcaggggttaattcacggaactaacttattagatgcttactcagggccaggtacaggactagatgctggagataaagagatgataaggcaaagatccttccctggaggtattttatttaaagaatgctgctgtatatttcaacatctctgcagctgattggatgagggtttctgctgggtctttctcactgatttctaaggtaagcgcagagaccagtgtttcatttcctttgtaactttcccatagcacttggcacagtgctctgaaggccattaagtacaatagttgataaatgttgatgactaaccaactctttcattcaccaaattaaaaactgtactcacacagaatatgaaatgaagctggctaatggctcaatctgtgccattttgttatataaggggtttgttccatgttaaaatggaacattcaactgtgtagtatgaccagctacgtcacccttagcttaataaaaatgtcatgttcactgaggaatgactattcttcacctcccttcatttaggcagacacacaaggaatgagaaacttagttcacttttctaaaaataaaaattaaattattccaggttccataatggtttattctaataataaaccattctcgccagcatacacacacaaaatgaaccatgggtgaggaatttccagccttcgtaatagccatttttatttcatggttgtcagatgcaacatggccttaaaaatcatttactgtcattatttaagaaaatttttctttcttaagtttaaatcatctacagtgatcataaaaaatgaaatttcacttttgatgagaaagaggaaactatttttttttttttttgagatggagtcttgctccattgcccaggctggagtgcagtggcgcgatctcggctcactgcaagctctgcctcccgggttcacgccatgaaactacatgataaaccatgcagttacttaattttagaacttgaaagcaagataatatgtgggaattacttggggagaatgaaaaggttaaattaatagctaataataactctaggaaatttacatgtcacataatgttacttaaatcagctatctaaaataggtatgtgctaaggaagagatacatttttagtttatctagcaaacattactagaggaaaaatggggcatattttataacatggagaaataacctatgcgtggagcataggaaaatacataaaaactaaatgagaatttagactaatacataatttagcatcatttttacagagacttcaaagccaataataaatgaatacttaagtacatttcatagttatggcctagaagttcacttaaggacagagagggaatacgatgtcacgggtaagtgatggaacaggctgtttcatagtatttcttaacgaatgggatctagaaagaagaattttgaagcaaactcttgtaattctcacatgtcatgggaaggacctggtgggaggtgactggatcatgggggccacttccctcatgctgttctggtgatagtgagtgagttctcattagatctggttgtttgataagtgtctggcacttccccctactctctctctcctgccaccttgtgaagaaggtacttgcttctccttcaccttaaaaacatgattttaagtttaaacttaaaacttaaaaccatgattttaagtttcctggggcctccccagccaagtggaactgtgagtcagttaaacctcttttctttataaattacccagtctcacgtagtatctttatagcagtgtgaaaacagattgatacagcccctgatatgtcttctatctctgcctctccttcccctggcttttcccctctcttctttggatgccttttccttaaatggccaaaacataaacatatcattccttgtaacatatctttgtaatatttaatatctttttacatctttatatttcttatattttggtaaagtaaaatcttctttgctataaatttagacatctacttttctcttcattgacatttatctcccatcatttatcagcagctccagcccttttttaaaacttgagaggcctttcaataatttattttctctgtgaggaaatggtccacataaggttctcaacttgtatctaataatcttctttacattgaggtttatttccttatttctgattctaccctttatagaaagacgaatttcagtttttatcttattttatttttattttattttattttattttgagatagagtctcactccgtcgcccaggctggagtgcgctggcatgatctcagctcactgcaacctctgcctcccaggttcaagcgattctcgtgcctcagccccctgagtagctgggggactacaggcgcgtgcaccaaggcgcgtgccaccatgcccacctaattttttgtattttttttttttagtagagacggggttttgccatgttggccaggcaggtcttgaactcctgccctgaagtgatccaccctcatcagcctcccaaagtgctgggattacaggcatgagccactgtacctgggctaattttagtttttatataaaaccatacatgcaatctactattaattcaccatgtaactttgtctttaggataactaatcctagctcctcatttaccttttaggaggcagtataacagtataacatagtggtttaaaaaaaggctacaaattcagacaaaccagtttgagtcccttgctgcttactaattgtgtgaccttgggcaaatggcttgggcacaataatcatgcccacctcataggattactataatattaaacaaaataaatttcaagttcttagcatgttacctgacatttagtgctcaaatacttctcaccattctcattttgcaataatctacgtttaaccaaagcttttaaaataatacagctctcttctttctcttcttaactcctatactattcttcatccacagagcccaggttccagtgttctgaggataatgtaatttatgtgtcaaaatattaagctgcatagattctaactaaatgctacacctttattttaacaacccactctcagcattccttacagtaccactgccaagttgattcatattggatgaatgtctttccttgggagctaaaggaaataatctgcttctaaacttttcactatccttttgagaagacaggtatattatcactgtctccatctcactgattaataaacagggtctaggagaagcttaatggactgaagagaggcagaatagtcaatgagaaggactgaaatactgcagtgcttgatactatatttatattatggatcagcgaggacacatgcttagacattcttgagctaatttaggtggctctaatagctacttgttctgattttctttctttttgggggactaagtggagtcacagtcttcctgaagaggcattcagaaccatactgctgagcctgatcactcaaatactcagatgccaaatgaagaaaaggtggatgttctctctctcttttcctttgtatctctgccttcaggttctgctaccaaatgggcttcatggcagagaggtgttcaataagctgacaactaagaagagcaagagatttcacacatatgacctttaatcactaatcacctgaactgcatgagaagtaatgtgaaagggaaaattcaaatgaaactatatagcaaaaaatttttaagggatgaagctaactcattatagaggtaggttcaaaatcatgtatctgagaccaatacttaattctgccaatcaagacttctcctgtctgtacttcattcatttatttcaacgttttcccaacgtggccatcttgccctattcagttctaaaagaaaacagggaatagttttctcctcttcggaccatgggcttatggcccatctggagaggatagggctccgaagccctatcctatttcaatttccttttatttaagtctagccctttgaagccagctctcccaagaatattctagataatatctcaccccctcagcatttttccattctttataccaatcatctgcactgtttccatacaagtaataagctggccatttttcactagtcctgaagattaataaaaaaagaaattctacagaataattatctccaactatactcccttatcccccagcaaactgatagtatcataggattactgtggcccatggtaaggtagagaaatgaacaatagggccagagttatattttgcattttaatagttttgactgtatgcttgttctaatttattttaagacctgaggtctgtgggcccatatttatcagtcaacctttttaggtttgcctgaatttcttaacttgttcatttcttaaacattattaagcactgtgctatgattcaaaaggttaaaaaaagatcttaggccgggcccggtggctcacgcctgtaatcccagcactttgggaggctgaggtgggcgaatcatgaggtcaggagttcgagaccagcctagccaacatggtgaaaccctgtctatactaaaaatataaaaaattagctgggcgtagtggcaggggcctgtagtcccaactactcaggaggctgaggcaggagaatcgcttgaacccgggaggcagaggttgcggtgagccaagattacgaccctgcactccagcctgggtgacagagcaagaatctatctcaaaaaaaaaaaaaaaaggatcttttcactgcccttgaggaaatattctggaaaatagtaagattaataattaccatgtagtatgtcttcgtagagacattagcaggatgaaatgggaacacagcggacaggtacccaaatcaactgcattccaaattttcatgttaataatgggtgaaaaagggctctgagtctgaaaaggacacttaactccaaccttccttctttctgttttgtgatgttaaatccaattataagggctgacattcccccaaaggaagatacacattagtgttttaatcaacaaaaggaggtgataaagtaatggatgaaagacaaaatttgtggattttaaatctcttttccccatatgagtccctcgctgcttcctgccttgtgctttttgaacaagtaacttcacattctgggcttcacattctcatctatcaggtgagcataatgttgccctccatgctcaatgatagggttggaaagaatgactgatcaaagttgttcccattcaactctacaacctgtatatttccagatccaaatcttttcaaggaaaagggatagggaggggtaggacctagggcttagggagcaaaggacagtgaaggaggccgaagcccattctcaccgaaaggatcttatcaccctcctggagccgcccatccagggccgcagccccattttctttgatgcggctgacgtagatgccactgtcgttggagacatactgctgatctgtcccaccgacgatgttgaagcccagccctgagaaaatcatggaggagtaaaaagatgggggtgaagaagaaagaaagagattagagaagatgaagagaaagggagggaaagcctactggggaggaaaggctgatggagaggagatgctggcgagtcagcctgtgatggagctggtgaatggtcatgaacaaggtcagccatatcaagagtattgagttgctcactcaaatgaggcacgactgaaaatataaacacagtgatccacctgttttgttcaatatataaagaaagatctatatagaacttaaagaataatggtgattactctaagttcgttcttctttttctttttttttttttttcagagtcttgctagtgggcatagtggtgggcgcctgtaatcccagctactcaggagttcatagctcagttgcccaggctggttatgagctcctggcctcaagcaatcactattgccttggcctcccaaagttctaggattacaggtgtgagccaccatgcccagcctagatgtaagttcttctactcacatttagttttgatcctgttgatggtattcaaaggacccaattcctgacattcctgatattactacagcagggttagctgtgttcatcaaaagaagctatgcatttttaccaattatcaaatgaactgttcctaatttagtgtgagagatttctaaccataccttcccttccacactttccttctcccaagcttctggagaatttatgtatgatagtgctttagaaaaatctcttgagagtttctttttttttttttttttttccattttggtggtggaggcagtggtgtaggtattggcagagaaacctcagaaccagaaaggtaactgctatttcatggtaggactaaatcaccaaatttactctcccttccttcgctacttcaagtacaaccatatataggttgagtatcccttatccaaaatgcttaggaccaaatgtgttttgaattttgaatttgggggattttggaatatttgaattaaacttaccagttgaatatccctaatccaaaaatctgaaatctgcaatgcttcaatgagcatttcctttgaacgtcatgttggcccttaaaaaattttggagttggaagcatttcaaatttcagatttttggatttgggctactcaatctatacttgggcatagtaattgacaacttttattcactgtagaaaaaactgactactcgttgattagcaactccccagttcctcttccctaagtccttggaaaccaccattctaatatttgtttttatgagtttaactattttaaatgcatataattttagttatgcaagatgaattaagttctagagatctgctgtacaacattgtgcctacagataatactatatcatacactgaaaaatctgttcggagtagatctcacgttaagtgttcctaccacagtaaaacaaaatattaaaagaaagaaaaaagagaaggaaagaaaactgagtaccaaagtgctatttctatggaccaatgactaagtgctggaaaggattttactgtacagaaaccgttgttaggaaaggattttacctatgcataaaaaaataaaaaggaaaaaggaacttctctagggctttcttaatgtcagctactggtagaattcaggggcacagtgtaagacaaaggagatagtttggaaacaaaccaaaaatctagcggtgcaattggaaggaataaccataatcaccagcctacactgttctcaatagaaaagatacttaaagagacatatgcggggggccgggcgcggtggctcacgactgtaatcccagcactttgggaggccaaggcaggtggatcacaaggtcaggagatcgagaccatcttggctaacacagtgaaaccctgtctctactaaaaatacaaaaaatcacctgggcatggtggcaggcacctgtagtcccagctactcgggaggctgaggcaggagaatggcgtgaacccgggaggtggagtttgcagtgagctgagattgcatcactgcactccagcctgggcgacagagcaagactccatctcaaaaaaaaaaataaaaaagagacatatgcgggctttctgaaagttctccccattggtgggagaaaagcttacacctgaagctcacagtattaacataagcactagcaaatcaatttgtaatttaaagaaaaacatgaccaaacaaagacacaacaggaaacatttaagttaaaaagcataccttagccaggcatggtggctcacgcctataatcccagcactttgggaggccaaggtgggtggatcacttgagctcaggagttcgagaccagcctgggcaacgtggtgaaaccccgtctctaccaaaaatacaaaaaattagacacgcgtggtggcacatgaccaacattgggaggctgaggtaggaggatcatttgaccctgggaggcagaggttgcagtgagccaagattgtgtcactgcactccagccagggtgacagagtgagacccccatctcaaaaataaaataaaatacataaaaagcataccttgtgcataaaatctctgcagctagataatagaaagaatttattctctaaaataatatacataatagaaagtgctacttctggagtttgtgacctggctgggcaacatagcaagaccctattctctaaaaaaataaataagaaggtgctacttctggaagatgctattttaacttccttgaagggctgggtattaaaaatagtagcttaacttactaaatgattttcttagagcaccctcaatttgtatcatagaaggtaggaagtattggagaaggtacagaaatgtaagataaggtggaaaagcagatggaacaagattatcgaaggttttgaaatgacttcaaaactgtgacagctttgaacaagggggccaaggccaacccacctctcccaagctggaacaaactatgtagaaaaatcttttgatgaaatccaacaccctcatcaaatgctacagttgcctctggtgatcttgggaacaggaagcaaatgttaagcagctgaatgcaatgtagtagttagcaacagaaaggactttgctactggttattcaaagctaactgtagaaaaaaaaggaagagtagaagaaattttaccgagatttaccataaacaaaaaagagccgtctactacacaccccatcgaagtcatattatataggtacatttataacccgttgctacttctgttgtaaatgaaccaaactatttaacatgagaactcctggactgacctgaagccctttgttcagccagaatatttacagaactgggtgtatctataagccaaagcattgctgcaataaaagagtcaccacagcattaagtagtggcatgaccaactgaacctgggctgtacggatacctacataatccccagttcacttgctcagtaaaaattactgattgaatcttatgtgtaagatgttgtgttatcatctgaggaagacataaagttaaactgcacactccctgctttgatcacaaactggagtttttcctttttcctgtccctttaagatattgcagaagcaaatcaacatttactatgtgttaggcattacgttatgctctgaggaagatataaagctaacctggacagttcctattttaaccacaaacccaaatttatccttttccctgtcccttttagatattgtagaagcaaatcaaagtcagaagacttggttctaagtttataacttaccagatatgtggactgaagcaagtcagtttacctctgatcctcagcttccttttctacaaaaataagaattataaattctgccctgtctacatcaatgggtaagtgttaggggccaataacataaaatacgaaaaaaaatcttcataaactacatagtagttgctctattgggataaggcgctaggagtagttgtcaataaactaatggctgctaaagctccaaactagatagtttgacagagaaagaatgaataaatatacagtagaaatgcaaaatctcctaaaaaatgggaagacagattttaaaattccacccatctataaacaggaactcaaacttattaagtacgtctatggcatgtgacctagaaatcccccttaagagtagtttctagcaagtgtgatatctaaactctgcggcaatcatccagcatatggaccaaccaattgaaacagatgtcagttggaaaccaccagaaagggaaaggctattcaatacgtatcttgctaatcattggctatggcccagaaaaatcttgcataagtagggtgaccacatatcccaaaagcaattgccacaaaagccaaaattgacaaatgggatcaattaaagagcttttgctcagcaaaagaaactatcatcagagtggacaggtaacctacaaaatgggagaaaatttttgcaatctatccatctgacaaagggctaatatccagaatctacaaggaacttaaacaaatttacaaggaaaaaacaaacaaccccatcaaaaagtgggcaaaggatatgaacagacacttctcaaaagaagacatttatacggccaacaacatataaagaaaagctcatcatcactgctcattagagaaatgcaaatcaaaagagatgccatctcatgccaattggaatggcgatcattaaaaagtctggaaacaacagatgctggcgaggatgtggagaaatggggatgcttttacactgttggtgggagtgtaaattagttcaaccattatggaagacagtgtggagattcctcaaggatctagaagcagaaataccatttgacccagcaatcccattactgggtatatacccaaaggattataaatcattctactataaacacacaggcacacatatgtttactgcagcactgtttacaatagcaaagacttggaaccaacccaaatgcccatcaacaatagactggataaagaaaattggcacatatatatcatggaatactatgcagccataaaaaagaatgagttcatgtcctttgcagggatatggatgaagctggaaaccatcatcctcagcaaactaacacagaaacagaaaaccaaacactgcatgttctcactcacataagtgggagccgaacaatgagaacacatggacacagggaggggaacatcatacaccagggcctgtcagggggtggggggtaaggggagggagagcattaggacaaatacctaatgcatgcggagcttaaaacctagataacgggttgatagtgcaggaaaccaccatggcacatgtatacctatgtaacaaacctgcacgttcagcacatgtatctcagaacttaaaattaaaaaaaaaaaaaaagatttgaaaccaaaggaaaaaaaaaagatccttaataatatattcttagtttttcattaactcacaggaaaagtctgaccacccatgagacagaaacctattacagctatttacaaggtaaccaggcttgtaaaaatataaaaatgtaaaaaaaaagaaacatggagttttaaaatgtaatgttcatattcataacacaacacctccctataaataaaaacatacacacaaatattaactatttacaaaaatgcatgcatatttaaagaaatataaagacacattagagtgggtacttatggggagaaagatacaggatagagtttaggtatgaagggtgaaaaaagaacctgagaggaacatactgatgataacagtgtactttggagctaaagggtataattaattcagctcttagcatttaaggtccaaaaggagttgaggggagaggcaggaagaaaaaagactgggattcaacttttttttttttttttttagtgaatgaatgaagagcttagtgagctctggttataatgtgccaacaaattttaaaatatggcaagattaaaatgggttgctgggtgtctattttgcagtctaaatgcaaaatagtaaaggtagcataagaatgacaccactataggattaagagagaaagaaagtgtgcctaatagaagaaccttggaaagttaaacaagaaatcccttcttttgaactcctgactataggtctggaccctaagcctgtttaaaagagcaatggcagaagcaacagctaatgtttaccaagaccttattatgtaccaaataatatgctatgtactttatatatattatctcatttaatcttcttgacaaacacaagtactcatttttcaaagagtttaaaaggtgaggcatggacaggttaagcaactttacaaaaatgtcacacagctctttgcaaagccaagacttaagtcaggctgtgtgattccaaagcatgaatttttaaccattttgctacaatacatctttgcagaaaatataaactgctttaagaaaaaaagtcttctaagcattgctggctatcttaggagctaactggtctccaggctggctctgaacaagcaatgctgggataatggttgtagaacaatctccaagggtaatatattctagaggaagaattcaccactatagagttttgtaactgttgtcaaggttcctattatttaccttcagaccagaaaaggaaaagcccttcatttcattcagattcttatctacaaaatctaaaagttataaagtaaatgaccagtgttaacctgttattctagaaataacaattctggacataattaaaatgaaacaaaatagttcattaacaccaaggattatagccacttgttgagttatgaagactagagtaacaaacaccctattttcccttttctttcccaagatcaatccgactaattttctcccagacatcaatcaaactccattggatacacaacccccctgtctgtcttttatgaagactagagtaacaaacaccctattttcccttttctttcccaagatcaatccgactaattttctcccagacatcaatcaaactccattggatacacaacccccctgtctgtctttatctatatcatggtaaaataaacttaacataaaatttaacattttacccatttttaaatgtataattcagtggcattaagtaccttcacaatgtcgtataatcatcaccaccacctatatctggaactttttattcaaataaaaactctatacccactaaaaaatagctccttattctcccctcccccaaactctgacaccatctattatactttctgtctatattaatttgtgtattctaggtaccccatataagtagaatcacacaatatttgttattctgtgtcttgtttatattgcttagcataatgtcttcaaggttcattcacattgcagcacatttcagaatttcattcttttttttaaggctgaattataatcttttgtatgtacataccacattttatttacctattcatctggcagaggatatctgtgttgtttccacatttggcggctgtgaacactggtgtacaaatatctgttttgagttccttcctgcaattcttttttttattttttgagatggagtcttgctctgtcgcccaggctgaccagcagtggcgcgatctccgctcactgaaagctccgcctcccaggttcactcattctcctgcctcagcctcctgagtaactgggattacaagcgcctgccaccacgcctggctaatttttggtatttttagtagagacagggtttcaccatgttagccaggatggtctccatctcctgacctcatgatctgcccgcctcagcctcccaaagtgctgggattacaggcatgacccaccgcgcccggtcccttcttgcaattcttttgggtatatacctaggagtggaattgcagaatcacatggtaattatatatttaataatttgaggaggtgataaacttttccacagtggctgcaccattttacatcctcacaaacaatgcacagctaccccaatgatatgtgtgtatgtatgtatgtatgtgtgtatatgtatgtatatatatgtatatttatatatatatgtatgtgtatatatatatgtatgtatgtaaaatagtcatcctaatgggtgtgaagtggtaacaaattgtggttttgatttgcatttccctaacagctagtgatgttaaatatttttttcatgtgcttattggccattggccatttgtattaccttctttggagaaatgtctactcaggtcctttgctcatttttgaattgggttgttttctgtcactaagctgtaaaagttctttatatatgctggatattaacttcttagcaaataaataattggcaaatactatctcccattctgtgggctatctttaactctcctcatagtgtcctttgaaacacaaaattttttacttttaatgaagcccggtttatcttttgttttgttgcctgtgcttttggtatcacatccaagaaatcatagccaaatcgaaggtattgaagctttttccattcttctaagagttttatggttttagctcttacatttaggtatttaataaatttctagttaatttttgtacataatgttaaggcaaaaatccaactttcacatacttctgcatgtgaatatacagttttccaaacaccgtatgttaaaaatgtgtactctgctgttatttgatgatgtgttctatatatatatatacgcctgttaggtctaatttgtttatagtgttgttcaaatcctctctttccttattgattttctgttggttgtcctatccattactgaaaatgaggatactgaggtctaactattattataaaatggtctacttctccagatcaatttttcaacatttgcttgatacattttggcactctgttgttttgttatgggaactttggggtgtcacttttctggcaggagacctctgtgtggctgctgcagcagggtgggcagctccaggtgctggctctctgcaaggctacagctggaccaggcgtagcgcgagcagcttctacagctggcactggggaacacgatggcatctggaagcttggagatgccaggaaccgtagggtcccaaggagaaagtcacagccctggctcagggagctcccaggtctcagatacatgaagggttgcagctcttctctctttctcttcacccacaatgtggcaagcaaggggcatgtctcagccctgactgtgttacagctctcttagcctcaccattcgatggatcctgagttcttgtccagcaaccaggaagaatgagatacacagacaagtggagtgtcagcaagtcaaagaggagctttactgagtgacagaacagctcagaggggacctgcagggggcagctcctttcagcatccagggtgtgctgatgagtgttcggctcctagcagagacagtagctcttctctgctagggaggtcatcccaatgagtgttcaactctcagcagagagggtagctcctctctgtaggcaggtcatctcaacaagtactcagttctcagcagagagggtagctcctctctggagctggtcatcccatcttctctgctgtggctgaacctggggcatttatgggcctcagagcagaagtgtatgccgactggtccatgggcagccacagacagcccagaaaaggcaccacatgtacccattccagtctgtgggactagcagcccagccctcagccttcaggcccaccttggcctgaaggtggggcctcaccagggaccaacccccttccacccaggagactgtctgcctcctgccaccatccatggcgaccagcctgtttgtgccaaggggcacctgcaggccagtgctgagctgccctcagcacccccaggattcccctcatgcttgttggtgcccaaagtccagagagggctgaggcagcaaggggctggtgtgtcagcactgccctaagtgtgtacacactgggccgggctttgacagcactcagattggcccaaaccctgcactgagatcagagcaggcactgggagcagggagaggccaggcagcaggaaaagacacccctgagcctgtgggtgcagggggaaccttcctgggcccctgagggtgaagagtgcagaaatgcctaggtctttgcacctgggagggcagagctctcatctgctccatgaagtgtgcagccagcactagctgtgcctcctcacagcctggggtgggggctccaggtcctcattgggccggggcaaatattcagagcaggagtgacatcaccacaagctccctgctgtcgccctggcgctgaggggtggcctgggactcactgtcgcttggctcacagccctgcctatagggggcctctaggagcagatagggggcctccaggagcagatagtgggccccagtcctggccatcacaagtgtcaggctcggaagtcacccagatgcagggtggaccccggggatgcggccccgcggaggctgctcccaaggtgcaagaacccactgcagtgcccgtggtgggtgggtgtggtgggtgctccgctggccaggtccccaaagcaggcgccgctcccacttcccaccctggggccccaacgtgcggccccagctctgcacccctggcccagcccccatgctctgtgtagaagcgtggcactgccccaggcccaccctggcctcacggcccctctctgctcgaccacactgctcacctgctggcgcccatctcggcctcgccccatagcgcagcccccagggcagcaggctccagtggggttcctgcttgtccctggctcccactggctccatggagcaaggcactgcccggggcccagccctgcctcctccccacactctccctgcagtggcagcaggcaagagaggcaatgcagggccagggtctggagcaacagaggctccggacctggggatgggtcctgcctggccatgtgagggtgggggacacacagttggctgcctcagggacgcaaggcataggggacccaccactgccattgctgctcccgcagccactcctgctgtcactgcccacgcctccccgctgcagccagtgtgatggcactgccatgaattccccctctgaagaggaacatctaactgctgttaagatagggacgatgactgctcttaactgcttcatgctgacagagggtgttaatttgtggaaaacaggagattttctctcaggatcctatctaagggtcagcttcatgctgattggtgttgttttggggaaaacagcagatttcctctcagggtcctacctaagggtccccagtaaaagggagccatcatccgaggctccatttccatgaccatttggagtttgacagcccaccccttttatttcttttgagctgcagtcagagatcactggttggttcacccctacaattgtcaaaagctgcaaaaaagagaaaagtttccttgactctgaaatacaaaacaaatgagcagcaatgttccaagcaaaaagtcaaaaaggattatttcagtcttccattagttcagatcactcagtcaactcctgttcacaatctccaaagttatcagaaacctgtactcaaggactataatccatcttttgaagaggatcaaaacaagacaacaattgtctgtgaatgccaaaatatcctaaggtcgtttcattcaaaaacacaaatgactaagaaatttggtaacctctgtggattacaataacccaatacgataaccctaattatgattgacagcatatactcagacatttggatttttgaagtcccatacaattttggaacatacacaagtattattcaccaaaatataacctgaagaagactaaaccctatctttatcttgacaatccctttacaaatttttgttaaagagtagaacagtgcctttagaaacccttgtggttttattcccaagttcactttataaaaaaaaacaaacaatacccttttgaatttagtattcccacacagaattttgtttttaagattaacctttacaaatcttccacaacttgtttaaacatttagctttatcttacctaatttaaaacaatcatttaaccccctaaactaggcaaaaatgtatattcccatgccttcttatacttttactaaagacacgttttacattctttacacaccttgcatgtaaatctatcctcagtagtctcaattacatgttataatggtaactgttagcaattcttaattttgatgaaaaatctggtaagttattttaattatttacttagatgctgataaggtctatttctaacatagctaggggtgtggcatatgttccccagccttaccaaactgtaaagcaggcaagttgaagaattttcaaaagccaaagaagcagtttatgacttttgaaaagtccgtaaattatgaaaaattaagcttcaaaattcgagtgctctttttagaaacaccagcatgacttatatataacacttatgggacatcctcttgtaaatatctaggaaagtggactcacttaacttgggatgctgataagcagcaacagccaaaacagggatcctctgaaatgtataaaataattcatttgcaagcacaagagggaaaaaaaaagctggttttagaaccgtacaaactgaatgagagacctactttataattgtcttggttaaaatctgataataagagatttgaaaagattattttttagagttctctggtcagaagtcagcttacttagggctgggcatggcagctcacacacctgtaatcctagcactttgggaggccaaggagagaggatcacttcaggccaggagtttgagaccagcctgggcaatgtatttttttttaataaaagaaaaaaagcttaattaaaagtaatatttaggctatcttttgtgggggggaaaggactttctgcttttttcctctcttggatcctggttcttggctttttttttttttttcagtcaattgagacccctttttaaatatgtttgataccttgagtcttctgtttgtttccaatcttgctggcataatttttgctgagaaaaatataaaacttcactggccttttacaaaatttaaaatctccaggctcttgctctgttgcccaggctggagtgcagtggcacagctcactgcagcctcaatcgcccaggctcaagtgattctcccacctcagcctcccaaatagctcggactacaggagcacaccaccacacccagctaatgtttttcttttctttttttatgtagagacagggtcttgctattttgcccaggctggtctcaaactcctagctcaagtgaacctaccacctccgcctcccaaacagttaggcttacaagcatgagccactgttcctggctaaacttgttctatttctttccactctgctcttccttccttttgttattttgataccacaggaagaaatctaaaggagacttctaacgactcagacccctcaaggaacgctgaaaaaacacaccattcactccctttttggggtattctgtcttcttgtggagtctgaaaagtcatggacaggttcctctcaggtctaaaactctgctctcttccatactgcattacttgttggcttttgagagtaccagagattactttgtactgtgaaagagacctttgtgtatgttatggctggtaagtcactgacaagagctacagtattggaggtgactaacagcagttgtttatggtgaatggttattactataggcagctactcattttattttattttttaaacatttaggtaagaaaggtgtggcttaatgtctttgtagtgaggtgcgctgtggaggtttgtgtggcctggtatcatggcattttgctctttgtggagacccaagattcacgtaaaagtggtttccttgatttttaaagatccagatgcactgccctgcaaatctgcctggtttttagacacttaatatcaggccctgaggcagtcctcactgggacaacaggtggtgcacctgtagtcccagggaggctgaagtgggaggatcacttgggtccaggagctcaagaccagcctgggtaacataatgaaagcctgctttaaaaaaaaaaaaagaaagaaatttttaaaatatatatctattaggccctggaaactgcaaatactttcctggtcccattcatgaaagggctccactttgaagtcagtaatctaatcaagaaacgaactaagtatctaacaagattatagtctccaaaatacaactttctagcacttagctggctactttgaaactctatgtaaaataaatttacttctataaaggaaatctccatttgtaaggacatgcccctatacccaagcagctagaaatttttacaatgggaaagacactggcttaaagttgacataacaaaccttacctatgtttaaagatacttttcctggcaatcttatcttgactgattctttttgtttcagcaaataatggtatatagatataagttctatgcctctaggggtatcaattttcacctaagagtaatgtttgcaatttagggttacctagctaaacaactgtttagggcaatggaataagtaatcaaggaactggtagtctaaacagggagagattatctgcaaactggcaaatgaagaatcttataaagctataagatctgtttctgtcactgtgtctgtatgtctctatgtttatgtgtcatgtgtatgtgatacttcactaccaaaatacatgaaaacattctaatgaatttgtcagaggcgtttaaaccagagcaactccatcttgaataggagctaggtaaaataaggttgctgggctgcattcccagtaagttaagggattcttagtcatggcgtgaaaaagaagtttggcacgagatacaggtcatgaaaaacttgctgataaaacaggctgctgtaaagaagctggccaaaagccaccaagatggtgatgagagtgacctctggtggtcctcactgctacactcccaccagcgccaagacagtttacaaatgccatggcaatgtcaggaaattaccctatatggtctaaaaaggggaggcataaataatccaccccttgtttagcatataatcaacaaatagccataaaaatgggcaaccagcagctctcagggctgctctgcctatggattagacattcttttatttgtttactttcttaataaacttgttttcactttatggactgcctcaaattctttcttgcgtgagatccaagaaccctctcttcgggtctggatcaggacccctttccagtaacaaaatggctttaaaggtaagcacttaaatcaagtattttatcagaaatatagaaagtaactcaaatgccttttagttcacattacaaaaataagactactttgttggtttaatgaaaatggctgtttcttctgatcagcaaaatatgcatgtatgtaacgtcagggtttctttcacaagctgtggaaactattaacaaagaaataacttgaggccaggcatggtagctaacatccataaggccaggagctcaagaccagcctaagcaactggcaagatcctgtctctacaaaaatgaaaaattaaaaaaaaaaattagcagggcatggtggtgcactactgtaggcctggagtgagccataatagcaccactctactccagcctaggtgaccgggcaagaccctgtcttaaagacaaacacaaaaaaataagtaacttgggatgacggccagctttgtttaatgatctatacaagtctaacttttaaaaatgaataaattaaatgaatataaatggtataaaagtgtataagcaagtttttcataattttaagaatctttttcagaaacttaaaatcatgttatgctaaattaagtaacagataattataaaatgtctgagtcatttacatggtatagaaaagctaaatatatttagatctgttaacaaacagattgagaaggttatctttctagaaattatgaaatggttctatctacaaatactggtataaaactgttcaaaattaccttacttcctaggttcttcactggaaattagggttactaagagttaaagttaccgtcaatatatacaattaaaactactgaacacaagagaaacaattctaaatacagtgcatataaagaaagtaagatgtgaagaaagttgacaatagagatcacttttctttacatggtaactttgtgtggacaaaataaggaggaaagaaatgtaaattaaataaggagggccaggtatagcggttcacgcctgtaattccagcactttgggaggctgaagtgggtggattgcttgagtacaggagttcaagaacaacctgggcaacatggcaaaaccccatctctacaaaaaatacaaaaaattatctgggtgtggtggtgtgtgcctgtagtcccagctattcaggaggctaaagtgagaggatcatcaaagcccaggaggatgaggctgcagtaagctgtaatcacaccactgcacttcaagttgtgtgacagggtgagaccctgtcagtcaatcaatcaatcaaatcaatcaatgataggaaagaaggaaatgtaaatttctgtcttaaggtagaatgccaatatcagaaagtcagtataggacaaaactaaagatttaaacaggttgtagaatgtctacggaaaaaaataaatgaatgaatgaatgataatggggaaataaatgtataataaatttctgtcctaaggtagaatgccaatatcaaaaaggaagtataggacaaaactgaaggtttgaacaggttgtattaggttggtgcaaaagtaatggcaaaaactgcaattacttttgcaccaacctaatagaagttttgtggaacatgaatcttatgaattttgtgagtgatcaagttggctaaaattagaaggggattatttcactttttaaaaaactgagcatcaaaatcaaaattgagcattaatatcaaaagcacactgatgcaaggccagactcaaaataatgggttttgggggccactgatctgctctttaatagattaaaaaagggttatgggaatcttgtgtgttcaaagctgattgagattagatggatttgtttattaaagttagctttagcattaacaacatactgatgcaaaggtagaatatggttctctcttttaaacaatattttcatatactaagagataataaaagacttgttcaccttttgagtaatctacaaaaataaaaagagaaaaagatgtgttggtcttgtgctgtctttattaggtcttttgattgtttgggaaaccaagtctcctttctattcaagagtaaaggtctttgctttcaattatcaccttgacttaattaatgactattatttattgtgtcttgtgatcctgtttagattaagtgttttcaacctgcattatttgacatgctttccaaaactaaatttcaaattctaactttaacccttttccaaaaggaacccctggaagtccaacagatacgtattaggcttatatgttaaaatcatattgttatagtaggtagccagtcaggcataagcagggcaggagggggcctaccaccacacacacacaccaggaacgtcaggttacctttgcagaataacacacccaacaactacaaaataaactttatatttaaaatgcttatgaaactgcctttccaaaaattgtaactgagaaaattatgatggtgaaagagatctgacctaactgactccatcttgcttctaatctccaattgtccttgttcattcctgggtgtaggccaaactaactttgggaggaacttagcttacagtttaactttgaaacaaagataacagccctttgctgaaataaacccccttcttgcttggggactatactgccgttgcaggactaacaaattagccacaagattagaaattatgatttaggagtcatgcagctggaggctgcaagattctgaacttccccgaattgctccaggggataacatcgcgattgtaaaacctaagatcagtgcttctgatattttgcagaccctgcactcaatggatcaggcagcaccacttagatctataaactaactcatctagtctttgtagtgcccacccaagaaacaacacagcacaagaggacagcttcaactccccatgatttcttctctgacctgaccaatcagtgatccccactttccaaccccccacctgacaaattatccttaaaaaccctgatccctgagttttcagggagactgataataaaactccagtctcctgtacagctagcgctgtgtgaatgaaactctttctctattgcaattcccttgccttgataaattggctcagtctaggcagcgagcaagaagaacccattgggtgattacacctgcacttcattgaatgtgaatcatgcctcaaaaaagttgagatgaacctggtgattatgtacaaaaatgcaagcattttaaacatttattaatgactcctacttattaggttggtgcaaaagtaattgcagtttttgctataaaaaatggcaaaaaccggccaggtgcggtggctcacacctgtactcctagcactttgggaggccgaggcaggtggatcatgaagtcagaagatcacaaccatcctgactaacatggtgaaaccatgtctctactaaaaatacaaaaaattagccaggcatagtggcaggcgcctgtagtcccagctacttgggaggctgaggcaggagaatggcgtgatctcctgggaggcggagcttgcagtgagccgagattgtgccactgcactccagcctgggcaacagagcgagactccgtctcaaaaaaaaaaaaaaaaatggcaaaaaccacaattacttctgcaccaacttagtcaataataaaaggctaaagtttctcaaagcaccaattttgtgttaattaagcaaaaaaaaaatttgttatagtatcctccttacagtagactttttctactatttcctatgcaaatatgataaaatgatttttaaataaattctaagtatatccccaagataaaatcaaagtaaaaaaaaaaacatagaagatgaagtttaaactcaaaatcaccataatctacctttctagccatctttggacattctctactttgcattatacagtaaacaaaatttaatatttgctatcgcttttcaccctatcatccccgcccacagctactgcttatctccgtgactttggatgtcttcttccctttgcctgaaaacatgaaattacttgtttaattgtctcattaccctattgcaatattcgttcctagaagacaatgtaattagcttatattcatttttgtacctcctgtgccaatatagtacctagtacatacacaaagcccaactggtgtcaattgactattattggaattgaaaattacacctaggtcaggaatttctaacatttccagttctagggaaatctcacaaggttaaaaatgtttctgggagcttctaacaggttttttttttttttggaggagggggaaggactattgcagtaatagggtttttttataaactaaggcataaaaggagggaaaaagagaaacagaagccccatatccctgaaattactgacacagcttaccctacccttcctagatgactcaattcttgccccataaagtctactccccacatagcagtatccttaaagcacttcaatgaattaaatgagttgttttgtggtaaagtgcttaagacagtacagaatcgtcactacaaattatttataaaacaaaaatcggacaggcgtggtggcttatacctgtaatcccaacactttgggaggccgagatgggtggatcacctgagatcaggagttagaaaccagcctggccaacatggtgaaaccccatctctactaaaaatacagaaaaattagccaggtgtggtagcgggcgcctgtaatcccagctacttgggaggctgaggcgggagaatcgcttgaacccgggaggcagaggttgcagtgtgctgagactgcgccactgcactccagcctgggcaacaagaacaaaactccgtctcaaaaaaaaaaaaaatcattgaatcctcacaactctataagtagattctaataatactctcatattatagctgaggaaactggggcagatagaagtgaggtgacttgcacaaggtcacacagtgagtgagtgatagagtaaggatttgaactcaagcattctggcactttttcttttttgagactgagtctcgctgtatcgcccaggctggaatgcagtggtacgatctcaggtcactgcaaccttcacctcctaggttcaagcaattctcctgcctcagcctcccaagtagctaggactacaacaacctcgaactcctgggctcaagcaattcttccacttcagcctcccaagtagctaggactacaagcatgcaccaccaaacacagctaatgttttgttttgttttgctttgttttgttggcagagatgggagtcttgctatgttgcccaggctggtcttgaacttctggcctcaagcagtcctcctccttgatctcccaaagtgctcggattacaggcaagagccacaatgcctggcttgaactgcaaaattcttaaaaatggggatcatttcttattctttattctagtgtccatgattcctaatcatagtgtaggcacataataaatgctaaataaattttaaaaaatagttttactttacttttcagtcttctgaaaccagcagttctgaccctatcatctaagtatagtttggctatttttccctcaataaataattgtgtacttatcacatgtaatcattgaccacttttctggctagtcacatggcttcgcaaaatgtttctgcagttgaacatctatcagcttgcctttctatttccccaaagtaattcctagatattttactgtacagtttttctttagtattgttttgaaaagatcttaatactgatccttgaagcaatctttagagaactgttccatttacctgactctctccaagaggtgttccatctactccttctccttgtttctgatatcttagccagtttcctatccatcataatacaatgtgtccatcctcattctctctttctcaaattgtatttagtgaagaaccatgtttaccactttttgaaagctgaaacagatcatgttactgcttctctttatttaaaacatcccattatggcaggcacagtggctcatgcctggaatcgcagcactgtgggaggctgaggtggaggatcacttgagcccaggagtccaaggcatgactgggcaacatagtgagatctcgtctctacaaataattaaaaaaaaaaaaaattagtcaagtgtggtggtgcatgtctgtagtcccagctactcaggaagctgaggcaggaggaccacctgagcccaagaggtcgaggctgcagtgaactgtcatagtgccactgtactccagactgggggacagagcaagaccctgtctcaaaaataaataagtacattgggtgtggtggctcacgcctgtaatcccagcactttaggaggccgaggtgggtgaataacttgagctcaggagttggagaccagcctgggcaacatggtgaaaccccgtctctatgaaaaatatggctaataaaaacattaatcaggtgtggtgacacacacctgtagtcccagctacttgaggggctgagacaagaggatcacttgtactcaggaggtcaaggctgcagtgagccaagatcgtgccactgcactccagcctcggtgacaaagtaagaccctatgtcataaataaataaatataaaaacattccattatattattatgatatctatcagtttgctcagtcatttaatgaacacttactgaccactgtgtgtcatgcactagacaaagcattaaaaaaacattaaagacacatgcatgcatgtgttcactgcagcactatccataacagcaaagagatcgaatcaacctaaatgcccatcaatggtagactggacaaagaaaatgtggtgcatatacaccatggaatactttgcagccatgaaaaagaacaagatcatgtcattcgcaggaacgtggatgcagctggaggccattatccttagcaaactaacaaaggaagagaaaaccaaataccacatgttctcacttataagtgggagctaaataataacacatagacacacagaggagaacagacactggggcctacttagggtggaggttgagaggaaagaatcaggaaaaataactaatgggtactaggcttaatacctgggtgacgaaaaaatctgtagaacaaacccacatgacactgtttacctatataacaaacctatacatgtacccctgaacctaaaataatagttaaatgaaagaaaataagaaataaaatatatgttctttgactcagaagagctcaaagtgaagtagaaggaggagacataagtgagaaagcatatagaaaaaaaaagttatttataatgattcagggcttggaattttaagtcacacagacctggatcgaaatcttcacttaaagagttgtataatgcagaagtcaaggtttcctcatttctgaaatggggataataaccatttcatctcttcctttttacaaggggacaagatacagtgcttagcttggcaatacatgggaatacattacaggcaatctgtaaatgatgtataatatagacaataagagaacatctatcctaggtaaagcctgcttcctggaggagctaactgttgaactgagtcctaatcaatggctaggaagtagaaagaatccagatagaactttagagaaagattaagtttccatactaacactaaagactccataatctgatctccacctactcaggttactactcagctacctcttctctcttgaatctcctaaaggaaactttccttctgtccaggctggtttactcactaacctcagaatatgctctgcttattttcttctctctattattgcttaggccatactcatccctgactctggccctagcctaaagcctgtccattccagaagacccacaagttccacgttcttttaattgaccattttaatggttctcagcagtgtctgcattcttgaactttcccaacacagggtcagattaccatgctcctttccgcacttcctttgccctcccactaactacctcctcatcattttccttaactatctgcacctttgcagtgagatttaatttttcatatgtgaacatcatatctctattggattgtaaactccatgaaggcgagactttgtgtaagcaagagaaaatagggcaaggatatagcatttagcctcacatctatttgatatgtgaagaaaggaatagatcagaaaactgctagcaacagtttcagttagcatgaaacccaaagcctatgacaggtctacaaggcttaaatgatagaacttaatggggcatcttgattttaggtactcaccttgatatgccctcagctctatcaagagcaagcaataaaaactttccactgtaggttgtattagtcatttaagatgcctcaaatgcttctgggaataaggcatgatataataaaataaaggtcaggggaaaggttggcagtcaacttcttaaacatggctactgcagtggaaagtagtatatggtatagcagaattaacacacctgggttaaaaatcctttgaaatttactggcattagaaactgggcaagtccttaacctccccaaggcaatttcccaatctaataatgtggattaaatatttattactcagggttgctgtgaagattaaatgagtatgtatgtatgtatagtatatatacagtatatatatgtatgtatagtatatatacagtatatatacagtatatatgtatgtatagtatatatacagtatatatatgtatgtatagtatatatacagtatatatatgtatgtatagtatatatacagtatatatatgtatatatagtaactagcacactaccggaaagacaatacctcctttagtattcattattaaaacactgccatcaacccatcatcttttccaaggcctttaaagaaagtaagaaaataaatattctcttccctctttaaagatggcatatcaggagtaacttgctgaaacccattgaggactcggacctaaaaacaagattcctaatcatagtactcaatgtacagtaaggttgtctttatggccaatctcttacctgttgcagtgcaaaaaaacatattaaacagtcttgtcacactttttagagtaactgagttttgagacgcattaagagactttcaatttgataaagaaaaagtgagagccttagatactataatcaagctggactcctgtagaaaaaaacaagattccactaaagataaaaggtaaactgttcaacccttgaagacatttgagattgtagccactgcctttgtaattcttcagctcatactattagtctaaaatggcaggaaataaaaacaaaacgaagttccaaatggtaggaaacataaaataacataaataatcataaaatgagccaaagaatgaactcttagagatggaagagacctctgaagtcatctagcccaagtcccttcttacagttgagaaagcagacaacaggagagattccatgctattaggttggtgcaaaagtaattgcggttctgccattgaaagtagtggtacttatggctgggcggggtggctcacgcctgtaatcccaaaactttgggaggccaaggcaggtggatcacttgaggtcaggagtttaagaccagcctggtcaacgtggtgaaaccctgtctctactaaaaatacaaaaattacccgggcatggtggcaaatgcctgtaatcccagctacacaggaggctgaggcaggtgaattgcttgaacctgggaggcagaggttgcagtgagacaagatcgtgccactgcactccaccctggtgacagagtgagacgcgtctcaaaaaaaagaagaacaaaagaaagtaattgtacttttgcaccaacctaatacatgtcaagcttcttttgcctcttcactctgttgtcataatttccccaagatttcattacttcccttgcagtaagcagatcagtcaggaacaggttcgactgccttataatatgggcccaaacactggaaatatccacaattcttgtccctgacagaacacaaagggggaatggtacacatgttctcggatctgattaaacatcaggttcctgagtacacagctatacaaacacaaagagtgggcaatgctgcctacaaaagaaatgcatacttagaggattttcatatttcttccatagatagaaagatccttatgggaccatcaaaattatgtggaagtttctagtggtgattagtttctagtggtattttgagacagtctcctccctatatatcttcatgatgataccatgaagaaaagctgaattagaccctgagaagaagagtatcacatactaggaaaccagttctggtaagtgattaacatgaacttgaaacctttctttgttaactgaaccaaccaaatttcaaatgactgttttcacccaagttcattcctaaacttgaggctttactctcccagtaagttcactgacttatataattaatacatggaaatgcttatgaaaatttaggaagccactgagtgaataaatacattcatttgtaataaatatgtgatacagaaatcaaaccatttttgggtgaaatatattagctagatataattattccctttaattagtccttgaagcttgtccgaatgccaatgttttgggaaaatactaacactaggaaatttatgactacaaatgccaaaaaagatgaagtgatattatactgaattttaaaaagatttcatctttagaacaagagataatatcagggtcctgctctgctttagacaggagatctgaaaatactttggatgccagagcaaaaggactatgtcaaagtacattaaattcttaagcaaaaggcaagaatcaaatctcaaacatctcaagaggtagtaaaataaccgaagatatttaggataaagaagaaagaggcaaaacaggagcagaacaactagagcctttaaataaatacttgcacagcaatcagaaaaggaactagcattgttttaattggtcctaagagaacaagttatcaatggatgaaaagtacaaaaaaacagattttgattgaaaagtaactttctatgttagcctcaaaagtcaataaatattaacagtgagtgaaggatacatttatataaaatagcaaaaaaatgaatccaagaaacttgggcataccaaatgagcctttgacaaaagtttaggcgcacatatggagcatgacactaatccattaagattagtgataggccaggcatgatggctcatgactgtaatcccagcactttggaaggccaaggcaggaggactgcctgagttcaggagttcaagaccagcctgggcaacaaagtgagacctcgtctctaaaaaaaaaaaaatattaataatggtattagtgatgagttatattccgataagtaaaaccaacttccaatttttaataatagaaaggaaggcagggcacagtggctcacacccgtaatcccagcactttgggaggcagaggtgggtggatcatttaaactcaggagtttaaatgagaccagcctgggcaacgtagtgaaacatcgtctctaccaaaaatacaaaaaaattagccgggcgtggcagtgcacacccatggtatcggttactcaggaggctgaggtgggaggattgcttgagcctaagagggagaggctgcagtgggctgagatcgtgccactgcactctagcctgggcaacagagtgagaccctgtctcaaaaaaaaaaaaaagaaaagaaaaagaaagaaagaaaagaaaagaagacacaaagtatggataattctgaaagttatattttataaagaataatctatccatgattaagctactgcagaactgcagatgagaaaaggtgatggactgtcctaggtagtggcaagggaaacaggagtgaaagaatttcaggaacatttcagagatggagctcagagtacttgatgatttattagagactcttggaatacagtattagtaggatttactgtgtcagtttagctatttatccattaacagtaacaatagtaggaaacacatactgtttaccataggtcaagcaatgttgtaaacattttacatggattaactcatttcattctcacaacactatgaagtatatttataaccatccccattttagagatgataaactaaggcttacatcagttaagttagccaataagtatcaagaatcagtaagaggttagatacaagatttagacccagatactgtaattccaaagctaaagagctcttaattgatcaactaaatagttgtaaaggaaagtaaacaaagtcgaaagcaggcagaatgtagtaatgtcaagagcccggtttaatgaagagccacagtgggggaagaggatagcagtttggctgctcaaaatcacatgaggtgttcataaaaaataaataaataaataaaataaatctgtattaaatccaaatccctgcagatgggagataagatttaactttttattttcttttttttttttttttttaaagccctgggtaattttgtggcggaaccaagtttgggaacctgtgtaataaaagatttctaagggctcttcctgctttaacattctagttgacattgtaaatgaagttcccagaaatcaaaggagcgagggagggatcctagctgcaggaaaacggctatgcattcagagtccacaccgtttatgctcccattttactaaacggtccctcatagggggagggatagaacaggcaacggaaagaaggatgtggtatccacgataagcaggctaaaaaagcaggcttttaaaaaggcttttctagcacgatttgcacaaagaaccccttcttgactatatatatttgtgttcatccaactggattttgaggtggattcctcagacccgtatctggctaatgatggatttcaatatattttctctaagcaccccgaagcgttgcacgaaacctctaggttgtggcctgcccgccccgaggccaggtgaatccggctcagcagcagaggtgtctgcaattacaccctctaatcccctactgtcagatatgaccctttccgcacatacctgagggccctctggtaagattgatctcttcctcagtgaccaaataatccactcttccgttcatgttttacagctcgtctggcttcctacttgggtcagctggagtgcagcacaggtgaaggtgaatcaatctcggcgctgcgcccacagcacagcggtttcggtttcagcagcctcgagacccggaaaag

SEQ ID NO: 418 - DNA, 92010 bp, Homo sapiens; identical to SEQ ID NO: 417

SEQ ID NO: 419 - DNA, 92010 bp, Homo sapiens; identical to SEQ ID NO: 417

SEQ ID NO: 420 - DNA, 6910 bp, Homo sapiens
tgctcaggaaataagagctgctattattactactcttcatagcataatgtaagggtttccttcctctcatcccagctcggaagcaccttatcaaggtgaactgagccgcttctgtttcttctcttccctctagccaccacgccccttcctttccgccatcctgcccccagtcttagctgcgcccctctcccaagcccggtcttggccctgccctttccctggccccgcccaccagacctgcaccggcacagccctcgctcagcggggcaggaagctcatggtgtagtttcgtgggatcgtggcaaagcccacgtgtttgggggacacgtcaatgtccttaggtgactgggaggacttgaggcggaagttctgcatgacggtggtgaagaagagaaagagctccattctggccaggccttctccgaaacagttccgctttcctgaggaggagaggcgggaggggtggaggtgaagcccactctcagtgcagcctcgccccagtaccgacctccagctgcggctctcccagggaggaagggtggaatattatggcctgagagagtttcagaggaggctctgatcctccctgagcctcaatttctttctataagagatgtaacaatggtgaaccaatattgatatattattactaacaaagtccatagtttacattagggtttactctgtgttatacagttctatgggttttgaaaaaggcataatgtcacacatccatcatagatggggtgatccatgccaggtgtagcaatgggaggtttagatgtcctttcctgccaggtacacttgcaaatatgactgctgtgccgtcatctcctttttagggatctgaggaatctgctgtgtgaccctagagaaatacatctacggggaaagatgtttcctttcattttacctgggcgcaggtactgggtgcttggtagttaaggaagtatcagctgctggctcaagggtagattctaacaggaacttccaagctggagaaataccaggctacaccgcagagaggggaggagggtgagggaggcccctgctggtgtgagccgtggcctggcagcaaacagtggtctcttaccgatggaaaagggcacaaaagcatcactcttcttaaactgccccttctcattcaggaagtgctggggattgaagtcctgggggttggagaagaaactggggtctctcagcacagagcccagcatagggaacacttcggtgccctggtagggaggaggaagttgtgtgtgatgaggagggtcgggggattggtgaaagtacacaggggctggagggggaactagtgtgccccaggtaaggggaagtggcaggcatggaggagttggggtcctctgatggaggagctttgggggatagaaggttcacatctctgaaacaggaagtttgggagacatggggtccatgtccttctaggcaggagtttgggggacctgagatttctgtccctatgacaaaaggccgaatggaaagggggcttctgtttcttaagataggaagtttgggaacatgtgtttgattctcctgacacaaagagtctggagagatgcaggactcaggagtgtctaagtggaaaggtggaacggatgtggtggttggggaagtcttttttgactgattgagggagtgggacagggtctagaaagcttctaatgtgggtgggatgctggggacacagagaggggctggaagtccccgtagtctggggggtgggggcggatagcaccttagggaggaagaaatcccgaaacttggtgtcctttttgactctgcgggccaaactcatggggatcacgtctccaaatctttggatctcgtggatcactgcctccatgtagggcatcttggcccggtcctcaaacttgggctgccggttcttgccgatcactctgtcaatctcctcatggaccttggctgggggaggagggggaatgtgtttaggtatctaggggtctcagagcaggaaatgatagtccgaataggcaaaatggggtggatgatatggctccgcctatgagacggaagtagagcattcataacagaacagacatcagccattcgcattgttggagtaggatcctgttaaccaggttgtgccagaatcacaggggaggcacagggaggaacttaggggatgacccggtggaacgggcagtgggcactcagtgggcttgggacagaagtgactgaccaatcagtgcagacattttcaatattttaatatctaatgagactcagctgatgcctaccagctgaatgttgccctgtctctggacagcaagtcacgtctcagggtcccgggatctgggacaggtggggacattgcaccagtcgaaggggaattttgagggtctggggccctccacttccgtccccctccagccttaccctccacctctgggtgcttcatgagcagcaagaagccatagcgcagggtggtgctgacggtctcggtgcccccaatgaagaggttcaacgtggtcatcaccaggtttttcaagtagaactccgtgttggggttcttctcctcctgcagggagagggggctttaggccaacctcactcctcttgccctcagggcccttctagggcttttcctttggatctacctctctttggttcagaccaaaggtggaaagagggaccctagatctaccagactcgctctaggttccagcccttgccctggctgctggctttgcccaaaatgctcttccttctcaccttctttaccttgctgaccatctgtccttcaattatcaacttagctgtcagtttttttttgtttttttttttcttatactgacttggtcttgctaagttgcacaggccggactccaactcctgagctcaagcaatcctccagcctcagcctcctgagtagctggaactgcacatgcgcatgaccatgcaggctcacttactttttaaacaattaattaattttttttgacacagggcctcattctgtcacccagactggagtgcaatgccgtgatcttggctcattgcaacctctgccccccttcgcgccaccatgcccaactaatttttggatttttagtagagacggggtttgaccatgttggccaggctggtctcgaactcctgacctcaggtgatccacctgcctcggcctcccaaagtgctgggattacaggctgttagccacggcacccagccaattgtgaggattattatgatgagggttaatttgaatgggcctgtgtcatctgcctgccccactcccagactgatttccctctgcctggctttgcatctccccgcagtggctgctggggtgtacctcctgcatgcggatgagaaaggagtcaatgaagtcccgtggggaattgggatccagcgtgcgctggttgtgctccaccttcttggctatgaagtcctccagcccttgcagcaactgaaaggcctgttgctgtggtcctggcaggtgtttcatcaccgaagagaacatctcatagagctggggttgcagagagaggatgggaagggaaggacagctgtcacggggcaggagctgatgggaatgggatttgtttcatagcaaggaaggaactgagttaaaggcatctgtctcgttgtttaggtatttcagtggggccggataggaacttatatctaagttttcaggaaggttaggtaccagggccacggtctagtaatttaggtgagaagaactgagacatatatccaggtttcaggtatttaaacgaggctggattggagcacacatctaggtgttcagatattcaagtgaagttgagttggaagacacctgtccaggtgtttagctcttcaggtggggctggtatgaggtgagtgtcacctgtctaggtatttaggcattcaagtaggcttggttggagacagctgtccagatacttactgggtctggattgggggcttttgttcaggtgctcaggtattaaagtggggctggtgaagatgttgaagtggaggggatacctgttgaggtgtttacctatccaagtgggatgcactgggagcacctctgtaaggtgtgtgattggaaagggttggggaacacttatttgtgtgtcagggaacaatctgtctagatatttatgtgtttaaggtgttggttagggcagctgtccatgttttcaggtatttaagtgggtgaagtagagggcgcttggccagatattccagtgggctaatctgggacatttgtgtagatgtgaaatgattatgatgggctggattttgcagcaccaggtgttcaggtatgcaggaggccggttgacgcagtcacttgtccaggtgttaaaatattcagaagaactgggtagggagcatctgttagaaattacggtaagttggggatgggaacacgtgcccaggtgagagagctgagctgagggtatgcatcctgccagcaggctctgttttggggagcatctgttgagctatccaggtgtccttggagacagggtattggacatccatcctgggttctggtgcaactgtccagttgtccaatatcggggactgattttgaggggacactgtctggagggcggtgggagtttggggcacctgtctccaggtaggggagcagttggcaggttgtggtaggggcgtcacgggccgggctgcagccagttacctgccccgtggaggttgacgtgaactggaagattcctagcatcatgcgcaacagtgacaggaactctttgtccttatagtcaaagcggtccccaaagacaatggagctgatgacattggagactgtgcggctcaggaagaaggtgggatcgatattggcgcctgcgggtatggcgggagaagggggttggggagagagtcaactcagaggtctgaggagagtcagaattccaggaggcagggccttgttgagccaaattcccagcgccagactccagggctggaagtgcgggcgcctttccccacctagtccccatccccaggcagaacgcgcgcgggttcctcgtcctgggtgttttccttctcctgcccccgcactcggggtcccctgctcaccgccagtgccccggagggcgtcgatgaggaagcccgcctcctcctggatgcgctcctcgatgcctcgcttgcccaccccgaagtcccgcagggtggcgatggagaagcgccggagctgcttggcgcgctccccgttgctgaataccacgcctggggaggtgaacgcgggaatggagacaggccagggggcggcaggggcaggagcggagcagctccaaggggctccccaagggtggaggagagagggagtagggtgggagagagatggattcagcgccattgcccagcagagctgcaaactcagtcagagaaacacgatgtcgaggtagagagagagagagagagagagagagagagagagagaagagagagaggagagagagagagagagagagagaagagagagaggagagagagagagaagagagagaggagagagagagagagagagagagagagagagagagagagagagaccaggtttaaagaataagacaatcagaaaagaaacagaaaggccagacagagagatgcacatagaaacagagggataaggggacactccatggaggaagggaaggaagtggggagagaaagagagtgatggaggaagaggatggagggaggggaagtgagatatggggagatctgggaggaggaaataaaaatggtgaaagattcttaagctgagctggagaagagagaaaaatattgagatagaaacagagagggtctggaaggaagagagactgttaccaggagatggaggctgaagatgtggaagtaggaataccctgaaatcctaagacagaggaagaagtgagaaagggatgcggagagatgagaaacacagagaagcccagaagctaagagggacaaaaagacaaatgaagacagagaaccagggctggaaaacagaaacccaggatgtccttagagatggagagagaggggaaagaggagactccagtgagagagaataaggaggtggggcagagagaggcagggaggaatcaggacagggacgctggagacaggtgagggatacacatggagaggccacaatgaagggagatggggagggaagaccagactggggactctgccttagcctccagttggcaggagagtcagggagaaggctgggaacactgagaccttcgtgtccacctggccaccttccccctcttgggcaccccctcaccatagcctttgaagacccagtcgaaggtggcttgctcgcctcgcccgctgaactcctcagcctggtccaccagagcctccctgacggcatcatgtccacacagcaccacgacccgccggggccccaagtgaatggtgaacacggggccatagcgctcactgatctgatggaggtgggtgggagtggttagagggagaagcctccactctgaatggggcccagcaccgagatgtcatgtgctgggatgcttcgcacccaggttctcacagtcagggagctggacatcccaagatcctgtctttctgatgctgaaactccaaaactccatttcctaagactctggtccacactggtcaaccccctgccacaaagccccagccaactaggcagcccccaccccgtgccacccatctccctgccttgggacaccttcatgagggagttgtacatctgctctgtgttcagctgcaggtagtttccaatgaagggcaatggggtgggtcccggaggcagcttccccttgctcttcctctgctgccaaacagacatcaagaccattacagtcaggcagaccagcaaggccaccagaagcatccctgaggccagcatggtggtagtgggatgatagat

SEQ ID NO: 421 - DNA, 282751 bp, Homo sapiens
aatctctagctcgctcgcgctccctctccccgggccgtggaaaggatcccacttccggtggggtgtcatggcggcgtctcggactgtgatggctgtggggagacggcgctagtggggagagcgaccaagaggccccctcccctccccgggtccccttcccctatccccctccccccagcctccttgccaacgccccctttccctctccccctcccgctcggcgctgaccccccatccccacccccgtgggaacactgggagcctgcactccacagaccctctccttgcctcttccctcacctcagcctccgctccccgccctcttcccggcccagggcgccggcccacccttccctccgccgccccccggccgcggggaggacatggccgcgcacaggccggtggaatgggtccaggccgtggtcagccgcttcgacgagcaggtaaccggcccgtggcgggcgggaggtgggagcggagtgggggtggggacagagtaggtgaggggaggtaggagcggccgcctcccccgcggctgcctcaggctctggaggaaaggaagggaagggaagagaagggaaggggggataagtgggggtggccaaggcgggaggtgaggggtaggaggggacagctgggagcttgggcaccctttccctcctaagtcggggggtggggccttgtccctgaccagcctccgaccctccatcccctttatcccagcccttccgcttggaaatggggatgagtgacctgggggcgcctttaggggcgcgccatctggatttaataattacccccttacttttgtttttgagcagaggtgggtaacgtttaggggttctctcttcctcttccctccgtgaccctcctaactggggacgagcgaaccctaaggcctgtcttatataccctcaataggagaacgataacattccgcccctcccccagtttcttcagcttcctctcctggagggggaagagcagaagaaagcaaggaaggcacaggttttcttactttctgctccatcgtctcatcctgccccgagagcttcaagtgcacactcactgcacatctttgtgatgccctacaacgtcgtcccccatatcctgatgacacagactgccttttttttttattgccgtttgcagtggaaaccgtggttctgaaatatcttccccttccttgataattgcagtctcttccccccccccttttttttttgccagcggtctgaggatgtgatgcattctcgagtgagaatgttggggagtaaaggggagaagggtgaaaggaaagtgagaaactgcttcagagccaccgacaacagagcaaagccagctgggatgtggtcctggagcggatcattctgctagtgtttgtggttgtttttgactctctcctggttgacaagagaactttcattgagaatatttgggatgaaaaaaaagttttgtagcttgaggaggtgactttttatcgcctgagtttcacacaataaatcctggggctgattagaataaatgcacacatagccttttgtcagtggaaattggtttaactttgtgttgctgtaggtagttggggatggtttaagggatgctttctgcagctgtgggtgcagtgggcttcctgtgatgggggaattgtttaagattgagtcaacctattttgtttactggatataatggtaaaacattatgggagctgaaggggtgggggaagagctcttctgttatttgatgcataaacatttctttacgggactcagcgtttcagacctacctggaaaatatcttggaatagacagaggaagttgagaagaagctatgtagataaaatagagttatgaagctgtcagagacttgaaggaattgttttatccattcgtatgcttccagacccaaaggcatctaaactaaactactaatccatctgaagtataatgttactgcatataaaagattacattattgatagagcgttagatttaaaacttggtagaaaagactctgtaattttaagaaaggatttaaaaggcacatagaagacttccaaagctgaaccttgtggacagcagaatctggatgtaggaaattgaaggatccacgccgcaattctccttaaattttaaaaattaaaaatttttttcagttttttcttaattttatttttttacttcttacctgttcatctctaggcttatttgccatattggaaaaagatacttaagagaggaatgattttgggctgggcgcggtggctcacgcctgtaatcccagcactttgggatgccaaggcaggtggatcacctgaggtcaggagtttgagaccagcctgaccaacatggagaaacctcgtctctactaaaaatacaaaaattagctgggcatggtggcgggcgcctgtaatcccagctactcgggaggctgaggcaggagaattgcttgaatccgggaggtggaggttgcagtgagctgagatcacaccactgcactctagcctgggcgacagagcgagactcttgtctccaaaaaaaaaaaaaaaaaaaaaggaggaatgattttgattatatacccagtaaagcaagaaagtgtttctccttctgtccctagctttaaaagaccttaaggcttcgttgtttgttatgcatattgtggaatcaaactcaccaccatctgttaaaaattaaggacattagtttttaaaacagcatttttctgcattccttatgttgtaattaagagaaagatatataggagagattattcctcactttttttttttgagacaaggtcttgctctgtcgcccacgctggagtgcagtagcttgatgtcggttcattgcaacccctgcttcccacattcacgtgattctcctgcttcagtctcccaagtagctgggattacaggtgtgcaccatcgtgcctggctaatttttgtatttttagtagagacgggggtttcaccatgttggtcaggctggtcttgaactcctgacctcaggtgatctgccccccaccccctgctcggcctcccgaagtgctgggattacaggcatgagccactgtgcctggcctattcctcacatttttctcttagaaagttaaagtctctgaccttgagatacaaaaatgtaagggttttcagtgtttaacataaggtacttatatatattatatatagtatatatataaaataaattaatatattaatttattatataagtgataaatgtttaattcaaattagagttcaccttacggttgaaaatgtcttttagtcagaaaactgaggcatgggaaggttaagtgacatagatctaataagagcttcagtatgaaaagtagtgaatgcttgaccatcagggagatacttttcctaagtatcccataaaatttgttctaatccattaaatatatttagaagactttattttattttttttatttttgagacggagtttcatgattcttgcctaggctggagtgcaatgatgcgaccttggcttactgcaacctctgcctcctgggttcaagtgattctcctgcctcagcctcccaagtggctgggattacaggcgcctgccaccactcctggataacatttgttatttttagtagagtgctgagattacaggcgtgagccatcgcttacatttttattgaggggagaaaaagccctgcatgtactgagagatagttgtataagaatcttaagagttggccgggcgcggcggctcacgcctgtgatcccagcactttgggaggccgaggcgggccgatcatgaggtcaggagatcgagaccatcctggctaacacagtgaaaccccatctctactaaaaatacaaaaattagctgggtgtggtggtgggtgcctgtagtcccagctacttgggaggctgaggcaggagaatggcctgaacctgggaggtggagcttgcggtgagccgagattgcgccactgcactccagcctgggtgacagagcgagactccatctcagaaaaaaaaaaaaaaaaaaagaatcttaatagtttcaactgtttataaaacttttgaattttggattatattatctgtactttgctttactgggcccagggggagttaagctttccttcttattacagctaagagtttgcctgttggaccacttaacgcccccagggagcatgtgcatgtctaaagatggcaactctgtttatgattgctgttttggttggatttctaatattcggtgtgattaaagcagaaatgcatttctagccactgctgattacagacatattgcactctgatgggtatcgcttagcaacttagtgcagtagactcagttaaaagaagtggatgtgtgccatattgacattttgagctcacattcttgtgggtaatataaaattccttaacctgataatattgcagctaaacctagtatttagggtctaagttgaatgagtattaccaattttagaagtaatcacctccttggttagggaaatgacagttgcacaggtggacagccagaaagctgaatgttatcagttaaatcttacatctctccttaacctgccttcgtggtgccaaatagcaagtttctaattgaaactgacaaattgtaggtgtgtagcttttttttttttttttttgagacagagtttcgctcttgtctcctaggctggagtgcaatggggagatctcagcatactgcaacctctgcctcctgggttcaagccattctcctgcctcagcctcccaagtagctgggattacaggcgcccaccaccacgcctgcctaatttttgtatttttagtagagacgggggtttcaccgtgttggccaggctggtctccaactcctggcttcaggtgatccacctgccttggcctcccaaagtgctgggattacaggcgtgagccaccacgcccggccatgtgtagcttttaattgtggttcattaacccagtttctaagcaaattagaaccttctgtgtatctcccctagttctgtatgccccactggttcctgtagagctttatttctgaagggaagtatgggaaaactatggatatttgaactaaaaaaaaaaaaaaaagaattaaaaagaactccatcccaaaatgatttgttgtaaatatgttcatttaaagcaattatattttccatatctgatcaagcaaaagtagtacataaaagccaaaaaacccaatttaaagaatatgttatggaataaactctgattttagaggttgtagtagcatatttgttgttctcatacattgagtgttcatctgaatgtacgttgaatatgcggtgagtgattcacagtataaaatgattggcaagtatcttcgaaattacaaaccacatactgattagacaaatagatttgcaaaactgaagctttttggatttaaaaaatatctcctagcctcattcttcaagcctggtgtgtaatttttataaggccttatagtagttgaaaatgagtactcttttatggtgacgaattctttatggtgagtgagaaataatgcttattcttccaattttagtatatgtggtgctgaatcgagcacaataatgcttattctttgcttcggaattttttaatttattattattgttattttaaatttttatttatttatttattttgagatggagtctcactctgtcgcccaggctggagtgcagtggcgcgatctcagctcactgcaacgtctgcctcctgggttcaagcgattctcctgcctcagcctcccaagtagctgggactacaggcgcatgccaccacgcccagctaattttgtatttttagtagagacagggtttcaccgtgctagccaggatgggtctgaatttcttgatgtcgtgatccacctgccttgacttcccaaagtgctgggattacaggcatgagccaccgtgcccggcccggaattcatcctttagaaagatttcttccagctgttcctcagttctctgcactcccttacactttccaccttatctgtctgggaactaatttagtctttatgttggctgctttcttttcacttttcaggctaagatttcctttctcttggaaatcagacgtttacttggtcctgcagctctctctctgtggaccagtcttttttgttgttgttgttgccagatactcaccgcctctactgtttatccacccatttcctttataactctgaaaagtagctcctgcctctgcttgattgctgttttcttgaaagtgattacttctggcaaaacatagtggtcattgcttagttgtaatgccactgtgatgttccactccccccggaaaccaatctcttccagttcccaagacacaatacttttctactgaattggagttccttagcgggggtcttagttttgttctgctattcagtgcctttgtccctatcctagccattagctttcctatagatccttgatttcctcatctgttgaaaaagaaatggctagaaaatcttttagattctttcaagtttaaatattcgatgattttaatattctaacagcatgtctctgtgacccagcagtctattgggagctgaccccacttgatttaccaaactctttcccattatgcctctgcatgcacctatgttccaggcaggtcacctcagtctcttctgtgtgtatcatgcttcttcccacttcttggcctttatttctgccagtctctgcctgaatgctttaattcctcctttgtgcttttctaattcctgtccatccttcaatgttcagctcagatttcattttttttttttccccatgaggttgtttcagactaaactctgctatctcacttcttggtatccttgttacctggagttttacagaaccacacagtaagttttcttcctttaggaggattgtttgaacacagcttggctttgttttctttttttcttgtctttttatcaaatggagtgcatactttctgaaaagcaaagaacgctatttgaattctcttctagtcaccccagtgcccagcacagtcttaaacacacagaacattgatggaatgtttttcatatgattcctggttgaagggtagactggctaaataaaaaaagtggtacttttggctttgttttactgaattttacttccatgtttgcaatagcctaggtctgataagtgatattttaactaggaatgagtaagaaaattagcataaagaaggaatttatacatatttatatttcctcccatagagcaaacatgttttttgaatcaggtttcagatctgatcaactacttttgtaattttggatttgtcacttactgttaggatattttgcaatggtgtgatagaatatgaatgtgaagcactttgaaaagtctaaaatttttctaatataagatttatatgttttctttatagcttattattattattattttttgtgtgtgtgacagagtcttgctctgtcactcaggctagagtgcagtgtagcttattactgattattgtgttttcattaaataagggagagtaggccaggtgcggtagctgatgcttgtaatcccagcactttgggaggcccatgtgggaggactgcttgaggccttgaattcaagaccaggctgtgcaacatagtgagatgctgtctctaaaaaaaattagttgggtgtggtggcatgtgcctgtagtcgcagctactcaggaggctgaggcaggaagatcacttgaacccaggagttcaagcatacagtgagccatgattgtgccactgtactccagcttcggtgacagagtgagaccctgtcttccaaaaaaaaaaaaagagagcgtgactagtctctggatattcctttgtatgtaccttggccaatatataccttactttagtatccattgacaagttctcttttttcttcttcttcatttttttttttttgagatagagtctcgctctattgcccaggttggagtgcagtggcacgatctcagctcactgcaagctccaccttctgggttcaagcgattctcctgcctcagcctcccaagtagctggcattacaggcacgtactaccacacctggctaatttttgtatttttaaaagagacaagggttcgccatgttagctggtctcaaactactgacctcaaacaatccacctgcctcagcctcccaaagtgctgggattataggcataagctgtggtgctggtctaatattgttacattttattttaaatgttcctgttttttgccctactctttttatttgactttttaaccattaggaaattagattcttttctcaaatctgctttattattattattattttgagacaagttctcgctttctcgcctaggctggagtgtagtggtacaattttggctcactgcaacctctgcctcccgggttcaagtgattctcctgcctcagcctcccaagtagctgggattacaggcgtgtgccaccacacccagctaatttttttgtatttttagtagaggcagggttttaccatgttggctaggctggtcttgaactcctgacctgaggtgatccgcccgcttcagcctcccaaagtgctgggatcacaggcttgaaccaccgtgcctggccctatttttgtatttttactatagacggggttttgccatgttggccaggctggcctcaaacacctgcctcagcctcccaaagtgctgggattacagatgcaagccactgcacctggccttaagtctgcttttaaaaaatgttttggctgggtgcggtggctcatgcctataattcaagctttttggggggctgaggtgggaggatcacttgggcctcagagtttgagaccagcctgggcaacagagtgagaccccatctctacaaaaagtaaaaaaaacaaataaaaaaaaaatcagccagtgtgcattggttgaaagtaaagaaaagaaaaaaaacagacaaattagccaagtgtggtagtatatgctacttgggaggctgagtcaggattgcttgagcccaggaaattaaggctgcagtgaggcatgattgcaccactgcactctggcctgggtgagaccctgtctcaaaaaaaatttttttttttaatatggagaaagtatttttgtttttcgttttttatttgggtaccggccactgcacccaaccaaacattttgtccttaaacaaaagtttaagtcatataatacagtagtaagaatgccttattttttacatctttgttctttaaattactcagattgctatggggcatttttgttgtagctttcaaatttggtattctggggttctatgtagactctatattgttgcattctaacgacatacttttaaggataagcagcgtattaattaaaaatgtgttttccacttgtgttccttaggtctgcgtatattttggaggtgtgtgtgtatataagtcaagggacaggaggtatcggaaggctctaaaggaagtttaaggaggagaatattctatagaagtggaaggggagatttgtggtcagcttaaactgttaaaaggcttgggatcaataccgaagcagaatatgagcatcttaatctgtttctttgcaaaggattgacttgtatttataaaagcattggcttgtttcatctgacatcttttaaagtaccccattttcttgggggcgggaagggagagatgagaccatttgttttgatcttgaaggacagaaaagtggttttacgttgtagtgactgtgaattaagtttaaggtctcagcaagttgtaaatttctgtatcatactatgtggtagagccttcagtaaacagagtactctcaggtgtttaatgctataggatataaactataactgctgtttatagtaccctcgctaaattctcttaaaggcaatccatttgaccacttcaaatgttatatgcctgtgatatatagttatattctctgcatataactggtttttaaaaattgtttattattcatttattttagaagtgaggtctctctttgttcctcaggctggagtgcagtggtgtgatcatagctcaccatagcctcgaactcctgggctcaagtgatctcccacctcccgaatatctaggactatgggcgtgcgccaccatacctggctattattttaatttttttcgtagagacagtgtcttgttatgttgcccaggctggtctcaaactcttggcctcaagcagtcttcccacctggcttcccaaagcactggaattacaggcgtgaactactgtgctgggtcctgagtggcttttgagccactgactatatcatcaaaaagcttctgttgagacaaagcctcaagctagtgtggagttcatcctactaaaatgaagaattggcattatgttctaaaactttacatattcttaccataaatggtactaattactttgcagtagcagtaacttgaggtgcaaacttccagattgcatattttctttaaaccatagtctggcactcacggtttggcttagggttgccactgcagtccacaagctgtcgcctgcccttattcatattttatagctttgaatgtcttattccattgaacttcagataactttttttttttgagatggagttttgctcttgttgcccaggctggagtgcaatgttgtgatctgggctcactgcaacctctgcctcccaggctcaagcgattttcctgcctcagcctcccaagtagctgggatgacaggcatgcgccaccatgcccagctgattttgtttttttagtagagacagggtttcaccatgttggtcaggctagtcttgaactcccaacctcaggtgatcctcctgccttggcctcccaaagtgctgggattacaggcatgagccaccgtgcccggctgagaacttaactttttctgatgaaattctttcctgctccacctaactcccgtgtcccacccccaccagcagagtggtatatctagcacaagaggcatgaaattaatttagtaaatagcaggactactagaaacttttaaggattatttaacttatttttaatcaaaattttatactcagataatgaccttttgggaagttatgtctcttaatgatctcaagtggtgacacttttctgttgacacggtttctcttgggtagttctcatagtagtttgggcatgagaaaacaacttttaccactttagacttgtgagggcagcctactatgtagtaaaagaaaaagcttttgattgtgcaacttgcagtgtggtcttggggaagtctcttaacctctctgaacatcagttttctatattttcatgtgtaaaatgggcatgatacttacccttctcacatcatgggcttgtttaatgacttaggtatgaatcttatatgaaaggaagctgtaaacagtcataaaaatgtattagcatctgtgcagtattttttttctatccattctttataatttggtggttattatttctactctacatgagaaaaaagttacagaggcaaaacatgttcacaatcatatgattatataattaactgagttaaactagagtatggatgtcttgacccttagatcactatctttccaataaatagttttaaaagtctaaattttactaacaggtagtacaaatatgcaaaatgagggatgtatgattgcttcttcactcgaagatggtatattatgtttttccttttaagttcatgttagagtatctgaatcttttcaagttggttagatgttagaaatagatgtaaattttaagcattatatatccttgatttcattatgtattattctcctggtcactttatcaaaacttcttcagctgttagaagttgtaacattgtttcccttttatttagttatataatacacttattgtacattcttaagtgggagaatagaatttgtgagaataccaacagaaatacacatacagctataaatatgagattatgattctttcatgttggcattgcacagtctatttttgtaaagttggtttttatattctaagaacattttacttagagtttgattacatttgaggcaaacttttcaactttggtagtatttgaatgaagattcctggatgtggtttttttaattgttacatctactttttcagtttttctttttccctataacaaccctcaaatccttcatcttgtcttttggagtatttttttctatcctcctgtctttatcggtgccttctattcctgtcccaccttgggtctgggaaaatgtgcctttatgctccatgtgagtcttcttccttttgggtaatgagtgcggagggaaaaaaagcacagtatttctttccctgttatgtttcagtttttggcctctgataagtgaatctggagtagggaatgacagtgatagtaggttttgttttagtcatatattggcgacaaagatcaacgaagacctgaagctcttgttcctctcatgacacaaactacccacaggtgcatgccaccatgccgggctagtttttaaattttttgtagagacgaggtttcgccatcttgcccaggctggtcttgaattcctggactcaagcgatcttcccacttcggcctcccagagtgctgggattacaggcatgagccaccgtgcccaaccgagattctgtctctgaaaaaataaataaataaataaaataaatacataaaaataaaataaaaacatttgaagacatcttaagtacaccctagattcccacccccaccaaaaaatttcattcattcttcaaccatttctcaaagaacatgttttcaagacacctcactatcctaattgttttccttttggtgcaatggtggtcagtactcaggcataccattttttatctttcctcccaatgttgtatgagggcattatatgaaacttaaatggatttaaaaatgctgagcttgctggacatggtggctcacacctgtaatcccagcactttgggaggtgggggagggaggattgcttgagcccaggagtttgagatcaacctggacaacacagctagtatgcacaaaaaaataaaaaaagtagctaggcgtggtggtgcatgcctgtagtcccaggtacttgggaggctgaggtgggaggatggcttgagcccaggaggttgagcctgcagtgagtggtgtttgtgctactacactccagcatgggtgacagagtgaaactctgttaaaaaaaaaaaaatgctgagcttcaggtacagtatatttttggtatgcatttgattaccagtacagtatacctatcaaaaatgttaattcacatgttttaaaataaaaagtttccaacataaaagtagagagttttttttttttttttttttttttttttctgagacagagtctcactctattacccaggctggagtgtaatggcacgatcttggctcactgcaacctctgcctcccaggctcaagccatcctctctctcagcctcccgagtagctgagatcacaggtgcacaccaccacgcctggctaaattttttgtattttttgtagagacagggttttgtcatattgtgcaggttggtctcgaactcctgacctcaagtgatccacccgcctcagtctcccaaagtgctgggattacaggcgtgagccactgcacatggcctagagagatgttataaattaatccttttgtatccattactcaatttctccctagtcttatttcatccgtattcctacccatttcctgctcactacctctttattattttaaagcaatcctatatatcatttcagcgtgatttattcttatactgactttaagagctgtgtaatataaaaacaactcaattaggaatcagaagacttgactttaagtcttaactttctactggaatgagttaacaggggggcaagccaagctgtatgagccctgaattcctaatatgttgaagagagtaacacgtggtggaggggacataatgttacctgcactttttcacagggatctatgagaatcaaagataggaggtaatatgcatgaaagtattttgtctactctaaactcaaaagcaaaagtgctttacaaaggtaagattttattagtaaatgctgcttccctgtataagtgctaacaactcatgcctaatcagtcttagaattatctggatgctgacattaaattaagtccatagtattaaaatcaccctttcacctttacccactcttggattttgacaattgcaacaacattttctcattcccaatctggctcctgttacttttcatgacttctgcaagttcactgaccacatttctcttaccatatttctaaattttcatctgtatcttggattcatgtacacttgagctcaggtaaaacagggaggtgggctcttcatgctttatgtatctaagttctgatgactctcagcaatgctttttttcagatttgaagatcattttcttttttttctttttcttttttttttcttttttgagtcactgtcacccaggctggagtgcaatggcgcgatctcggctcactgcaacctccgcctcccaggttcaaacgattcttgtgtctcagtctttcgagtagctgggattacaggcacctgtcacgatgcccggctaatttttgtatttttaatagagaaggtgtttcactgtgttgtccaggctggtctcgagctcgtaacctcaggtgatcctcttgcctcggcctcccaaagtgctaggattacaggcgtgagccaccatgccttggcctcattttattttcaactagaacaattagaaataaaaattgagttgaatagttctgcttttaatgacctattggtgctggaatcatggactctagtgattcttgttcttctttcctcatctttttgatcctaatgtattttaaaagcctttacatatttttgtctttaacatttctagttattctgaacttttgttttaactcttctgttaatttatccattgtgtgtagtgtgtattttttcttaaatgtccttataaatactgagctgtgggggaggggagaggaggagcaactggtgcaggcacgctagtttctttagaaatgtcagctctgccagatcacttaagacttgttaaaagtacagatttcctggctctactaaacatcgtgtgatttctagaggtcccaggtcatttttgacataaagctgggtttgtaaaccactgctgtgtgatatacagggagaatttaatttctgggtggtatttaataggtcacagtacagtcatatatatcactgcaacaagttagaaaaccacaattggatgaactttaaaaatcaatactaaaaaaaatattggagagctatggatgtaatgaggactagatgaattagaattccagaaatagaagagatctttataggtgagcagaggattgctgacatttgctgattctggacacacactgaaggaaaaggaaactagagaggaagtgcattttactaaaactgcaacatatccctggcccagttcaattcctgattggactgaggtgatcagcctatcttatcccttttgcctaatagaggaaatagacagctcttactgaggagatatattctggggtttctatggttctttcgtttataatactatcatactattaactattctagagatgtgaaagggtggaaaaattcaagagaaaaataaaacttatagaagcagactcagaaaattgaagttcatcagacaaagacttattttaaaataactataatatacttaagaaaataaaggaaaatacggagaaaatggatgaaaattttcatagagaattggaatccacagaaagaaaccaaatgaacattctaggaatcaaaaacacaacgttggttgcttaaggtctttatttgtagtttaattagaaactttggcgcaggactctaggacactccacctccccctcattctttactgttcttaaaaaacaaaaacaaaaacaaaaaaaacccaggtaaatttaatgtatactatttaagttccacgagagcagggcctatgtctgttttgttcgttgttgtactcccagggcttagtatagtgcatgccacattaaaaaacaaaacaagacagaacaaaatcttccttaacaccaccatcacaaacccccccattaataattaattgacattaatctgaaattaattattcattgtaccggttcagtagcagactatacacagcagaaggcaagactagagagcttgtggacagatcaatagaaaatatctagataaaagcacagaaaaaaaaaaaagaatggaaagagtagaacagagcctctgagacatgtggaacattagtaaaaagtctaatgtgtaattggagacccaaaagtagagagattagcatggaagcaaatacttgaagaggtaatgataaaatattttcccaaactgatgaaaggcatcaacctataaattcaagtagtttagcaaaccccaagcaggatgaacacaaagaaaactacacttagcatatcttaatggaactgttgaaaaccagaaacaaagagaaacgcttaaaagcagccagaagaggggaaaaaaggcactgtgttcaaaggaacgatataatacaactgatggctgactttttaatacaactgtggaaactgggaaataacagacattttttaaatgttggcaaaaaaacctgccaagctagaattctaccttcagcagaaatatccttcagacaagaaggcgaaataaagacatttttagacaatcaaaagctgacaatttatgaccagcagacctgcactgtaagattactgaaggaagttttttaggcagaatgaaaatatctcaaatggaagtacaaaactgtaggaaataatgaagagcacacactcgggtaagtgtgtgagtaaatagacaagacctattgcctcttgtttttattgctgtttttaggaactttattgctttttgctattctagaataatagaatttccacagcttttaggttaaggtaaaattgccatccaatcaataaactgcacatatttaaaatgtataatttgatgagttttgatatacatataagcctttgataccatcaccacaatcaagatgaagaacatatattaccggcaaaagttttctccagcctccttataatccattcctacctccatcccatccctagggaacccttgagctgtttttgtctcagtggatatatcataagttgtttatccattcacttgttgatggataactgaagacaactcaaattttcaccattacaaataaagttgtcttgaagattcatatacatgactgtcatttctcttgagtaaatacaaaggagtagaaatgggtggatcatatggtggatgtatataataatgttacaggatattatattctgtaatattttaagaggccaccaagctgttcctaaagtgattgtatcatcttacagcagtatatgagagtttcagttgttccacatctttgccaacacttatttaaccttttcttttaaattacagccatcctagtgggtatgaagtggtgtctcattgtggttttgatttgcatttccctaatgactcatgatattgagcatcttttcatgtgcttatttaccatctgaatattttctttggtgagctgtttatctcttttgcccatttttaaaaaattgggttttactggagttttcagaattcataatatatgctgaatacaagttcatcagataaatgatttgcaagtcttctagtttttccttgtttttttgttctcaaagtctttcaaaagcagatgttcttaatttttctgaagtccaccttatcaattaaaaaatagatcatgttattggtatatctaaggtatctttttctaatataaggtcacaaatttttctcctctgttttctgtagaaatttaggatttatactaacgtttgtggctcatttttagttaatttttgtatttgtgctatgtgcctgttatgccaataccacatagtcttaactataaaagagcttaactatataaactataataaaatatcaagtcaggtagtataagtcctccagctttcttgtttctcagaattgttttgactagtctaggtcttttgttatccttgtatggtttcggattggcttgtcaatttctattaaaaagccagttttgatagagattctgctgagtccatggatcaactttgggaagattgccatcttaacaggtattgttttttagtttcaatttttgattgttgctaatatatagaaatacatggatgtttattgatcttgtttgtttttatttaggccatagatttttttctttttctttttaaagacagggtcttgctctgtcccctaggcttcatagctcacttcagccttgaactcctgagctgaagtgattctcccaagaagctaggactacaggtacatgccaccacgctcggctcattttcttattttatagagacaggatcttgctgtgtttcccaggctggtctcgagcacctggcctcaagctgtcctctcgcctcggcttcccaaagtgcatgagtcactgaacttggccaggccgtaaattgttttgagacagggtcttgctctgttgcacaggctagagtgcagtggtgcaatcatggcttactgcagccttgacctcctgggctcaagtgatccttccacctcagcttcctcagtagctgggactgtaaacactcaccacgatgcctggctaatttttgtagagacagggtttcaccatgttggccaggctggtctcaaactcctgaccttaggtgatccatctgcctcggcctcccaaagtgtttgaccactcagcctttatacagatatttcatcttctttacaagaagaaaaacactctaagctcttgcctaaaaagatgaaaatgttctttgtaaaaatgaggatgtccttaccctcttcccaaaatgaggagcagagtctcataattgtattgatttctgggggacattcacactatctatttctaggctgtgttaattatgcctcaaattcatagttccttctgaatatcctgttacctagggactaaattgtaaagttaacctttaataaagtttgaataacatagagaagaagagggaaggaattgatttataaacttgcccgtttccctgtaataaggaagaaaatatgtatagctgctgtagaccttgcttctgtaactggttgagagattgtagttcatatttataactacttctgctgtacattccatgtttcctttgttctcattcaagatctcagctggtggggtaacctaaatcttcattaataaagaatatggctttgggaggctgaggcgggtggatcacgaggtcaggagatcgagaccatcctggctagcacagtgaaaccccgtttctactaaaaatataaaaaattagctgggcgtggtggcgggtacctgtagtcccagctactcaggaggctgaggcaggagaatcgcttcaacccaggaggcagacgtggcagtgagctgagatcacaccactgcactccagcctgggtgacagagtgagactgtctcacaaaaaagaataaaaaaaaaaaagaaaaaaagaccatgggccggacatggtggctcacgcctgtaatcccagcactctggaagctgaggtgggcaggtcacaaggtcaggagtttgagaccagcctggccaacatagtaaaaccctgtctctactaagaatacaaatattagctgggcgtggtggcaggcgcctgtaatcccagctacttgggaggctgaggcacaagaatcacttgaacccgggaggtggaagttgcagtgagccaagatcacaccactgcactccagcctgggcgacagagcaagactctgtctcaaaaaaagaaaaaaaagaatacaaatctttggtggtcctgcttcatgtgtgtgcatgcctgtggctgtggttttccattaagttttgctcttatatatataggtttagaaaaacatttcagggaatcctcagggttccagacatagtcctctttgtccccattatgtagcaacagtacagtatcacctagtaataggactgaattacatcagctaatagaataacccccttctttgactgttgatgtagtgcggtggttcttaggacagttttacctcccaggggacatttggcaatgcctggagacatttttaattgttatgactttcgtgggggtgggggaatgctactggcatctagtgggtagagttcagggatgctgtcaggcatcctgaaatgcacaggacagcccccaagagtagagactgatccagtccaaactgtcagtagtgctaagattgagaaattctgatttagtggtatggaggcagtggtcatgaggtagttgttacttccagttcagtggaactgtgtggaatcattccctgcttgggaaccaaggcctccaatccagcagatatcaaagtcgtaggtacttgaaacaaaacttctgctaatggaatttttaggaataatagaggaactacttctacttgtgccccttgattctcaggcctttgtattctagctatggggaaaacaatattgtatattgctcattgatccactgtaactgagtgagtcttcagtagtccattctgttagaccagctgcttctgggtgatggagtatgtggtaagaccagtgatttccaagttccataacccattcctgcataaccctttttctgtgaaatgagtaccttgatcaaagtcttgttgagtagtataccttgatgatgaacaaggtgtcgcccatgtccttgatggtgatgctggcagaagcactgtaggcagggaatgcatattcatattcagaatatgttggtgccagtgaggacaaattcttgtcccctccatgtatgtagagtttttgttttgttttctttttttaaggtatggtattatccactgtcattaatattttggagcattttacttccacattaaaaaagatcaaaataggtaataattatctgaccaagaaatgttttaaataaattgtagacttatgacagctatatcatctatctaaaaaccttggagtaactgtaaaatagtgacttttgaactgtagactttactcatgcagatatctcactaattttgttgaaatctaccagatagaaatccattgttatgggttgtatggttgaaaactttttaggctgtcatttgtttcaagatacagattgactcggtatactttaacatttctcatagttggccaaatttaggtaaaactatttaatttcattgaacgttttagggaaaatgcctgaatattaatagagataggatgaattaaattaaagaacttaccctttgaaaaattgccagggttagcaatttttatgctaaccctgcataaaaattgtgcgtggtggtgtgtggagtggtgtatatgtttcagagaaataatataaatgttcagataagagtatctgcgtaatctaactaggacctgtctaacctacctgcttaaggatagaggaaatcttgagagacttgaaattgaagaacttaaaattttaagtcttccctttcaaggccctatcaaaacatcatgaccacatctttgaaatagttacttttatcactcaatatagttagaaaattttatttttagaactccaaaatcattttattttattttatttatttatttttttcgagacggagtcttgccctgtcgcccaggctggagtgcagtggcgccatctccgctcactgcaagctccgcatcttggtttcacaccattctcctgcctcagcctcccgagtagctgggactacaggtgcccgcccccatgcccagctaatttttttgtattttttttttttttagtagagacagggtttcgctgtgttagccaggatggtctcgatctcctgacctcgtgattcaccttcctcggcctcccaaagtgctagggttacaggcatgagccactgtgcctggctcattttatttttattattattttttgagatggagtctcactattgcccaggctggagtgcagtggtgctattttggctcactgcaacctctgcctcctgagttcaagcaattctcctgcctcagcctttggagtagctggtactacaggcgtgccgccacgcctggctaaatttttgtatttttagtagggatggggtttcaccatattggccaggctggtcttgaactcctgacctcagttgatcctcctgcctcagcctcccagagtgctgggattataggtgtgagctaccgtgcctgacctccaaaaccgtttttattaattatattctttattaagtatatgtttgataaagacaagcatttttccttttttcactgttacattctttctgtttagaatagtgatttgcggccaggcgcggtggctcatgcctgtaatcccagcactttgggaggctgaggcaggtggatcatgaggtcaggagatcaagaccatcctggctaacaggtgaaaccctgtctctactaaaaatacaaaaaaaattagctgggcgtggtggcgggctcctgtagtcctagctactcgggaggctgagacaggagaatgacgtgaacacgggaggcggagcttgcagtgagccaagactgcgcctctgcactccagcctgggtgacagagcaaaactccatctcaaaaaaaaaaaaaaaaaaaaaaaaaaaaaaaggaatagtgatttgcacatagaagggactcaataaatatttgttgaatgaatgaatatatgaaataaaatcttccatgctcttgaagagaagtatttgtcatgtgactggtcttatatggcagaatgtcccttgtttaccattcctattcccttctaaccaaatcatgatatgtatttttaggtattctttggcatttctttttgaacacctggaaaaatgctaaaatatggtttaaaactcaatgtttgtgaattaggctgttaggtgcagcctgacttaagggataagggctgaattatagagaaattgaattatgctttcaaatatggtacgcatatgaaagtaatacatggttgttttttaaactaggttaaatgtggtaaatgcactcttttaatttagtgttttattaaattttggtatatgttgtgttataagcataaaagtttctgaaagaatttttgtgcctagaaattgtgggaattgttgctttctttaacttttgatttgaaacaatcacaaattacactggattcttaaaaatgttgtaggatctttagggagctcaactgcagtccagatgctgattttttttttttttaatactttaagttctgggatacacgtgcagaatgtgcaggtttgttacatagctatactcgtgccatggtggtttgctgcacccatcaacctgtcgtctaccttaggtatttctcctaatgctatccctcccctaaacccccaccccgcaacaggcccagtgtgtgatgttcccctctgtgtgtccatgtgttttcattgctcaactcgtacttatgaatgagaacatgcagtgtttgattttctgttcctgtgttagtttgctgagaatgatggtttccagcttcatccatgtccctgcaaaggacatgaactcatccttttttatagttgcatggtattccatggtgtgtatataccacattttctttatccagtctataattgatgggcatttgggttggttgcaagtctttgctattgtgaacagtgccgcaataaacataggtgtacatgtgtatttatagtagaatgatttataatcctttgggtatatacccagtaattggatggctgagtcaaatggtatttctagttgtagatccttgaggaatcgccacactgtcttccacaatggttgaactaatttacactcccaccaacagtgtaaaggcatttctatgtctctctctcttttttttttttcttgagatggagtctcactgtgttgccaggctggagtgtggagtgtggtggcatgatcttggctcactgcaacctccgcctgccaggttcaagtaattctcctgcctcagcctctccactagctgggattacaggtgtgtgccaccacacccagctaattttttgtatctttagtagagacagcgtttcaccatgttgggcaggatggtcttgatctcttgaccttgtaatctgcccgcctcggcctcccaaagtgctgggattacaggtgtgagccaccgcgcctggccttaagagttcctgtttctccacctcctctccagcatctgttgtttcctgactttttaatgatcgccattctgactggtgtgagatggtatctcattgtggttttgatttgcatttctctaatgaccagtgatgatgagctttttttcctgtgttttttggctgcataaatatcttcttttgagaagtgtctgtttatatccttcgtccactttttgatgggttttttttttttcttgtaaatttaagttctttgtagattctggatattagcccttggtcagatggagagattgcaaaaattttctcccattctgtaggttgcctattcactcatgatagtttcttttgctgtgcagaagctctttaatttaattagatcccatttgtcaattttggcttttgttgtcattgcttttggtgttttagtcatgaagtctttccccatgcctgtgtcctgaatggtattgcctaggttttcttctagggtttttatggttttaggtcttatgtttaagtctttaatcaatcttgagttaatttttgtataaggtataacaaaagggcccagtttcagttttctgcatatggctagccagttttgccaacatcatttattaaatagggaatcctttccccattgcttgtttttgtcaggtttgtcaaagatcagatggttatagatgtgtggtgttatttctgaggtatctgttctgttccattggtctatgtatctgttttggtttcagtaccatgctattttgtttactgtagccttgtagtatggtttgaagtcaggtagtgtgatgcctccagctttgttcttgttgcttaggattgtcttggctctacgggctcttttttggttccctatgaaatttaaagtagttttttctaattctgcaagaaagtcaatggtagcttgatggggatagtattgaatctataaattactttgtgtagtacagccattttcatgatatcgattcttcctattcatgagcatggaatgttttttcatttgtttgtatcctcttttatttccttgagcagtgatttgtagttctccttgaagaggtccttcacatcccttgtaaggtgtattcctaagtattttattctctttgtagcaattgtgaatgggaattcactcatgatttggctgtttgtctgttattggtgtataggaatgcttgtgatttttgcacattgattttgtatcctgaaactttgctgaagttgcttctcagctaaaggagattttgggctgagacgatagggttttctaaatatacagtcatgtcatctgcagacagagacagtttgacttcatcttttcctattcaaataccctttatttttttctcttgcctgattgccctggccagaacttccaatactatgttgtataggagtggtgagagaaggcatccttgtcttgtgccggttttcaaagggaatgcttccagtttttgcccattcagtatgagtatacctatgtaacaaacctgcacattctgcacatgtatcccagaacttaaagtatttaaaaaaaaaaaaaatcagcatctggactgcagttgagctccctaaagatcctacaacatttttaagaatccagtgtaatttgtgattgtttcaaatcaaaagttaaagaaagcaacaattcccacaacttctaggcccaaaaattctttcagaaacttttatgcttataacacaacatataccaaaatttaataaaacactaaattaaaagagtgcatttaccacatttaacctagttaaaaaaaaacacaacaaccatgtattagtttcatatgcataccatatttgaaagcgtaattcaatttctctataattcagcccttatcccttaagtcaggctgcacctaacagcctaattcacaaacattgagttttaaaccatattttagcatttttccaggtgttcaaaaagaaatgccaaagaatacctaaaaatacataccatgatttggttagaagggaataggaatggtaaacaagggacattctgccatataagaccagttacgtgacaaatacttctcttcaagatcatggaagattttatttcatatattcattcattcaacaaatatttattgagtcccttctatgtgcaaatcactattctttttttttttttttttttttttgagatggagtttcgctctgtcacccaggctggagtgcagaggcacaatcttggctcactgcaagctccgcctcccgtgttcacgccattctcctgtctcagcctcccgagtagctgggactataggcacccagctgtgggtttgttataaatagctcttattattttgagatgctctccatcagtacctagtttattgagagtttttatcatgaaggggtgttgaattttatcaaaggccttttcttcatctattgagataatcgtgtggtttttgtcattggttctgtttatgtgatggattacatttattgatttacatatgttgagccagccttgcatcccagtgatgaagctgacttgatcatgggggataagctttttggtgtactgctggattcggtttgccacaattttattgaggattttcacagatgctgaatttttttctgggaagaatttactttgactttttcatcctacaaaaattattctggttctgaaggatgcaggtgtttcaatggtgtcccattaatatccccaggcttagcacagttcttgcttggttataataggcaattaagtgttgaatgaatgaaagaattttaactttattctgtgggttcagggagctgttgaagagtattaagcaagtgagtggcatgctcacatgttctgaagagtgtttcctggtagtgatatagaagatggatttgaagggacagtaaaggcaagaataataattaagaaattgttataatagggatgatctgagccagggtactcattataggaaattaggggcaaccttgtcatgagatttgtttaggagatgaaattggaaggcttcagatggatgataggggtaaggaggaaaggaggagatttaagtgaataagagttgaggagagggaggagttgtaaatgacaagtttcttgtttattgttttgaataaaggggaaaattgttttcagttattcataaaggacttaaaaatgggctttgatcccaaaagttgttttgaagttatttcctgctttatctttggagacccttcttcccacccccacatcaaagcaaatgccctcaactgctttagatgcagtcttgcattgaaataggtatcacattgttttattttgcttgaatgggtgctgttggcttaaacatctaattgcatctgctttgtcttctttagttgtgtctacttatgggccaaaagagcatttctacctctgtaatttcatttgcatattggttttcagataaattgaagattaattatatgaagtatatggtttgtaatctcaattgaaggtgaattttttattttcctggttgaatataatggaatcattttggtatggagaagaaatggttaaaaatagaccagtgggtcatctcagtgtgaaagtcaagaggacttctaggcttaagcctggtagctaaatttctgttggctctaccctcttcatgatgagtccaagtttattttgatctgcatctttcttttttttaatgaatgaaattctccttcattcagcctggtaagtaacctggccattagtacgtgactaaatagctgaagcttctggcttgaattaagttataaacttagcacagtggcaggtgcttgaactgccatgttaaaactagcgcatagaatctttgccattcaaaaactgttttctcaatcccatgaaggagatgaagcctacatgggaatcttcactgattgtgctgacttttcttctacaatttttagtttataacatgtatagtttgtcaattgtgctaggatattttgttaatatgttcttaaaaattcaaatcccaggggtaaacatcaaataatttaattgtgcctatttgactttatgggagagttaacaaccatatttatatatatggttaaatgtgtataatcttcattctcaatctttcagaatccttattttccattttcatttttagcattagctgcattatttctttatacaactaggaaaagggattattcagaaatttggttgatggctttttattttgtagagacagggtctgtctctgttacccagcctagtctctaacttctagtctcaagtggtctttccacctcagccttcctagtgttgggattacaggcatgagccaccgcactggccagatggcattttaaagaataatgttaggaaaataattaatttttgcaagtgaagatagttgaaatgttagctaaaatgatgacctagaggcagcttgttttggtaaatatcttagtcagtttaggctgctataacaaaataccatagatttggtagtttataaacaacagaaacttacttctcacaattctaaagtctgggaaatccaagaataacattcctttaagcaaggttgaatgtaccagcttgggcgatagtggcaagtagcctcctattccattttgttctagaaagcattttttctcttttctattatttttgtctctttatatgtttatgtgttagggggagaaggagagagaatatttttatatttttcttttggggggatatttttatttttaaattataaatacttctaatttgcaaaggatcccagaaatagttgaagctgtctttaaacccctctctgatcccattctatcctttctgttaactactattctgaagttaatttgtactctgtccatttttatccttttattacatatgtttgtgttcataaaaaaattacagtttaacatttttacataaaaaatgttcttgtaaatattctgcaatttgcttttttaaattttattttttatttttaatttttttttgcagagccagggccttgccttgttgcctaggctgatctcaaactcctggccccaaggaatcctcttaccttggcctcccaaagtgctgggattataagtgtgaaccaccactcctggccttgcagcttgctttttaaacctattctaagacttgctccctatttatacatgagtattaagttaactcattttaactgcacgtataatattctattatcagtatgtcagtttatccatttctggtatagaggaacacttaatttgttttcagggttttttttttttttgcttgtgtttttgttttattataaacaatgcttcaggaagcatatatttgtattcttgaattttttttttttttttttttttttgagacagggtctcactcttgtcgcccaggctggagtgcagtggtgcgaactcggctcactgcaagctccgcctcccaggtttatgccattctcctgccttagcctcctgagtagctgggactacaggtgcctgccaccatgcgggctaatttttttttgtatttttagtacaggcggtgtttcactgtgttagccaggatggtctcgatctcctggcctcatgatctgtccgccttggcctcccaaagtgctgggattatatgcgtgagccaccgtgcctggccttgaatttttatttgacttaaaacatactgtgaaacttgtaagattatgtgaatcatgtttgtacagtttatacttaaaaaaaaaaaaacatggtgaactcttatcaattcacagagtaaaaaacaacattcccaatgctgtggaaacacctctatggcccaaatcacagttcttttcttaccattccccctaccactatcttgaattgtattttaaaatttcctttcttttctttatgtctccatgaacaatgtattgctttgtttacttattttgattttcatgtaatggaataatactgtaagtattctgatttcttttgtaagcatcatttttcttttgagcgttaatctatggtattgtatgcagttcattcagttttactgctatacattagttcattatttgtatatattgtatatatatatatatctgggctattgatgcacatttggattgtttctagttttttgctattactaagaatgctgcttacgaacattgttattcatgtcttttgtgcacatgcaggaatttgaagtatatgtctgggagcagaatttttcattttatggggtatgggtttgtttagctttactaagtaatgccaaatttttctaatttttaaaaatttttaattaattttttttttgagatggagtttctctcttctcccccaggctggagtgtaatggcacgatctggactcactgcaacctctgcctcctgggttcaagcgattctcctgcctcagcctcctgagtagctgggattacaggagcgagcaccatgcccagctaatttttgtatttttattagagacggggtttcgccatgttagccaggctggtctcgaactcctgacctcaagtgatctgtccacctccgtctcctgaagtgctaggattacaggcgtgagccactgcgcctggccaccaaattattttttaaagtgattgaatcagttgacactcccaactgcaatatagaagtattcctattgctctgtgtccttgccaaagcttagaattgtttctttaaaaaattttatggggccgggtgcagtggcttacacctgttcaaggccagcctggccaacgtggtaaaacccggtctctactaaaaaatacaaaaaaattagctggacgttgtggcatgcacctgtagtgctagctactcgggaggctaaggcaggggaattgcttgaacctgggaggcggaggttgcagtgagctgacatcttgccattgcactccagcctgggcaacaagagcgacacttcgtctaaaaaaaaagaaaaaaaaattatgtatctggtgggtaagaaatgttgtttcattgtaatttgaatctgtatttccttgactaccaatgaggtttagtttcttttcggatattcatagagcatttgtgttatttattctgtgaaatgtatttgtgtttcttattctgtgaagtgtctgtatatactttttgcccatttttctgtttggattgtttaatttttcctgattgattcatagcaattttttatggttttagatctaattctcttgttttttgagacagggtctggctctgtcacccaggctaaagtgcaatggtgcaatcttggctcattgcaacctttgctaggctcaagctatcctcccacctcagcctcttgagtagctgggactacaggtacgcgccactgtgcctggctaatttttgtattttttgtggagatggggttttgccatgttccccaggctggtcttgaattcgtgagctccagtgatctacccacctcagcctcccaaagtgttgagattgtagatttgagccacagtgcctagcctagatctaattctagatttgtgttgcaaatatcttttccaatttatgattggattaaaaaaaacttcggtgattgaaattcttgatcttactgcagctgaatttatcagtcttctatgatttatgttttaaaatttttttgtgtcctatcattaagataattctctattttctaaaagttgtttgcttttcacttttacattgaagtctctaatccacatggaaagactttttttgtaaggatccacttttatttttttgccatatgataacagataactgattgttccagcctatttattgagtagtgcattttttctcctgtgatctcagtgcttgcttgggtgaatattaagtgtcagtatatgcacaggctcagtttctagactctcagttcggctctctcctctagtgccagtaatccacttgattatttgtcctgattgtggttgctttataataattcttagtataaagtatggcaggtccccaaaagacttataataatgcctttccatattggttttacagtcagtttattgatttccgcaaaaaatgatactgggattttgaatggtattgcattgagtctttggatcaagttgggaagaattgattgacattgttatgatattgaggcttcctatttaagaacataatatgactttctatttattttatgttttaaaaaatcattccagttaagttttataattttctccttatataaagaacttctacataaaatgtcagtttttcctagaatatttttattatttatacatgatatttaaaaagttatattttctgattgtatatagaaatgaaattaacttatattttgtctttatactttttttttttttttatttaaagaaacggggttttgctatgttgcccaggctggtcttaaactcttggcctcaggtgatcctctagtctcagcctcccaaagtgctaggattacaggtgtgagccaccacatctggcctgtttttgtgctattactgacttatatctagattctttggggttatctatgtagacagtggatgatctacaaatagttgtagctttgtttctttatcttcaatctttttttttctctgtgcatctgttgagggcttttaatgttgaataggggagatgacattgggaagctatgtgttgtttttaattaatattttttttgtacattgacctcttctgtaccttgcacttctgttttgttttgtttggttttgtttttggaatgcagtggcgcaatcacagttcactgcagccttgatcacctgggctcaagccatcatcccacctcagcctcccgagtagctgggaccacaggcgtgtgccaccatgcctggctgatttttgtattttttttttttttttttagagatggggtttcatcctgttggccaggctggtctcaaattcctgagctcaagtgatccacctgcctcgacctcccaaagtgttaggattataggtgtgagccactgcacccagccccagggttgttgcttctttattgagcttgtcactcagtgccttttaactggggcatttagcccgtttacattcaaggttagtattgatatgtgtggatctaattgtgtcatcatgttgttagctggttattatgctgacttgttggcatggttgctttgtagtgtcactggttatgtacttaagtgtgttttttttagtgtctgataatgttctttcctttccatatttagtgctgctttcaggagctctcgtaaggtaggtctggtactaacgaattccctcagcatttgcttgcctgaaaaggatcttatttttcctttgcttatgtagcttagtttggcccaatatgaaattctgggttggaatttcttatctttaagaatgttgtggctgggtgctgtggctcacacctgtaatcccagcactttgggaggccgaggcgggcagatcatgaggtcaggagatcgagaccatcctggctaacaccgtgaaaccctgtctctactaaatatacaaaaaattagccaagcatggtagcaggcgcctgtagtcccagctactcgggagcctgaggcaggagaatggcgtaagtaaacccgggaggcggagcttgcagtgagcctagatcgcgccactgcactccagcctgggtgacaagagtgagactccgtctcaaaaaaaaaaaaaggaatgttgaatatagacctccaatctcttctgacttgtatagtttctactgagaggtccattgttagtctgatgggctttcctttataggtgacatgtcctttctctctagccacctttaacatttttttctttcatttctgccttgaagaatctgatgattctgttttttggagattatctttttgtgaaatattttgtgggagttctctttatttcctgaatttgaatgttgacttctctagctaggttggggaagttctcatgaatgatatcctgaaatatgttttccaagttgctgcctttctccccatatctttcagggataccagtgaatcatatatttagtctctttatataatttcatatttcttgggggttttgtttgttccttttcattcttttgtctttattcttgtctgtcttcttatttcagaaagccaatcttcaagcgctgagattcttttctcagcttggtctgttctactgttaatacttgcgattgcattatgaaattttttttttttttttttttgagacagagtagtgacacgatctcagctcactgcaacctctgcttcctgggttcaagcgattctcctgcctcagcctcctgagttgctgggattgcaggtgcctgccactacacccatctgattttttgtatttttcgtagagacggggtttcaccatgttgaccaggctggtcttgaacccctgacctcatgattcgcctgtcttggcctcccaaaatgttgagattacaggtgtgagccactgcgcccggccatgaaattcttatagagtgttttttagctgtatgaggtcgtttatattcttttctatactggctattttgtctgtcagctctgtatcgttttattgtgggtagcttccttacattgggtttcaacattctcctgaatctcaatgattttcattcctatccatattctgaattctgtttctgtcatttcaaccatctcagtccagttcagaacccttgccggagagctagtgcagtcgtttgttttagaggaaagaagatgctctggctttttgagtcatcagagttcttgtgttggtgctttgtcatctttgtgggctgatgttccttcagtctttgaagtcgctgtttttttttgtttttttttttttatcctatatgatgaccttggatgtttgtggtacaaggtaggttcagttaactggcttcattactggaggggccagggctcatctcaggactcccggagtacatgggtcctccaactctgggggactggcattgggccccagctttgttctctggttctttaaggttaggaacctgctgcactggaggggccgaggtgctcctggacctctggtcacaatactcccgtgggttgtgccagccaaagtgtagggggtggcagtggaatcaattcttgttcgcatgtgccagtagcagtggcagcaaggccacagggtgctggcctccatgtgggcattggcagcaacagtggcagtaaggccagggcggggggctgctggtacacatgcactggtggtggtgttagcacaggggcagggtgctggtgggtgcaggactgggtgtgccctctgtgcacgttcatgctggcttcagtggccggtaaggggtgggggtgggtcctctgttttctctgcctagtttcatgttggtgcaggggctcagtgctggtggggatggcactggtgggctctgtacctgccagtgctcccttgacaatggccatggagggataggcagggtgtactcacgctggctgcagtggcatgggagggtgcttgcacgcatgtgtgctggcggggaagggaaaacaaggtacacctgtgcacacgtgtgggcaaagcatttggagggtggccatgggcgagtgcctgcaggcaaagcagcatggagcagccttcggtgggaggagggtattggcaggctcgtgcttttccacagggatcactgtggttggagcactctgcctgtcagcaccttgtcagtgcaggagctggtatgtggccccccccggcagtactgcaagcatcctggccaggctggagccccatgagagaccagcagactgagggtactcaggtcacaccacccccaccttatgggcaagactgccctgcagagttcaggtctggcagttcctctagggctaaagtctcctatgggagcaagtcgagccttgggggatgggcactcctggccctgttgcactacagatgctccagcaccaaaacctctgagctctgccctggctggagttctgcccctaccacttctctaagcagctttccctgccagctcaagtgtccttggtggttgaggggtctccttgtggtggaggagtctccttctgcagggattccagagtcccctggtgagagtgggttgctgcttccctgttcaactcaactgcctcttcaggagtcactgggggccaggaaaaagtcccggtgcgtggtagccctgtgcagggttccttacttcttccctcgtcagttcagcatctgtgtcttccctctgtcagcactcagtgctttccctctgaagatctgctaagagtgtgccagtcatcctgatcctctgggagatgttcctactggctgcagctagttggccatcttggagccccctccctgtggcttttcatgatttctaataattacattgatgttacattctgtgggctgttcttattgaaatgtataaatttaacaaatcagttgttggtgtaaacttgctgatattttgtttaggatgtttgtatctatgagtaagattggtttgtaattttcttatatagctgttgtctggatttcatatcaaggtgattctagccttataaaatcaattggggagtttatataatctatttaatctctgtgttaactgaagttgtgtctaatatttcacccctaatgtttatttctttattttttcatgtttttttttctgtttgtgtatttcgtttttatttttttgagacagggtcttactctgtcatccagactggagtgcagtggtgtgatcactgttcactgcagccttaacctcctgggctcaagcagtcctcccaccttagcctctcaagtagctgggactacaggcacatgtcaccatccctagctaatttttaaattttttttgtagagacggggtctcaccttgttgcccaggctggtcttgaactcatgggctcaaatgatcttctttcttggcttccaaaagtgctaggattacaggcgtgagccactgtggctggcctcagtgtatttttaaagactcatttctaggccagacttggtgggtcatgcctgtaatcccagcactttgcgaggctgaggtagatggatcacttgaagtcgagagtttgagaccatcctgaccaacatagtgacaccgtttctactaaaaatacaaaaactagctgggtgtggtggcagacgcctgtaatcccagctactcaggaggccgaggcaggagaatcgcttgaacccaggaggaggaggttgcagtgagtggagatcatgccgctgcattccagcctgggccacagagcaagacttcatctcaaaaaaataaaaagactcatttcttagctttttaaactttgttttctgttttgttaattttgttgttacattttctttccttgggtttattctgctatgcatttttcccctaactttttaatgttacttatttatttattttttgagacggagtttcactgttgttgcccaggctggagtacagtggcgtgatctcagctcactgcaacatttgcctcccgagttcaagtgagtctcctgcctcagccacccaagtagctgggattacaggcgctcgccaccatgcccggctaatttttgtatttttagtagagatgggatttcaccattttggccaggctggtctcgaactcctgacctcaggtgatccacctgcttcggcctcccaaagtgctgggattacaggcatgaaccaccgtgcctggccttaatcttatgtttaaatgtggaaaaatgcacataacataaacgttaccatcttaactgttcctaagtgtatagttcagtagtattaagtacattcaccttgttgtgtaaccaatctacagaactcccttcatctcaaaaaactgaaaccctttactcattaaactagaacttcccattcctccatgttcccagccactggaaaccaccattctactttctgtttctatgaatttgactaccctggatacctcaaataagtggcgtcatacagtatttgtctttttataactggcttgtttccgttagtgtaatgtcttcaaggttaatccacattgcagcatatgtcagaatttcctaccttttaaaggctgaataatattctgttatttgtgtaaaccacattttctttatccattcaggacatttgggttactttcaccttttggttattgtaaataatgctgccatgaacatgggtgtgcagataccacttcaagaccctgctttcagttcttttgcatatgtacctagaagtagggttgctggatcatatggtaattctatttgtaatatgttgaggaactgttttactgttttccataggtatatgcactattttactttcccatcagtagtgcacaagggttccaatttctccatatcctcatttacgtttgttattttgtgtctttttttttatttttttgagacagagtctcactctgttgcccaggcttgaatgcagtagtgtgatctgggctcaccgcaacctccgcctcccgggttcaagcgattctgctgccttggcctccctagtagctgggactactggcacctgccaccatgtctggctaatttttgtatttttagtagagatggggtttcgccatgttggccaggctggtcttgaactcctgacctcaagtgatctgcctgcctcggcctcccaaaatgttgggattacaggcatgagccactgcgtctggccttatttcatgtctctttttgatagtagccatcctaatgagtgttaggtggttttatgactttttggtttttttttaatagaggtttttgctctgtcatgcagactagagtacagtatcatgagcatagctcactgcatcttcgaactcttggactcaagcaatcttcctgccttagcctccccaaagtgctgggattataagtggaagccactgtacctagcacgttttctgacttttagagttatatttaagctcatcagttttgaatatttcatttgattgtaagtattcaaagttataaatttattaaatgctgctttaattgtatcctacaagtttcaataattggctttttatttttcaatttcatatttccatataatgttttcaattatgatttctcctttcacctagagtgtttcatatgaatatgaaacatgttatggtttatatgttaccagtaatttcaaatttgaacttagctttatgaccttgaacatatttattagttatttattgttatgttataaattattcccaaatgtagccgttttgtacaacaaacatttattatcacataaagtttctgtccatctgaaatccattagtggctgaactgagtgtttctggctcagagtctttcatgaagctgcagtgacagtcttggctgggtctgtagtaatctgaaggcttgactgggggtagagcatttgcttccaagtaaattcacttacatagcttttggcaggaggcctcagttctttgctggccatttgtaagaggtctcagttcctttctacttgggcttctccatctggctgcttgtaatgtggcagctgacgtctcccagagtgagtgatctgagagaatcaaaagccacattctttcatgatccttagaagttacataccttcctgcttgccgtataatattggttatgcagaacaacccgaataccagatgagagaggatgacacacgggtgtggatatcagaatgtaggaatacttgcagaccatcttggagtctggctaccataagcatacagtccatttttataaagttttcatgtcttcttgaaaatgatatgtagtcccaagttcttgagtgtgatttttacataggagtttgatcaagtttattaagcagttcaactcttctaaattctgattcttttttgtctgctagatcttactactgagaaaggtaagttaggaaatctttcactgaattagtatgtttatgcttttttcttgcagatgtgtcagttttgtgtgtgtgttattaggtgcatagaggcttacaatatcttacagttgatttgagtcctgtatcatcatgtagtgcccctcttgatctctagtcctttttatcttagtccactccagttttctcttgtttctatttgcctgatagatctttttccatttcttaactatcaatatttctgtgcctgtatgctttatgtttgtctcttataaacagttcatgggaaaccagtctgatggtttttttttcttctgcctggagagtttagttcatttacattcattgtgatgactgacatctttggattcctttctgccattttctttttaaaatttaatctaattattattacttttttgaaacaggggtctttctctgttgccctaacttgagtccagtggtgtgatcatggctcactgcaacctctgtctcctgggctcaagtgatcctcccagctcagcctcctaagtagctggaactataggcatgtgccatcttgtctagataattaaaaaacattttttttttttgtagggacagcatcttactgtgtttcccaggggctagtcttgaactcctgagctcaagcgatccacctgcctcagcttcccaaagtgttgtgattacaggtgtgaaccaccacccccagctctgccattttcttatgtgccttttattcaactgtttcatttttttaccccttgagtctcagaatttacctctgggttcattttacttctgcttgaagcatattctttagaatttcttttgatgagggtctgttgcagtaattgctcttactttcctttctttgaaaatacagggccagcgcggtggctcacgcctgtaatccgaacactttgggaggccgaggcgggcggatcacaaggtcaggagatcaagaccatcctggctaacgcggtgaaacccccatctctactaaaaatacaaaaaatagccaggtgtggtggtgggcgtctgtagtcccagctactcagtaggttgaggcaggagaatgacgtgaacctgggaggcggaggttgcagtgagctgagattgtgccactgcactccagcctgggtgaaagagcaagactctgtctcaaaaaaaaaaaaaaaaaaaaaggaaagaaaatacagtagtctccccgctccccccacaaccacttatcagcagttttgctttctatggtttgttgcccacagtcaactgcagtctgaaaatgttaaatggaaaattccagaaataaacaattcataagtttaaaattgcatgctgttttgagtagtgtgatgaaatctcacacagtcctgcttcgtcttacttgggatgcaaatcatccctttgtccagtgtatccacactgtgtatggtacctgcctgttagtcacttagtagccatctcatttatcagattgactgtcatgatattgtagtgctgtgttcagttaacccttattttatatagtaatggccccaaggaggaggagcagtgacgctggaatattgttataattgttctttttttaaaattagttattattgtcgatctcttactgtgtcttataaattaaacttttttataggcatgtatgtgtaggaaaaaaacatagtatatatatagggttcagtactatccctggattcaggcatccactggggctcttggaacttatgccccatggataaggggagactactgtatctttatttctcccttattcttgaatgatagttttgctggatatatagaattctggacagttatgtttccctcagtatgttaaagatactatttcactatctgtctgctatcatagccattgagaattcagttgacataattgcctttattttataggtgacattttctctccagttgtttttttaggtctcctttttgttgtttgttctgtagtttcaccaaaatgtttgtaggtatatggatctctattctgctttgagtttttggacttcttgggagtgacatttgttgttgtctaacagttctaaaaagccattaccttctcaaatattgtttcttttctgtatttctattagttttcttctggaactacaattagatgtatgtaatattgtttgaggctgagccaagtagtgtactgtgattaagtttactttctggtacaactttttgtgtctcctaaatgtaatgtctcatttagcctcatttttttcatttgcttcagtttttatgtagctattgttatttctttccatcattaacacgttctcagtacagtttttcacatagggtcaaacctgttaatctgttcagtgtgaccattttccttgaggatttcctcccatgctagtgtttagaattggctgcttgctataccaggtgtgcagctatcatcctgtgttctcccttcagcatcattttggaaattcctattgcttgtctcctgtgttgattcccttgttttgtggatctcattcatttacaacacaccttccactagcttgctggaaaaaaaaaaaagtacaaaggagataaattttgagaccttgaatgtttgagaatgtctttattctaccttttttgaaaaaaaaattgataatttgtctaggtcttaagttctaatatgaaataattttttttctcagaatttggaaagaatttctccattgccttttagtttatcactgagattattgctaaccccaatgccattctggtttctgttacgttgtcatcaatctgtttattttttcttttctagaatccttggaatttttttttatttgtccttgctattctgcagttcaataataacatgttgggataccaaatgggtcttacttagtttagagactcttcaagtctggaaaacttcttgtgttattctctggcaacgtcttcctatcttatttattaatttttttctttttttcacatgttggaattgattactcatgtaatgttttacatttttttctttcatggtctttcttttgttctttttttgtagaaaatatcttgactttatcttccaactctttaatgttttctttctttctttcttttttcttgagacagggtctggctctgtcgcccaggctggagtgcaatggcacgatctcagcactctgcaacctccacctcccgggttcaagtgattctcctgcctcagcctcctgagtagctaggattacaggtgcctactaccacacctggctaatttttgtatttttagtggagacaaagtttcactatgttggccaggctggtctcgaactcctgacctcaggtgatccacccgcctgggcttctcaaagtgctgagattataggtgtgagccactgcacctggcctgctctctctattttaaaaatagcattctttagtttttttttttttttgagtcagcgtctcgctctgttgcccaggctggagtgcagtggtgcaatctcggctcactgcaagctccgcctcccaggttcacgcaattcttctgcctcagcctcctgagtagctgggactacaggctaattttttttttttttgtatttttagtagagacggggtttcaccgtgttagccaggatggtctcaatctcctgatgtcgtgatatgcccaccttggcctcccaaagtgctgggatcagaggcagcattctttaaatttttaagtattttttaagatactaataatttaccgtattttgaagttttcttctcattcttcattatcttttttctcaaaattaattgtgtgtacttggttctttttctttcatgttaataaggtttccttatacctggtgattctgagctgttttcactttaaatatctaagttttgtttgtttgttttttgagacagtctcattctctcgcccaagctagagtgcggtggcatgatctcagctcactgcaacctccacttcccaggttcaagaaattcttgtgcctcagcctctcaagtagctgggattacaggcatgtgccaccatgcgtggctaaattttgtatttttagtagagatgaggtttcaccatattggccaggctggtctgaaactcctgtcctcaagtgatcggcctgcctcggcctctcaaagtgctgggattacagcatgagtcattgcgcctggcctactcttagatcttaaatgttttacacagacacacacacacacacacacacacacacacacacacacggtaactgtgatgatggatgtgtcagttgatcgtggtaatcatttcagaatgtatacatctattaaattatcatgtagaccttaaattattatttttgtcaattatacctcaagctggaaaaaaatgcagatctactcttaaatgtgagataattggaagctcatgtgcatgggctagggtaagttggtggagaactaactttattgttggaggctttctaaatgtatgtcttttctttgaacattagtttgttccagaaaatattgcgtggttggttgcctgggaagatgtatgtctgattttcggacttggaagcaagataaaggaaagaggctgctggtttatggtatagagattttcactcgttaagaaagtaacaaagtaaggaagtaggattattgtagaaatattattttacagttcaagtttgtaaaacacaggtgaaggtaatcgttggtgggtctcttcctctgagatcaccaaattatctgtagactggttggtagacttggagagaccacttgttcttggacaacagttagaagcatactgccctaagcagtaaaaaggtgattgttgagggcagcaagaggcggtgtaacataccagttcatttttcttttcttagcaagcatgtactaattgccttttaaaactcctgaccataggggataaaacgattacaagaaagataccttccctgctcccatggaatttacattctagcacaacagtggatattaaacaacgtatcatctggttatgtaattacagtaataagaatcatgtaggagaggtcaaggaagcttactgctgtggggttcaggatggcatctccgaaagtatgaataaggaaagtggtgggagaataaaaggagagtggcagagactcagactgagagattaattgagataatgacaattgtgggattcaatgaggtgtataatgtgtttagtgcctggtacttgtgctcagtaagtgctaattagtagttgtttatagcaatactgttatcttggatgatcaaatagaagatccctagcaagtaattttataaagacaaaaatttcgtgtcaactctgtaataaaacaatatatccttagaatcagttatcacttaaaatccttattttatagaaatttttgtgtttcaaaagtatagctagggcaagtcccccttcagggtggatacttaaaggagatgaaatcacttcataaaggtgtctgcactcccatgttcattgcagtgttatttacaaggtagccaagatatggaaacaacctaaatgtctgttgatggcaaattgataaagaaaatgtgtgtgtatgtgtgtgtttatacaatggaacgttattcagcctttaaaaagaaggatattctgtcatttgccacaacttggttggaccttatgctaagtgaaatagaccacgcacaaaaagaaaaatactatataatctcacttatatgtggaatgtttttaaaaagtcaagtatacggagacagagaataaaacagtggttaccttgggcaggaggaggaaggaaatggggttatatagataataaaatagcagatatatagaatgaagaagtctggagagcttatgtataacatgaagactatagttaataaaacaaaactgtattaaggatttttattaagtaatttagctgcttgtaacacttacacacacacacatagtaactatgatagatgttttcactgtagtaaccattttgctgtctatacacatcccaagatatcagcttataaatctcatatacacagatttttttttttaaaggtattgttggggcagggatcaggcttaactttgtggttgtatctgtagtacccagcacagtgcctgacacatagaaggtgttaatcttgttttttttttttttaggtatctgaaatacttaccagaaattctattctttcagatgagagacatctatgtgattttaggtattaataaaagaaatattcttccttttttcttactacggtgttggtagtggtgctctttcttcagggacatcattgatggccttttagttagaatttaaatgttatcctttctgtagccagcagggatctgttgggataaagtcttatttttcttttcttgggagtaattggtgctttctaacttttcagcacttagactcacaatgtattagttatctattgctgcaaaacacattacttcaaaacttagcagtttaaaacaacagacatttattatcccacagtttctatgggtcaggaagataggggtaccttagctggatgcctctggagcacggtctcttgaggttgcagtcaagctgttggctggggctatatcatctgaaagctttactggggcaggggatgatgtacttccaagttcactcccatgattgttgggaggaggacttaattccgtttcttgtgggcttcttcctggtttatgtttgttacctggtgtctagagctgatgtattgggtacttcccctctagcatggttattttctttgttttttctctcatttaggtgaaaacttaggtgaattttaatgtaaaccctacccccattatggtctaaggggccttttagaaaatgagtagaatgtacacagaggcaaaaattttagcctgtgaccttttgaagaattttctaagtgaaactagaaacaaattaaccattgttcacagagtgctttgcttaatgttatgccttcttttgctaaatcctcttgtttgttgaaatcttacatcttaagttgctgatagtttgttaatagagatcataattaaaaggtgattatatttcttcatgcagtttagctttacatttcttccattatacccaaagatttctataatatagcaagaaatgtttttaaaaagtgtttttcctcaattgtgtgaaagtaatgtatctaactgaaaagaagagaaactcataaaagtaaaaattttaaaaaatcaccttattcttacctctcaaatacaatgacctcatattttaaattttgctcaaggttttttcctcctcattctaggcataattattttcttatatgtgtttcagtattactttttttgtgaaaaatatggttacaaatgtggtctaatttcattttgcactttaaaaattattaatgaggccggaaatgaggccgggcactgtggctcatgcctgtaatcccagcactttgggaggccaaggtgggcagatcacgaggtcaggagttcgagaccatcctgggtaacacagtgaaaccctgtctctactaaaaatacaaaaaattaaccgggtgtggtggcaggcgcctgtagtcccagctactcgggaggctgaggcaggagaatggcatgaacccgggaggcggagcttgcagtgaaccgagatcgcgccactgtactccagcctgggcgatagagcgagactctgtctcaaaaaaaaaaaaaaattattaatgagatggtcatatttttatgttatttactgatcacttacctttgaattgccccttgtttcttgaagtttttccaataaatattcttattaataggcaagacaacctgatctgttagttatgtaaactttttggtagctaattgtatgtgcattcttttacctcccgtttgtttctttattagcagtgtctttttgttatagaatttatacattttcttgtaagcaaatatcagtgtttttattataggtgctgtatgtttgtcttgcttaggaaaatctttattactccaatattattaaattattctttagtatttgtcctaatagctttatggctttgttttttttaaatcacacacacacactcacacacacacacggacacacacactctttgagacgggtcttgttctatcacccaagctggagtgctgtggcgcaattatggctcactgcagcctcaacctcctgggctcaagatatcctcccacctcagcctcccaagtagctgggactacaggtgcataccaccacccccagctaatttttaaatgttttttttgtagaaacagggtctcactttgttgcccaggctggtctgaaactcctgggctcaagtggtcatccttcctcagcctccccaaagtgctggttttacaggcatgagccaccacacctggcagcacccatatattttaaaatttagtatgaattagtcttttctttttgatgtggcataattgtattgactaatccattctttaccattgatttgaaataccacctttattatattaaatttgtgtgtgaatatgaatatcttttctgtgattgcaattaatttgtacttgtacagattgtgctgtaagagcttaacagtatatttcagtacttggtcatgtctcttgttcttgtttttcttttcttttcttttttttgttttgttttttgagacagagactcgctctgttgcccaggctggagtgcagtggcgcagtctcggctcactgcaagctctgcctcctgggttcatgccattctcccgcctcagcctcccaagtagctgggactacaggcgcctgccacgacgcccagctaatttttgttgtatttttagtagagacagggtttcaccgtattagtcaggatgatcttgatctcctgacctcgtgatccgcccgcctcggcctcccaaagtgctgggattacaggcttgagccactgcgcctggccttgttcttgtttttcaaaaatttctttggtattctcacaagtttattcttccaaattaacttcagaatcagcttaccattttaaataagcaccccccttctaaatctattataacatctcactactttctcttctattcatattagcttaacttaagctaccatcctctcttgagtaagactgttttctaacatacagcaacaagagggttctttttaaaacataaatcagattatgtcattcctttgcttaaattcgttcagtgcctttttcccctgtcttttggttatctattgctgtataataagctactccaaagccttgtagcctaaaaacaaccattttattgtgctcacaatttttgggggtcaggaattcatgacaggttcagctgggcagttcttctgttccatattgtgttgctgacactggagaatcccttccattatggcttcttcagtcacatgtctggctcctcagtgtttcttggcctctctctccacaatggcgtcccattcttcagaatctctgcatgtggcctcggcttctcacagcatgctgatctcagagtagtcccattttttacatgacaactggcttctaggaagagggaaataaaaactgtcagaccaattaaggactatggcctggaactacacagtgtgcctttaagccgtattttattggtcagaatagtcactggacctgctagatgaaaggaggtagaaaaataaatttcttttcctaatgagggagtggcaaaatcttattgcgggaaagcatgtgggatgagagatacttgacagttggaaaatataatccgtgacatcgtcaaattcaaaataaattcagagttcttaaaatggcctataaggcttttcatgatctgactcctgcttcttgaatctctgaccgcatcccctagattttcctcttcgttccctttgggttaaccacattggccctcttgctaggctttgaacatgccacacccaacatcagatccattttacttgcaactactgccgtgaatgctcttctttagatctttgcatgggtcttcccgttctcattcattcattcattttgagacagggtctcactctgttgcccagactggagtgcagtggcacgatctgggctcaatgcaacctccgcctcccgggttcaagcaattctcccacctcagcctcctgagtagctgggactgcacgcatgtaccaccatgcctggctaatttttgtatttttgggtttcacgaggtttccccatttggccaggctggtctcaaattcctgacctcatgtgatccgcccgcctcagcctcccaaagtgctgggattagaggtgtgaaccactaatcccatggctggtcttcccatttttttacttcatttaggtctctgctcaaatgtcacatcttcagagagcttcccctgaacaccttatctgataaattcttggttacttagaactccttaatcttgatttttttttccttttcatagaatttggtgctgttagtaggagcctggggggcctaagtaccacttttcttccttccctgcctggcttctgagcaagttgagaaatgagtaaaggtggaggccaaaatatattttaaaaattcttctgactaaagggagatgaagtaaagggaacaaaagaagtatcatgaagattctcagatgtccgacatgggaaactgggtagattgtggtactatttaccaagacaggaaacatggtaggaagattatgaattaagctttggaaatgttgagtttgaagtgcctacaagttatccatgtggagaaaccaaatggacatttggataacacatctgaagctcaggagagaagtttccattacagattcaggtttggtagttgttctagttttctattgctgtgtaacaaactaccacaaacagtagcctaaaacacacaaaattactatcttacaatttctgtgggtcggagtcaaggcattgcttagctgtgttctctgctcaggttctcatcagcctgaaatcaaggttttggttggggcctcagtcttatctgaggcttggggttctcttccaggctcattggttgttggcagacggttcaggaatctggggagacaagatttttgggagcgccaacccagatgtttccattccatgtgtcagagtcttgttctttcctagccaggcccctgatctggacgtaggagacctgctgcctttgggagttcaacctttgaagcccaacacatacagatttagatatctaatctgtctgtccatccatccatccatccatccatccatccatccatccatccatccatccaatctgtatatctctgagatatataagtgtaataaatgggcgataatcaagtgctggttttggtccttaggtttctctgccctcctgctgcaggagaggagaatctctgtgttttcagagaggttctctggctttcaaacttagttttcaattggaagttaatcagcttttttgtttttatcttttttctttgaaatcaacatctgggagtgaggagcactgggcaaatgcagtgcaggcccagcaccagctttggccaacccccacggggagcctggagcgagaatgggagcctgggacaagaatggctcttctgagttgcccagaattgcggtggctgatgtgtccaggccttcatattgccatatcaattagtcatttgatgtgggttatcttgggaaggatatgaccttgaacagggttgttccttgtaggtgaggcaatccctgaaggggctgactgacagcactcccagcatttaaggtaagtccttttttgaaggaggaactgggtagcacctcagtgtctaccacgatttctctgtatccaccaaatggccaatttgtttttgttttttattatcattattcattcatggatttaaacatatatttagcaaactttctgttaaattatgtgtatagaaaagggcacaaattgtaaatatacagctcagttaaatgttcacaaagtaaacacaccagtgtaaccagtatccagatcaagaaataaaacaatactgtgaatctaggagtcctcctcgtgtttcctttcagtcactgttttccagggatctatcctgacttctaaaatcatgggttgaatttagcatggttttgaaatttatgtaacatcatacaatatgtcttgttctgacttctgtctgtcagtattgtatttgtgaaattaagctcacaattgtaagtcattctcttgctgtatattttttcatggtatgactataccagtttttaaaaaccatttctgctattaacatttggattgttccagttgttgggaattataaaacatgctgctgtaaaacattgttgtgcatgtcttttggtgaacatatatacatttctgttgggtatatatctagtgaaattgctgaatgtgtgtgtgtgtgttcagttttagcagataatgccagtttccaaggtaagtactgagttacatgcctactagtagctcctaagatttccagttgctgtaatttgctcctgtttgtagaagacacagccttcgagggcttatcactgagaactgtatttactaaggtctccactagcagattctgaactcttttgtcctctcgaagctgcaaggctttcaaattctgctttgcttttcagaagtttttagtttagcctttttaccctcttccactcactgaggcatttgagattccctcacgtcttcagttttgccaatctagccctcagtgaacaccagaatctctgatggtttcttcttccattagaggtacattgcctgggaaaaaagccttatttctcaatctgttttcctgaccagaatctgcaaatgccccaggggaaaagcagctgcagaagatccccttacctcattatagctcactctttttggaatcttagtgttgctaatccctattccttcagtagctctctgaattcttcaaacaggtgatttttatatttcatcttttgttagaaattaagtttgtggtgggagctattgttttgcagtaaattattctatcctacatggaaacagtagtatggatttaaatatatttaatatgtttcaataaattgccatccttaagtgttcaaattattacacttttggccagtgggggcctctttaaaattcattcctaaccatttttggcttgaccgttattagtcagtgctgctatctggtatgacaagatgttccggggtcattatgtcttttttttttttttttcctccagacatagaagcagccatttcctaaaggagtccagattccttttactgggaaatggtcgttcaagattacaactgagtgaggattactatgggattggtcattagtcattactatgggattggtcattgtttctaggcattttcattggacagaaatagaaatatgttttttaaagtacaaaataaaatatcttgacttcatatagatacttctatttcaaattcaagactacatttctttactttaccattacttttatttcccatgctgaaagtcttgggtttttagaggcactaggagtcatagaattaaaataccacagaattatttagttcctctctttataccattaaataattagatacatttataccattaaagaattagatacagttttcagttgatttgtttatttttgatttctagacttcttaaaattttaattttatgtttatgtaagttacgtagttctaaaatgaaatctacaaaaacaatatgtattccatatagaatatggattctatccttttcacttctactttcttttcatttcctaaaggcaaccactaatttttttgagcatttcattcttctactgttttgttttgtttcttaatataagaaacatatatttctatctcctccctcttcttagatgaatggaacatactgtgtatattttctccatcttgttttttttttaacttaagatgtgtcctggagattattctatcatttaatgaatttggattcattttttggttttacgttacattttatacatgtcttttatttaagtgtcactgtgttcatgttatttgctctttcagcatatataaatatatacacttatatacatgtacacacacacacatacacacacacacacacacacacattttttgagacagagtcttgctctgttgcccaggctggagtgcagtggggcttagctcactgcagcctctgccccctgggttgaagcaattatcatgcctcagcctcccaagtagctgggattataggcacgcgccaccatggtcaactaatttttttgtattttagtagagatggagtttcagcatgttggccaggctggtctcgattgcctgccttggcctcagcatatatttttgtatttagaaagatttattcagaccagcgttcatactgtgtaatgataaggaatttattgtagaaattagattgtatacagttttgaggggactaagtgaggtgagtatctggaatggggaattggaggatcagaggagtccactaaccagatcgtccaaatcaatgacaatgggtagataagttggagctgttggggaaatctgagaagtcaaatatatccagccactgaagtgagattatgaaggaggagcttgaggagggcactgtgggaagctcttgccatgtaaggtttgtcttacaaagccctgtaggtttgcacccaagcatctggtggtaggtttgggctagtattggtcagcaaagtgaccactggtccaaagaaagagctggacatggagtgaaagagagagagagtaaaagctggaactttctgggtgcctctgtatctgtctctcattgtatgttactgtgaaaccttcagaataatagctgctgcttcgcttccacatttcaaacaaattttatacaggtcgagtatcccgtatctgaaatgcttgggaccagaagtgttttggatttcacatatttttgggttctagaatatttgccttttactcaccgtgatcatccctaatctgaaatgagcatttcctttgagagtcatgttgttgatcaacaagtttggattttagagtgttgtaggtttcagatttttcaattagggatagacagcctgtacaaattaccctttagaccaactctaaccagaaccatatagtgagtgggatctgggaaagtagttcccagcttaacagttaacacaccacgcaccaccagtacaatttgtgtttttgttctggtggttaccattatattaatacctttatatggtattctaatttccttctcttttggggtggaggggtattatgtgttggttttttactctgagcaatattgaaatgaactagaaacctcctttcctcatctcctttttccctagcattttactctcagttaataacaagacaatcaagaaacatattctactatttatatgctctcaccaccctccctctcctcattttgataattgtattgtatctatattatcaagtacataaagcagtcacctaatatactttctcccttattgccaccattctcagttcttttagaaaacacagtgatgctccggctgggcacggtggctcacgcctgtaatcccagcactttgggaggccgaggtgggtggattacctgaggtcaggagttcaagaccagcctgaccaacatggtgaaaccccgtctctactaaaaatacaaaaaaattagccaggcaatggtggtgcatgcctttaatcccagctactagggaggctgaggcaggggaatcgcttcaaccttggaagcagaggttatggtgagctgagattacgccactgcactccagcctgggtgacagagcaaggctctgtctcaaaaaaaaaataaataaataaataaaaatacagtgatgctccacataatgacattttggtcagtgatggactgcatatgtaatgggagtccctcagtattataatatggtatcattaccttttctatgtttagatacacaaacaccatgtgttcaagttgccaagagtattcagtacaataacatgctgtacagttttgtaccctgtataccatatagcctagaggtgtggcaggctatactatctaggattgtataagtacactctgtgatgttcacatgacagtggaatcatgtaaggacacatttctcagaacataccccatcactaaatatatttaatgattcctattaatgtggatgtctttccaattattctggtcatctgaagcatattctctagtatatcctccaggaaaaggaaaagggaacaaaatttccagggttcttgccgtttagcacagtttgtcattgctataaaattgtctctcagtatctgggacattggttccaggaacctccatggacggtgaaatctgtagatgctcaagtccctgatatgaaatggtgtggtatttgcatatagcctacacacatcctcctgtgtactttaaatcatcccttgattactgataatacttaatacaatgtaatactatataaatagttgttatacactattatttagggaataatgacgaaaagtctgtacctgttcagtacagacatactaaaatttattttttgatctgcagtttgttgaatgcatagatggagaactcatggattcagagggctgactgtatttgaattcagtttggctagatataaaatccttggtttatgttttcttctttttttaattatactttaagttctagggtacatgtgcacaatgtgcaggtttgttacatatgtatacatgtgccatgttggtgtgctgcacccattaactcgtcatttacattaggtatatctcctaatgctattcctcccccctccccctaccccacgacaggccccggtgtgtgatgttccccttcctgtgtggtttatgttttctttaaatatcttaaatttattttactttattgttttctgacataaaattttgtcaaagtctgatgagagtctaatttttgggttttttttgtataaataatgtcctctttctgcctgtaagttcaaaagattttttttttcttgttcacggaagttcaaaatatgttaaggtattggtcattctgggtcacttttccaggtgtgtggtatgcacattaaagatacagtttcaagtttttaaaaatttcaataataatttcagcaaagttttcttgaattctagtttctaatatccactttattccattggtttggtttctttctttggtgactcctgttatatgtatgttgaatcttctttttctatctttttttgtcactttattgtaaatttttattatctcgtatgtaatttcttttttatattacaactttcctccttagtccccccttttttttcaacatttgtttactcttaaagcattatcttctgtgttaatttactcttatgtatcttctggttagttttcatttctgaaatgatttatcttctaattctttcttgagttctgtcaacttatttctatctgtaattcttatttgtgttattccacatcttttgtcattttcttaatttctcttggctcactttgaaataataatttacagttttcatctgttggtggatatgtctttttggaaactttgattttctgttgtttagacccttatttttatgtttttctgtttcttactcctttttcttaataataactttacatattatttgaccatagaacttttctgttggcttatttttatgtgaaattaatttttctgaattggtaggagggatttgtaggccaggatagctttgtagctttatgtctctagagcttattctttttttactttcatgaaataaaaaaaaaatggtctcattctttcagagatctcttgttcatctctctctttttcatttttatttggacctttttccttttctccctttacccctgttttcagtttggagttcattctcagcagtttcttctcagtgtgggctagaactgtgctgtccagtcagatctaataattacatgtgtggctacttaaagctaaatttaaataaactttatttaataataacttaaataaactttaaacttttgatttcttgtctataccagctatgttacaagtggttaatagctacatgtgacgactagtggctgttgtattgggcattgcccatgtagagcactatcattaccacagcaaatcctattagacagtgatgcttttgagtgtgctccattctcttgagacttttatcataggcctttttcattcatctgcaaattgcaatgagcataactaccctctgttttggctaatattcctaaattgggctgctgtgctttttattaaggatgcagtacattgggaatctcctcttgtcagatccattagacattctccttccacctgctttctcttgcatagatgcttataccacattagtatttttgttttttgttttccagacacaggatctcgctctgttgcccaggctggagtgcagtggctagatcacagcaactttctgggctcaagcagtcctcctgcctcagcctcttgagtagctggattacaggcacacactaccaagcctagattttttttttttttttttaaagtaaagatgaggtctcactctgttgcccaggctggtcttgaactcctggactcaagcagtcctcctgcctcagcctctcaaagtgctgggattacaggcatgagccattgcgcatgtccccaaccagttttgtaactataaatggtttgtttctatttgttcacttctctgggtttgggaatgagggaccttgtcccttcattttcatgtagatattcatcagtttgtgtttttactagagaagttctagtttctttgattttttttttttttttttttttttttgagacagagtctctgttgcctaggctggagtgcagtggtgcgatctcagctcactgcagcctccacctgctgttcaagccattctcgtgcctcagcctccctagtagctgggattacaggcatgtgccaccacgctcggctaactttttgtatttttagtagagacagggtttcaccatgttggccaggctggtcttgaacttttgacctcaagtgatccacctgccttggtctcccaaagttctgggattacaaatgtgagccaccgcacctggccatttctctgatttttatgggatacttagggagattcaccagctgcattttatgaaaccctagttcaagaaacatactggaaaaggagatatggtcacaaagaataggagatgtttctaagggaaataataaattaaaatgaaagttacagtgacttgtgctcactgaatctaaaacccagctgattaaaaatttggcaaaataaaattaaaaaggttatctgtgctcgtaaacaaaagtcccatttttggcctttcaggtttttttcctccataatctttataattaacattacgaagttctgtagtttctgttctgccccctcctttacactctaaaaatgctgccccaccccgccaatttcatttagtatttccttttttttttttttttttttttatttgagatggagtctcgcccgatcgccaggctggagtgcagtggcgtaatctcggctcactgcaatctctgcctcctgggttcatgccattctcctgcctcagcctcccgagtagcttggattacaggcacgtggcactacacccagctaatttttgtatttttagtagagtctgggttcaccatgttggccaggttggtctcaatctcctgacctcgtggtctgcctgacttggcctccgaaagtgctgggatgagccaccgtgcccagcctatttagtatttctttactatcaaaataatcgtccattattaactgatttagcaaacttgggcatgcccctcggtctctttccacctttagttgtactatgttaaaaatgagaaagttatattcaggtttgtttttttcacagaggaacattgctaggtttctctgttagcattagcagggtttaatattaacagtaagtatgtccatgatgctttaaatacagaatgctatttttgagcagagtagagatgaacttctagacagtggaacttaactcattcacagagaaatgtaaatgtggtcttctcatagaatattttttctcatgggatttgtctgcttgtgttctgttatcccttcaattgtgtagctgagggtgcttatcttactgagtgagtcttactgttttttccccaggttttatagtttgttcttgcttctgaacaatcagcagttgtttgccattattgacaagaagtctagggcatagattttcttgatctgtttttcttttaatgtttgagttcaatggataagggaaacggttgtatgcattttattgcagacattctctgaaataatttttagccacaagcaaatagctctgtttctgtgagtcatcatttcttcttatatagtgctggataaagaattctattttgtagatagagatttatgacttccagaaagaaagctgcaaaaatggaagtttccaaagaatttaagatttgctataataaatgctatcatatattggtgtttgagatgcaaatgtacatatctgtgtatcatatattggaggttgattgaaaatcggagtttgagatgcaagtataggtatctgtggttgatgcagttttcctaaaacgtcatgattttcaatggcaagtaagttatttatggtcgtttttaaggataagctgttaacgtgttttttttttctttttttttcagcttccaataaaaacaggacagcagaacacacataccaaagtcagtactgagcacaacaaggaatgtctaatcaatatttccaaatacaagttttctttggttataagcggcctcactactattttaaagaatgttaacaatatggtgagtatttgggttactgtgttttggggaatttgctttcttttctttttgattaaaaagtttagaacagcatattttgaagtatggaaagtgattttctgtggactttggatataaccattaatcttattttgtttacgagcacagataaccttttaattttattttgtcaaatttttaatcagctgggttttagattcagtgagcacaagtaactgtaactttcattttaatttattatttcccttagaaacatctcctatcttttgtgaccatgtctccttttccagtatgtttcttgaattaggatttcatagagcttttgtggcctacacgaattgaccacagtaatccattacacatatttttctttagcatcttgtttgaatttacttacggttgtcccagccctaagtagatgataaaatatgatctcatagtcctaaaatgtggattgatttttttatgaagatatgtgttttttcttccttctgtaacctgtgacagattctgtagtagttaccctgttgttgaaacagtttttctcaaataccagtttcatcaaataattccactgttaaaagctcataatttctttcttcttcccattttctaaaatcgattgacgtttcctagacttcagagtactccagctgtcctccctctgtacctttgaacatataacatcttttgtctttctcaagtgatcccttcctctctctaaattcctatttaacatctccattctaagctgtttcaaactaacatactcagttcatggcaactgatctggatttttcttgattaactctgaactctctgctggtgtttagcatttatttatttatttatgaatgaataaatgaatgaatgaatgaatgacagggtctcattctgtcacccaggctggagtgcagtggcgcaatctcggcttactgtaacctcccccttcccagttcaagtgattttgctgcctcaggctccccagtagctggaattacaggcatgtgccaccatgctcggctaatttttttgtatttttagtagagacgaggtttcactattttggccaggctggtctcaaactcctgacattaggtgatccgcctgcctcggcctcccaaagtgctgagattacaggtgtgagccaccgcgcccagcctgcatttataatcccagtttgtatttgtttgtattgagttgtgaaacaacttctggttatagattgtgaagattgttcccccttccttttttttgagatggtccttaggtttattagataatattctagtatgacattgaaaagacatgaagttacctttttgccttattcccatattttagataatttttctcttgttctattttatttttaactggcatacaataattgtacatgtttatgggtacatattgatgtttcaatacatataatacatagtgatcccactagggtaattagcatatccatcatctcaatatttatcatttctttgtgttgggaatattgaatattctcttgttatttgaaactatataatgttaactgtaggccaggcatggtggctcacgcctgtaatcccagcactttgggaggccaagacgggcggatcacgaggtcaggagatcaagaccatcctgtctaacatggtgaaaccccgtctctactaaaaaaaaaaaaaaaaaaaacttagcggggtgtggcggcatgtgcctgtagtcccagctactcaggaggctgagacaggagaatggcgtgaacccgggaggcggagcttgtagtgagccaggatgcgccactgcactccagcctgggtgacagagtgagactccgtctcaaaaaaaaaaagttaactatataatgttaacatagtcattctacagtagtacagaacactaagtcttattcttcctataaagctatatttctgtatcctttaacaaatctctacccaccccgattctccctacccgacccttcttacctctagtgtcctctcttctactttttactctttttagcttccacatatgagtgagagcatgtggtgtttaactttttgttcgcatcatccttggtgtgtttccttttaagaaagttgcttacacaataccctaaacttacaaaactaataaactggaggtgtagaaaatcatttaccttctttatggaaaaaattagtattttccccccaaaagcaggaccatttataaataggtaaagagatttacggaaagacatttaacattttttgtagctcctctgttgcagtgtgtggggcacagtttagtatttgcacatatgaatatgtggctgtgttcccagttatattgaaatattttaatatttgggaccctcttttcaaaacaaaacagcattgttatattggcgttcatttagtgcttattaaataagttttcaaaaccatagtctcttgttaataaatacatatgtagtattcattttgaggatagtgagtacttaaaattcactgtggtgctatagcatgtttttgctataaaaattaagactttgatcatttcgtggcataaaagtatagttaaatccccaattcaagattctggtacaggtctatatgtgtgtctaaatcctacatatttttaaagcatgaagcaaaacagcatcttttactgttacaaggttaatggcagactctaataaatgccatttctgtttgccttagactttagtttttatgaggattaggataaaatcagaaataatatatttaagtatagtataatctgggaggtaaaatggaagactattgttgatcttttagtctttcacttttcagatgtgtgttgattggtagcagaaagtgaaactaacttttatgttctgaatatcttttctgttagagaatatttggagaagctgctgaaaaaaatttatatctctctcagttgattatattggatacactggaaaaatgtcttgctggggtaagtaaattgatcttaagtaggcaggctttgtgaatttgatcttgagaatgatcttatgtcccaaagtacagatgtggaccaagaggacagtcctatggacttttgtctgagacatataaatatgagttttgttaatatagctgacctggtgacagacaatttttcatgagaaaattttctcatcttttgtaaattaaacagatattaagtttacttataaaatgttatgtttcagccacgtatctgtctctcaggtttttaggaaaatattttatgaagagatcactatttgatttaacggatctctcagagagttgtgggagagtgcgattcagaagtccaagagtaatcttgtatttcctcctatatgaatatgattttaatattctacttttgaaatttatgtaaatgagaacttaaaaattaaacctattaaggatagatgttaccttgagaacacttgttttatgtagacacacaaatatgcgataggtatgtggaggaggagagtaccaaacaattatttctctggtttcctgtaagttgttaccacagtgtatttcaaccatgacttaatttgaactttttcaagagtatttctattgtgtaaagaaagtatttctatacatcattatccttaattcttcctggaacatggtaagagtttatataaatatataaattaaatacctctgttttaatgatctgcctaatccatgtgtattgaaattaactcatttcttatgttctctcttcctttggctcagaattcagaattttgttttgattcagaattgcttccctcttcacatatgttgcagttctctatagtgaaactagttgaaagagaccttaatatatgaggactgatagtgtggttgagaagtgttggtggaagcattggggtagggcattgaaaaaaaaattatattgacacaactgtgtatccctagggaaggctgtaagcgaaaaaatgtaagcataatatgtatatatatttttcttttgagacagagtctcactctgcggcacaggctgaagtgcagtggcaccctctcggctcattgcaacctccacttcccgggttcaagctattctcatgcctcagcctcccaagtagctgggattacaggcatgtaccaccatgctcagctattttttttgtattttcataagccatgggggttcactatgttggtcaggctagttttgaactcctatcctcaagtgatccgcccattttagcctcccaaactcctgggattacagatgtgaaccactgtgcctgccctaagcataatattttaaattttcttattgaccgttgaccatattccaaaattgtggagacagtgtttataagttttctacttaaaatcgaaggtgagctagttgttttagcatggtattttccgttaacttgtgatatgctattgttcatgtgtaaaatggagtgaaagagcaaaagagctgttacataggatgatggaactgggaagatgggcaaattttaaacttttcttgaatcagttttttccagtggtcttattactttgactgcaaattaccagtatatcagccacacccatgactgaatggtggggcgtggggtcatatattgccttgttcagtttcacagcttttctccattaacatttgtaattgagaggtaataatgaatgtattttggagaatgattaccgatattattggcctctgtttgatttaatactctttgaagatagcctaattgaaatgctaataagtgggcctagtataacttatgtaatgcataaaatgtatattatcttgccgtgctctactgttgaaaaatgtgtatgctttttcattaaatttactatttaaaaagtaatgctatttatattattgaacaattgttttatttccttcagtgattttacagatgtttcttgattcttacttttaaatcaaagtaaattgaggcagtttaagaagaacggagctcacaagtatacgtttgttatacatagttggaatatttaagtgaaagaaaaatacttaccaatatgttatgagtgcaattttgtagaatttgaggaatcttaagtatttttgttcctgtgaatatgactattatttaaaagatttaatacttcttagatttttatttgttagagttaacatctgtattgtttggttagcctataaacaagaaataggcattgtaatgtgaattcacaggtttttgtgaagtctgtttatgtactgtccctatgtttcagtgtatttgcatctgagagtgcttggattgcagttacagaattgagcgtagcatacaattgtacacatttttgttctttgccatcttgctcagtgttattaaaattcttatccgcatgtagttatcaagactgttaggtgaaatagtaatgtggaacagcatacctacaggatagcttatccattgattgtgtgttaattgtaaagtatatatttacaaagtagagatttcactgttaacaccgaagttatcaaacttggtgtcaataacaggaccacctggccttatgttctcatggtgtgatgtaatataacctatagtgaatcccctaaactgtttaacctcaatctaatcagaccattaggtttaaattttagcttacagaaaatatacaggccgggcaccatggctcacgcctggaatcccagcactttgggagatcgagacaggcggagagcttgaggtcaggaatccaagaccagcctggccaacatggcaaaaccccatatctgctaaaaatacaaaaattagccagatgtggtggcacatgtctgtagtcccagctacttgggaggctgaggcaggagaaccacttgaaaccaggaggcagaggttggagtgagccaagattgcgccactgcactccagcctgggccacagagcgagactccatctcaaaaaaaaaaaaaaaaaaaaaagaacgaaaatatacaatacagtaactagaagagcaaatcaacctatgtcactggaaaataattaaatcaaggatatggaacattctgtaaggcagctggcccacttaaagtcatgggaaataagagtggtgaatatgggccaggcgtagtggctcacgcctgtaatcccagcactttgggaggccgaggagggcggatcacttgaggtcaggagttcgagaccagcctagccaacatggcaaaaccccgtctctactaaaaatacaaaaattagctgggcatggtggcgggcgcctgtaatcccagctattagggaggctgaggcaggagaattgctttaaccctggaggtggaagttgcagtgagctgagattgcgcccttgcatagaatagtgaaactaaggaaacatcatgttgtaatcggtgaacttttttggatccttattgaataaaaatgcctatgaaagacattttgggggcagtggtgaaatttgaattcagacttggtattagatgatacaagggaattgtttatttttccttggtgtgttaattgtattgaagttacattagagaaaattcttttaagagatgccaaggcacatggggtgaagtattctatttataatttactttgaaaagatttcaaccaaaataaaattactttgagtaggtagtgtctgttttggtcagtctgcacaaaagcaagtgtgatggctcacccaggaatttacttaaatgtcaagacagatgacacaatgcactcatcaatcaatatgaattaagtcgattctgtaattgtagaactcacagcaaactggggattcccagggaagggctcgtttggtgaacaagagagcaagcaggaatgggaggactggtaaggatggcagggggattgaactttaattgtgattatggggtcagagatggaaccatcctctttattaaactatctatagacagatgtagcaaatatgatgaaacgttaacagttgttaaatctaggtggtgtgtatgtaaggtgttcattatttttgttctgtgtgtgtgtttgaaaattttcataatagaaaatgtttacaggtaaaattaaagtttagaataatgtgattatttctattttagcaaccaaaggacacaatgagattagatgaaacgatgctggtcaaacagttgctgccagaaatctgccattttcttcacacctgtcgtgaaggaaaccagcatgcagctgaacttcggaattctgcctctggggttttattttctctcagctgcaacaacttcaatgcagtctttagtcgcatttctaccaggttagtgtgtaaatccacatgggactactgaagtaatatgaatattagaagttttgttttttgtctacataaaaataaaaagttaatggaaatgaggtttttttgtttttgagacaagttcttttgcccctcacagcagctttgacctcccaggcttaggtgatcctcctacctcagcctccagagaaatgagtttgtctgggcttgcgtagaaattttatgcattaatatctttgacattttaattgcgtaatattgtgatattgatatgtgcaattaaataagagcactgttatgaatgtgaaagtctaaatttcagataaaaatatctgccgtgagcaggctttaaaaaacaatactaggtatgaacttttggtttggctttttaaacatattatccctttaaatgaaactacccaattagatggaataattaatgagagtagtcagaattcaaatactttcacaactctaccctttatcacaagattttaggttaccaaaaaacaaaacaaaaacaaaaacaaaaaaacctaagtgatgtgaaaacacaaggaggtgaataattgcaaagtagaattctccagaaagtggactacattttaaatgtatgtaaaatactgccatttattgagtatttatagcatttcctttgctgtctcatcctcacagtaaccttgatgatacttccctcattttacaggtgagcaaactaatactcaaaaaagttcaggtgatgtgccaaataatggaggacccaaaatttctaagtcaggctggcttcagaatttatattagtttcactataccagattgcttccctatctattttagccacattttgatgaaatctgttttataaaatatacttctgtttttaaagatgtatcaaaaatataatttaagcttttattgatgactcaaaatcatcctgagcattagttgtgatatgctacctacaggtggagaaattagtataggtagtgctctatgggatagaattataagtgacagtagcaagtagctgcaaattgttgttatgcacatgatttgcctttctaaggcaagtaaagtcagatgggttattaacttaattagaaactatagcacaaattatttagtgattcgtgaatcgaagactaataccgaatagagaaaaacaatcctctttgttggtgcctgcatctttggctcgtcagtgttgtacgaacagtggactttgattattcagatttactgattcctttgttgttttccagcaggtgtgaaagacaacatacatcaccatttgagaatttgtgttacggttttttgggggaattgattaacttcagagtcctgcaatctttttaatcaacaatgacatttctataattaagatcctaggcagcaatatttttcaacctcaatgcaattcttgatccaaagaaaattaaagttttatttaatggtatattattgataatcttgggtaatatttacatgatagaaaaatgttttcatgaaatcttttgagcagtaacgttttatattatgaataataatacagtggttgagtcagcaaggtaacaaacacctagagagtaggagggtggaaaattgtatttaataaaaaacgcaaacccttttcatttaggtgactgctaggccggccttactatttgaaacacctgttaaattaaaggtagaaagtggtacaaaaaaacccaaatgtcttgtagtctatcaatgcatgaactgccttatagaacacaacaaatgtgccaccttggaaaattctagaaaatttctagtcaccaaaggttttactttatgggattttgcagcattagcacatgtaaaaataagcaacttttgtttatttcctgaatctagttcactgttgccagaatagaaaccaagtgtctaaaattttattagctttcagaggacagaccactcagaaatggcatctgtgaaataacattgtttcagacaactgcattttcagttccatttagcttgtgtcagaaataggagctgatcttactgaaggatcactcacctaaaagaccattatgatggtttagtttaggttggaacatcttatgctgtcatcgtcatagtattaggtgacttaaaatatgtgtgtggcttgaatggtagttctttctaaagattgatcttatgttttatatataatagatgaatcagtatcatgaagatgtttcgtgtttgtccattctccccgtcaatgtttctcctttaagattaagatttggtttttatatttctgacctttacttttctttaggggaagataggctatagatttatttattttatgtttttgagacacagtctctctctgtcacctagtctggagtgcagtgatgtgaacatgtctcactgcagcctcgacctcctgggctcaagagatcctcccacctcagcctcttgagtagctgggactacaggcacgtgccaccatgcccggctagtttctttaatttttttgtagagacggggtcttgccatgttgcccaggcttgtcttgaacccctgggctcaagggatcctcctgccttggcctcccaaagtgttgggattacaggatgtgagctaccatgcctggctggctataaatcttaagatagctttatttttctctgggagtataccattttctgtggcttatagtatttatgtagcggagtaactgctttctccacagaattactccacaaatgcagttgatctagttgttttgtagtgagaaggtgcttcagaatatctcatttgatataccaccagaagcagaaaactcaatgactttaaaagtcatttggttctttacagtttactatttggttccatacaaatctgttcgttatggtttcttactctttttttaaaaatagttttcagtttttttatatgtctctgatcatttaaaacgtattttacgttctctttagtattgtttaatattgatttgtttgtgctgattcattcatagtgaattgtttcatctcagttttggaatccttgattgcaaagttatctttagtgtggcctgtattttctttgagaatccttgtagccttgggctgagggagtgttctagtgatggttttgcatttgcatttgccaggtgcccagttctggagctatttttttcttaatttctcagtcccagcctgtatgggcagtataaatttgaaccctaaactcttagaaggtaaacagctctaggtgacttttttcactttatccaaagtttaggcagagcagttaagcttctttgtgctggtaggtttttttctttttttctttttgtggggagtgggggcggcagggggagtgcattgttctttctagttcatgttttatgcagggcccaagttagaatcctgaattattagggtacaaggcgtttatatccagtctccatgtggatgttaagccccaagctcctaggttaaggagatcaaaaacctcactcatctttcctttgttgcagggctgggtcatgtacttgtgcacttaactctctggttttcagttttcttcttcttttctggacctatacatttaaaatatctttcagtatgcctagactttctagctgttttagtgataggttttctactgttcatttcttttgctcagactacgctttatttgatttctctgcttcggaaatgatgtttaaccttcacaaaatacctgctctctataagggtaccagactataaaagggacaaaatttttctcccatttttcacaaacaaccacaagagtcaacttttcagaagttggtattgctgatctatgatgttgtgttttctgaggagccgtactccatatttctacgctctttgcagcagctgtggaatttttagcattgaggacaacctcattcccagcttgaaatgctgagcttttcttaccctgatgataggaagagagttcatgtaagtgcttagaatagttgtactgttagctgtagtctaattaaagctaaagtgagtgaaacgagaatttgagaaggaagaataggattgattacattcttatcaactgaaggtttagtgtgatgattaataactcctttgcaaattgcactaaatgattgaaattcaagttaatacatataaattataagaccatatagtatttgtgccttttcaccatatctctattgctgcatttataaaagtttacaatttaattgtgctgcttatattttttatgtctattaatatgaataatgagtatgcctcattaggtagcatgatttaatagattagcaataccaacttttgaaaatctgagtgctgtggttgttggtgtaaaatggaagaaaagtttaatgccttttattaacatttaggctaagtgaatttcttttatcagtttaaaaatatctacatatttgttaagtgttaaatgtttctacgtttgtgataacttcatattcaacataggagaagctggggtttaaacagatattcctgtccttataagcttatgttctgtgaagtagggatattaagcaaataattacataaatacatgtacaaactgtgaaaagtgcaatgaaaaaaggcttactcggttttcaaatacaaagtaaatgtaccctgtgaatataaagtttcattcgtgtttcaaaaatctagttgataaaagtagaagttagtaaaatcaagtttacttattatagttttagtcttaattcaaattatacttttacttgtaattggaaatatgaatttttaaaactattcattgtggaaaaatggaaaaatacacatagaatagtacttcaaatccccatgcatctcttactctgctttaactgtttctggcatgctatggtttctcttcttcccttttcagtaatttaaagcaaaccccagacatcatttcacctgtaaatatttcagtatatatctctaataaatagatttttaagcatttaactataatattgtcatacctatcaagaatcataattccttaatatcatgcattgccaaatttgtgggttttttcattatctcagaaatggcttttttgttttgttcaaattaagatacaaataggatgcgtactttggaattggttgatatttctcctgagcctctgttaatcagtatcatttcttcatttcttcaccttgctctccattttttcccatgctgtttatttgttggactgcgttatttgcctttctacattctgtatttgggtttcattggattcacgttcatttggctggggggggacaagaatactttactgatgatgctatgtggttcctaatgaatcacatcaggaaacatgtcctattattgacttttaatgttatgatcagtgattggatttcgatgttatcagcattatgtattcattatacagtttcccataaatttttcctaatgtttttagtaatcactgatgatcactgcctggattccacttcattgggggctgcaaaatgaaacgttttctattctgtcattcattctttattttaaaattgtgacttctatgaaagatttttgcttcattgtgtgtttagttatcttgcaatacagtccatgtagggaatgcaggatacagacttgacttccattattcgttatcagaatgagttggtaccctaacagttgcgaaaggttacccatgaagttttttctttcaatattataacaggcttgtgtgttttaatttattgtatgtgtttccattgtagacataattcttttgatcctcagattatcccatttttgacagttgagatgcctaaagtgcatacctgtgtgatatttgacatggttctgatagttgttgatagtttcctgttttcaagcccaaggtgacctgccctcaccttgtatatctcttgcccccatcctggaattaactaattttcccaaagaaccctggccgaaagtcggcaatatttagacacctcaatcttaaggataaggatgctacgatgctacgtttactgaattatcatggtttcttttatcatatcccttgtttgttatgttcctttaggtttttataagaaatatttattgccttatttttatatatgtctttactcttatgaactcatctttgggggaagaatctgttgaattcagaatttagggatacccgaagactttttttgtttttgttttttttaagagatagggcccactctgttactcaggctgaagtacagtggtgtgatcacagctcattgcagcttcaaacttctaggctcaagagatcctcctcccttagcctcctgagtagctgggcctataggtgtgtgccatcatgcccagctaatttttgtattttttttagagatgatgtcttgctatgttgcccaggctggtcttgaactcctggcctcaagtggtcctcctgccttggcctcctgaagtgctgggattacaggtgtgagataccacacctgtcccctaatacttaatttgataagttaattttggtttttactttttaggttacaggaattaactgtttgttcagaagacaatgttgatgttcatgatatagaattgttacagtatatcaatgtggattgtgcaaaattaaaacgactcctgaagggtaagtttaaatgtataatatatctgaaaaaaatcactgggtcaaaaactagtatcatgaatgtactaattatattaattgtgctgaactagaacaccaaactggattttataatgacatttccttgtgaaataaccagtaatacaaatgggtaattatttttcaatctttgaaaataatgcagtagagaaaatgagcattttaaatcttggcaatggaaagttttgcttaactacaatttttgttttcaatacagagaatgcaagggtgctattatttcatttttctggaatttgatctctcaagggtggctataggttatagaagctatctgtttagctattgtagcactttacaaagattgtctgtagtaggatatcaaagttttattgcagaatggaacgaggagattgtgatgttatggtgagaggatgaattgagccagagatttcatttctgacatttctgttttcagctctctactgactgactttatagcattacaaagtcccttaaccttccattgccggttttgtctccttgtagaacatgtcagtagtagttccacatggggatattataacacctaatatgtgactttaaagcttgggaagtactttacatgattatgtggattgaaataaacgatcagaaggaattgagatatgttctgtagtaagcagtgatgtgttaatgtaaatcagataccaatgagtattcataaactgagtatgatctgaaggaattgagataaattctgtggtaagcagtgatgtattcatgtaaatcagatatcaatgaatattcataaactgagtatgaatatctaaatttcattttacaaaaaaatgttttttagtttttggcattattagaccctggctaatttagatatgaaaccgtatacagttcacacatatttttatttgtaacttaaggaattgtcaaacaataatatttttaatatctgacctaaaacagattgaattatattagcttcagaaacatcagttctgcaatgtagttttcaaaatacgtgtttttgttttcttaatatttcctttaaactcaataactatctcaccagagatgtaaaaaggcaatacctatataaaggaataatataaagctgtgttctattcatattacccttgttcataatttatgattttaggtcattaccattgtgaaaccaagcaacaattaattcagtaactttaataaaggaaaatataggggtgattttagctgttatgccaagatacaaacatgtggacagcaattattttagattataataaaccaccattgaattaatagttgagatttgcaagattttgatatctattattaagcgttgagcagttgagaaactgaatggtaaaatttagagatctctatgaattaaagttaagaagtattagtgggattttatgatttttcataactattcagtgatgttttggaaacaagtctagtccaggttgcctgtgaatagctgtttaaaacaatagaaatgttcaatccgtaataattaactgaaatgtctcttctgtccaaataagagaaactaattgaatgtgtggataaatgactttcttttatactgaagtaactttcccatcgaatgcggctccctcatgaacataaatttagagtatatgctgataaatatataaagtataaaaccgatattaaataggccagcaaaatatggctcttggtgacagtggtaaaaggaatgcaccctttcagtaatgagtagtaaaggtagtaatgtgttttaaatacaactcaacaagcctttgttgagaaactatgtataagaagccatgctaagtgctgggattacaaaaattaataaaatatggaatctgtccctaaggagctcatggcatggtttatgagacaagtgatgtcattatcaagttatttgcagaaaaaaactatgataaactcaaatagggtgagtgtaaagtgagagaggaagtatatatttgtttgaggggatgagagatgagcaagatgtgaaggtacaagaataggtcagatcattttaataaaaatatggccaggcctggtggctcacacatgtaatccccacactttggggaagccgaggcaggaggattgcttgagccagggcaacatagagagacccccatatatacaaaaaaaaattagctgggtgtgctgacacgcacctgtagtcccagctacttgggaggctgaggtgggaggatcacttgagcccaggaagaggttgaggttgcagtaagctgtgattgtgccactgcattccagcctgggtaacagagtgagatcctgtctctgtctgtctctctgtctctctgtctctctctctctctctctctttctctctttctctcgatatacctatctgtatatagatatatcaatcgatatgtgtatatccagatctgtctatagatatatctgtatcttgatagatatatcgagagagagagagaaacatttgttatattttcagtctgcaccgggccttgcgctatgcagtttgcatgccttttctcatcaattcttacaataaccctgtgacgcaatactagtattaatattatcatctcttgtgtagatgaggaaactgaggcctcagtaaattttcaaagtcacagagctagtaattgttcagtaaagattgagttcacatctgctcgtctctagaacctagatacttgactgctgcactgttgtgcttatgagttacgaagctttattttagtggccctgggaagtgatagaaaggctttgaggtagagaataccttaatcagtattttattttagatatacccctttgcttgaaatttgcaggatggcttggtagagggttacctgaacttctgggacttggttatgcagtaatataagtgaaaaataatgagagttgtggagatccagatgatggattggggtagggtaaggatggggaccagtttgataggtatttaaagaagtggaggctgggcgcagtggctcacacctgtaatcccagcactttgttaggctaaggtgggcggatcactgaggttaggagttcgagaccagcctggccaacatggggaaactccgtctccattaaaaatacaaaaaatgggctgggcgcggtggctcacgcctgtaatcccagcactttgggaggctgaggcaggtggatcacgaggtcaggagaccatcctggctaacacggtgaaacactgtctctactagaaatacaaaaaattagccagtcgtagtggtgggcgcctgtagtcccagcttcttgggaggctgaggcaggagaatggcatgaacccgggaggcagagcttgcagtgagccgagattgtgccactgcactccagcctgggcaacagagtgatactccgtctctaaataaataaataaaataaaataaaaatacaaaaaattagccgggtgtggtggcacgtgcccataatcccagctactcgggtggccgaggcacagcagaatcgcttgagcctgggagatggaggttgtagtgagccgagatcacgccattgcactccagcttggacaacaagaccgaaactccatctaaaaaaaaaaaaaaagaaatggaatacatagcatttgatagtcaatttagatatatgaggttagagagatatcaccaaatattacagaataagctggttagagcagaaaagggaaggaaaggttgatggcagaagagagggtttgaccaggaaaatgataaattcagttttagatcttctgagtttgaggtatcagtaggatgtccaacaagaaacttgtagaactgaaagatactttggctttgagagtagattatggtatataacacatttaagatgtcataaaggtaaagttgttgctaaagagcactgtgaagagtaatgtcattatttggaaatcagtggagggtgagagcaaagagaattcaaaggggtacttttaaaaactgatttggagagttacttatttgcaagtccagaaaaaagactcatctctctcttagacacttacatagatgtaataaaaacctttatcccttcattaaaagtcaacaggagaagttctttgccgagggaccattgccagtaaaatcgcttatagacaggtcattttttccaaacataaatctttttctagatgtggacaataaacttaaagaagaagaaattaaaatacccaatatatttatatggagaaatgtttactgttacttgcgttaaaatgcagtctactattttgaacactccaattagcaaaataaagaaaatgaacatacttttatgatgacaaagataggatgaaggcactttcgtatgctgcttggtgatagcagcatttggcccaaccctagtgaaaggcagcttggtaatctttatcaagggccctaaaaatattcatctctttgactggacacttctagagattccttatcttaaataagcagtgatgtgggaaaagatgttgatatgaaaatatttgttaatgttatttataatagtgaaataacagaaataacctcagtgttaaaactggaaaacattaaataaccagtcacttaatacagtgacttaaatattatgaggggcatcaaagcatactgaaaagaccttggttttaaagcccaattcaatcatttattagatctgtaaccttagacacacagtttgttcatctgtaatactctgaaaacattaagattcaaaaagaattaagtgtatcatactaaaaatacatgatatgttttaatagtttgtgtaatagttactattgcatatagagccatcaaaaataggccaggcacagtggctcacacctgtaatcccagcactttgggaggcctacgtgggcggatcatgaggtcaggagttcgagaccagcctgacgaacatggtgaaaccccatctctactaaaaatacaaaaattagctgggtgtagtggcgcacgcctgtaatcccagctactggggaggctgaagcaggagaatcgcttgaacctgggagacggaggttgcgtgagccaaaattgtgccattgcactccagcctgagcgacagagcaagactccatctcaaaaaaaaaaaaaaaaaaaaaaaaagagtttttactgatacagaaataattagggatactatggaaaagaacaggtttgatacagcttatatgatctcagttatgttaaatatatttgttttctacatgcataggaaaagtggtagaagtaaaaccaccagatgttaactgtgattgtctctgaatgatagaatcattgatggttttaaaaatttcccataaacacctgtgcttttgctttttttttttttttttttttttggacagagtcttgctctgtcgctcaggctggcatgcagtgacatgattatagtacactgtagccttgaaatcctgggctcaagctatcttcccactcctgctttcgaaagtgctgagattataggcgtgagccatcgggcctggccctgtatatgttttccaaattttttaattatactttaagttctggggtacatgtgtagaacatgcaggtttgttacataggtgtccatgtgccatggtggtttgctgcacccatcaacgcatcatctaccttaggtatttttcctaatgctatcccttacctcagcccccaccccccgacaggcaccgatgcgtgatggtcctctccctgtgtacatgtgttcttatggttcatctcccacttatgagtgagaacatgtggtgtttggttttctgttcttgtgtttgctgaaaatgatggtttccagcttcatccatgtccctgcaaaggacgggaacttatccttttctatgtcagcatagtattctgtggtgtatatgtgccacattttctttatccagtctatcattgatgggcatttggattggttccaagtctttgctgttgtgaacagtgctgcagtaaacatacgtgtgcatgtgtctttatagcagaatgatttgtaatcctttgggtatatacccagtaatgggatggctgggtcaaatggtatttctagttctagatccttgaggaatcgccacactgtcttccacaatggttgaactaatttacactcccaccaacagtgtaaaagtgttcctatttctccacattctctccagcatcttttctttcctgactttttaatgatcgccattcttactggcgtgagatggtatctcattgtggttttgatttgcatttctgtaatgaccagtgataatgagcttttctttatatgtttgttgtcttcttttgagaagtgtctgttcatatccttcatctactttttaatggggttgtttgtgtttttcttgtaaatttaagttctttgtaggttctggttattagccctttgtcagatgggtagattgcaaaaattttctcccattctgtaggttgcctgttcactccgatggtagtttcttttgctatgcagaagctctttagtttaattagatcccatttgtcaattttggcatttgttgtcattgcttttggtgtttcagtcatgaagtctttccccatgcctatgtcctgaatggtattgcctaggtttctttctagggtttttatggttttaggtcttatgtttaagtctttaatctatcttgagttaattattgtataaggtgtaaggaaagggtccagtttcagttttctgcatatggctagccagttttgccagtaccatttattaaatagggaatcctttccccattgcttgtttttgtcaggtttgtcaaagatcagatggttgtagatgtgtggtgttatttctgaggcctctgttctgttccattggtctatgtatctgttttggtaccagtaccatgctgttttggttactgtagccttgtatagtttgaagtcaggtagtgtgattcctccagctttgttctttttgcttaggattgtcgtggttatgcgggctcttttctggtttcatatgaaatttaaagtagttttttctaattctgtgaagaaagtcagtggtagtttgatggggatagcattgaatctataaattgctttgggcagtacggccattttcacgatattgattcttcctatcgatgagcatggaatgtttttccgtttgtttgtgtcctctctggctggcatctggcaggtgcccctctgggacaaagcttccagaggtaggaacacgcagcaatctttgttgttccgcagcctctgctggtgatactctggcaaacagggtctggagtggacctccagcaaactccagcagacctgcagcagagggttctgcctgttagaaggaaaactaagaaaggaatagtatcatcatcaacatcaaagaccaaaggtagataaatccacaaaaatgggaagaaaccagtgcaaaaaggctgaaaaaaaaacgagcacgcctcttctcctccaaaggatcacaactccttaccagcaaaggaacgaaactggacaaagaatgagtttgacaaattgacagaagtaggcttcagaagatgggtaataacaaactcctccaagctaaaagagcatgttctaacccaatgcaaggaagctaagaacctggaaaaaaggttagacgaattgctgactagaataaccatcttagagaagaacataaatgacctgatggagctgaaaaatacagcatgagaacttcgtgaagcatacacaagtatcaatagccaaatcaatcaagcagaagaaaggatatcagagattgaagatcaactcaatgaaataaagcgagaagacaagattagagaaaaaagagtgaaaagaaatgaacaaagcctccaagaaatatgggactatgtgaaaagaccaaatctacatttggttagtgtacctgaaagtgatggggaggatggaaaaagttggaaaacactcttcaggatattagcaggagaacttccccaacctagcaaggcaggccaacattcaaattcaggaaatacagagaacactacaaagataatcctcgagaagagcaaccccaagacatataatcgtcagattcaccaaggttgaaatgaaggaaaaaatattaagggcagccagagagaaaggtcgggttacccacaaagggaagcccatcagactgacagcagatctctaggcagaaaccctacaagccagaatagagtgggggccaatattcaacattcttaaagaaaagaattttcatcacagaatttcatatccaggcaaactaagcttcataagcgaaggagaaataaaatactttacagacaagcaaatgctgagagattttgtcaccaccaggcctgccttacaagagctcctgaaggaagcactaagcatggaaaggaacaactggtaccaaccactgcaaaaacataacaaattgtaaagaccatctatgctgtgaagaaactgcatcaactaatgggctaaataaccagctagcatcataataacaaattcacacataacactattaaccttaaatgtaaacgggctaaatgccccaattaaaagacacagactggcaaattggataaagagtcaagacccatcactgtgctgtattcaggagacccatctcacatgcaaagttacacataggctcaaaataaagggttggaggaagatttaccaagcaaatggaaagcaaaaaaaagtagggttgcaatcctagtctctgataaaacagactttaaaccaacaaaaaagatcaaaagagtcaaagaagggtattacataatggtaaagagatcagtgcaacaacaagagctaactaccctaaatatatatgcacccaatacaggaacacccagattcataaagcaagtccttagagacctacaaagagacttagactcccacacaataataatgggagactttaacaccccactgtcaacattagacagatcaacgagacagaaagttaacaaggatatccaggagttgaactcagccctgcaccaagtggacctaatagacatctgcagaactctccaccccaaatcaacagaatgtatattcttctcagcaccacattgcacttattccaaaattgaccacataattggaatacaacactcctcagcaaatgccaaagaatggaaatcataacaaagactctcagaccacagtgcaatcaaactagaactcaggattaaggaactcactctaaaccacacaactacatggaaactgaacaacctgctcctgaatgactactgggaagataacaaaatgaaggcagaaataaagatgttctttgaaaccaatgagaaaaatacacaacgtaccaaaacctctgggatacatttatagcagtgtgtagagggaaatttatagcactaaatgcccacaagataaagcaggaaagatctaaaattgacaccctaacatcacaattaaaagaactagagaagcaagagcaaacaaattcaaaagctagcagaggacaagaaataactaagatcagagcagaactgaaggagatagagacacgaaaaacctttcaaaaaatcaatgagtctcctgacctcgtgatccgccgccttggcctcagtgaaaccccatctctactaaaaatacaaaaaaattagccgggcatggtggcaggcacctgtagtcccagctactcgggagcctgaggcaggagaatggcgtgcacccgggaggcagagcttgcagtgagccaggatcgtgcaactgcactccaacctgggcgacagagcaagactctgtttaaaaaaaaaaaaaaatcaatgaatccaggagctggttttttgaaaagatcaacaaaataaatagaccactagccagactcataaagaagaaagagaggagaatcaaatagacgcaataaaaaatgataaaagggatatcaccaccgatcccacagaaatacaaactaccatcagagaatactataaacacctctgtgcaaataaactagaaaatctagcagtaatggataaattcctggacacatacaccctcccaagactaaaccaggaagaagtcgaatccctgaatagaccaataacaagttctgaaattgaggcaataattaatagcctaccaaccaaaaaaagtccaggaccagatggattcacagccagattcagctagaggaggagctggtaccattccttctgaaactatttcaaacaatagaaaaagagtgaatcctccctaactcattttatgaggccagcatcatggtcataccaaaacctggcagagacacaacaacaagagaaaattttaggctgatatccctgatgaacatcgatgcaaaaatcctcaataaaataatggcaaactgaatccaacaagcacatcaaaaagcttgtccaccatgatcaagttggcttcatccctgggatgcaaggctggtttcaacatatgcaaatcaatgaaagtaatccatcacgtaaacagaaccaatgacaaaaaccacatgattatctcaatagatacagaaaaggcctttgatgaaattcaacagcccttcatgccaaagactctgaataaactagggattgatcaaacatatctcaaaataataagagctatttatgacaaacccacagccaatatcatactgaatgggcaaaaactggaaggattccctttgaaaactggcacaagacaaggatgccctctctcaccactcctattcaaactaatattggaagttctggccagggcaatcaggcaagagaaagaaataaagggtattcggttaggaaaagagaaagtcaaattgcctctgtttgcagatgacatggttgtatgtttagaaaaccccatcgtctcagcccaaaatctccttaagctgataagcaacttcagcaaagtctcaggatacaaaatcaatgtgcaaaaatcacaagcattcctatacaccaataacagacaaacagagagccaaatcatgagtgaactcccattcacaactgctacaaagagaataaaatacctaggaatccaacttacaagggatgtgaaggacctcttcaaggagaactacaaaccactgctctaggaaataagagaggacacaaatggaaaacaattccatgctcatggataggaggaaccaatatcctgtatgtgttttatacttttttttgaaaaagcaagttattaaaagaaaaagctcacaatcattgatgtccaaggcatatttgctgtttatggaatttttctttcctagcagacaactatcgagttttgggtttatgttaggtgtctttacctttcattgcttacagataatattggagcaaaagtaatacgtaaatggaaagttattttgctctgagttgtatttgtgttaacttattctagagttaatttttaaaaattgtgttttttccagaaacagcatttaaatttaaagccctaaagaaggttgcgcagttagcagttataaatagcctggaaaaggtaagttacaacctctctggtattaaaattttgtttttgatgtaaaatttgctgttgttagcatcctgaatcaaaaagttatgacttgagtgatagtttcacattcattttcaggaagaatacattgtaatattattatgaaggaagttagaagtttgtgacattttatttactgtattacaaaaaatcactgtaaagacatgtggttctttatttataggcattttggaactgggtagaaaattatccagatgaatttacaaaactgtaccagatcccacagactgatatggctggtaaggatacgattgattttttttttttttttgtcttttaaatgcctacttgtgacataaaaacctatcatcgttttccaagttatttttgttataaaggtgcttttacatcttctattgtcaactggtgtcaaataggaaatactgtttttctcttacatttctaaattaggcccaaccctcttcctttccttggagcaaacaaagtagtttgaaatgaaggtcagatctttagagctgtgataggatggggtgtttggctctttgttgtagagaagcatgtgctctgaagctttattttgtatttagggagatgtgtataaagtagtaatattctcacctataatgtaagacacaactgcaaggcagagaatacagactcctggagaactttggtaattctttttgggaagctgttcagtctttgttgcttgggtacatcacactttgcataaggcccttcacagtgagactgaatacatgatcatccattctaaaatgtgagcttttccaggatagatcaagatagctcttctaacacatagacagtattacattgcttgtctacttaccagaatgcatttgtgtagttgcttaaatgaagttccatgtttatcttttaaaaatgttgcccttgggtttttacatagtgtcagcttttactttaatgccagggattttgttcctatctaataatgtcatttaatatatttttcatgcagaatgtgcagaaaagctatttgacttggtggatggttttgctgaaagcaccaaacgtaaagcagcagtttggccactacaaatcattctccttatcttgtgtccagaaataatccaggatatatccaaagacgtggttgatgaaaacaacatgaataaggtaaggagggcaaaattatttccattatatctagatgtgaagcagtttattttactcaaggtgtgtattactttaggcttattatttaagcaaagtatttcagggaaccatttaaatgatcattttaggtttctttgtttgatggacttagaagagacatactcatacataattttatttggcagagggaaaataataccaggcaatgaacaaagatttaaaataatcccttagtttcattcttttgtctgagaagactaaacgatacctctgttattattaaacgtagtttctctaatattcactacaaggattgccctacttgagttcatcacttttatagtgtgttatttgcatgtacttagggtatgtgtccatatagtgctactgaaattatctagtaactcattttaagtattttagaacagttttcaaagaattttgccaggaaggtaaggctctcgcatataccatctatagtgaaattggcaccatgacaactggtaattctaggaggctcttaaaatttttttaaatatcacctaggtgattgaaaaaaaaaagaactgagtattaatcctagggttttactgaaatttcaatatgcagtttgttttgcaaatattttttttttcattttttgctgcttttggagaaatactcttagctggctgaacatgagatggtttccttcatggtttgcctgtagatggagatgttcagaatcagctgaatgatttattactttgtagaagtattggaccgggaatttatacattaaagggtaaataaatgaaccaggtaatccttgagagtctgtgattgcgtgttactccacttaggtgtatatctcaacttttccattatgaggacaccatttttcatggtagattgttttggagcccttcaaaatagtaggtttgatgataaatactgagtgtcaacttgattggattgaaggatacaaagtattgatcctgggtgtatctgtgaagttgttgccaaaggagattaacatttgagtcagtgggctgggaaaggcagacccacccttaatctgggtggtgcaccatctaatcagctgccagcatggctggagtataagcaggcagaaaaatgtgaaaagagagacgggcctagcctcccagcctacatctttctcctgtgttggatgcttcctgccctcgaacatcagactccaagttctttagttttggaacttggactggctcttcttgcctcttagcctgcagacggcctattgtgggaccttgtgatcgtgctagttaatagttaatatcccctttatataaatattctattacttctgtccctctagagaaccctaatagagattttggtacaaggagtgtggttctagaggaacggagtattaaggatggagtttcttagtttgtttgggggtttctggagtttgctgcttaatatgattagaccctaaaatattaaggactctacttctaatattgtggagaacactgatagtcgttgctgtgaactgtttagagagtttgcaaaataaatgcatttgacactcctgattcaccgctaatgagaggcaaggagtttagtgaccctatacataataatacctttgaccatatatggagaaccaaggaacataatgaagctggttggttgctcctaaattcagtggacaaagtggtgaaagaaaatgatgggccgggcgcggtggctcacgcctgtaatcccagcactttgggaggccgaggcgggcggatcacgaggtcaggagatcgagaccatcctggctaacacggtgaaaccctgtctctactaaaaatacaaaaaattagccgggcgaggtggcgggcgcctgtagtcccagctactccggaggctgaggcaggagaatggcgtgaaccccagggggcggagcctgcagtgagccgagattgcgccactgcactccagcctgggcgacagcgagactccgtctcaaaaaaaaaaaataaaaaaaaaaaataaaaaaataaaatagaaaatgatgagctcagggattctgtctcctgtcttcagaagcagatactgagcctcaaatctgctaagattgacctgagtgagacccttatctcctgtagaaaaagagctgaaattgtgaaaaaacaaacacaaactcttatcatgcaagtggctgacctgcaacaaaaggtgcatgtacagcctaaccaggtgtctactgttaaagtgtgggcattgattggaaaagaatgggaccctgcaacttggaaagggcatgtgtgggaggaccctgatgaagctggggactctgagtttgtaaactctgatgaaccttttttgccagaagaaacagcttccccatccccagtagtggcaacatcccctccctgagccatgctgccatcagcctttccacttttgtctgaagagataaaccctgcgctgcctgaggcaacaggaatggcctcccctgaggcagttgccaggcaagataatgttgattctcctcagaagccacccccaacacccctgtttgcttctagacctataaccagactaaagtcctagcaggtccctagaggtgaggctgagagtgtgacccatgaggaggtgcgctacactcgtaaagaactgcttgagttttctaatttatataaacaaatcttacttggagagaccttggtcatgtttcacttccacaacatatgacactggtctattacattaatgatattatgctgattggattctgtgagcaagaagtagcaaacgcactggacttattggtgagacgtttgggtgccagaggatgggaaataaatccgagtaaaacttagggaccttctacctcagtaaaatttctagggcttcaggggtgtggggcctgtcaagatattctttctaaggtgaagaatattgctgcatttggcccctcctacaaaaaagaaagaggcacaatgcctagtgggcctacttggattttggaggcaccattcctcatttaggtgtgttactctggcccatttatccagtgacccaaagaactgccagttttgagtggggtccagaacaggagaaggctctgcaacaggtccaggctgctgtgcaagctgctctgccacttgggccatatgacccaacagatccaatggtgcttgaagtgtcagtggcagataaggatgctgtttcgagcctttggcaggcccccataggtaaatcacagcggaggcctctaggattttggagcaaggccctgccatcttctgcagataactactctccttttgagatacagctcttgacctgttactgggctttggtggaaacggaatgtttaactgtgggtcttcaagtcaccttgtgacctgaactgcctatctatgaactgggtgtgttctgacccatctagccgtaaagtgggtcgtgcacagcagcattccatcatcaagtggaagtggtacatacacgatcgggctcaagcaggtcctgaaggcacaagtaagttacatgaggaagtggctcaaatgcccatggtctccactcatgccaccgtaccttctctctccccacctatactgatagcctcatagggagttccctatgatcagttggcagaggaagagaagactagggcctggttcgcagatggttctgcacaatatgcaggcaccacctgaaagtggacagctgcagcactacagcccctttctaggacatccctgaagcatagtggtgaaggggaatcttcccagtgggcagaactttgagcagtgcacgtggttgtgtactttgcgtggaaggagaaatggccagatgtgcgattatatactgattcatgggctggagccagtggtttggctggatggtcagggacttggaagaagcatgattggaaaattggtgacaaagagatttgaggaagaggtatgtggatagacctctctgagtggttaaaaactgtgatgtttgtatctcatgtgagtgctcaccaacaggtgacctcagcagagaaggattttaataatcaagtggatagcgtgacctgttctgtggatgccacttagcctctttccccagctacccctctcctcgcccaatgggcccatgaacaaagtggccatggtggcagggatggaagttatgcatgggcttagcaacgtggacttcactcaccaaggctgacttggctatggccactgctgagtgtccaatttgccagcagcagagaccaacactgagcccttgatatgacatcattcctcagggtgatcagccagctaccttgttgattatattggacctcttccatcacggaaagggcagagatttgtcctcactggaatagacacttactcctgatatgggtttgcctatcctgtatgcaatgcttctgccaagattaccatgcatgggctcaccaaaggccttacccaccatcatggtattccacacagcattgcctctgaccaaggcactcactttacagctaaagaagtgtgccagtgggctcatgctcatggaattcactgtttttgtttgtttgttttttgagatggagtgttgctctgttgccaggctggagtgcagtggcgcgatctcggctcactgcaacctctgcctcccaggttcaagcgattctcctgcctcagccttccgagtacctgggactataggtgtgcgccaccacgcccagctaatttttgtatttttagtagtgatggggtttcaccatgttggccaggatggtctcaatctcttgaccttgtatctgcccccctcggcctcccaaagtctaggattacaggcatgagccaatgtgcctggccacactggtcttaaccatgttcccaaccatcctgaagcagctggattggtagaacagtggaatggccttttgaagtcacaattacaatgccaactagaagacagtactttgcagggctggagcaaagttttccagaaggctgtgtatgctctgaatcagtgtccaatatatggtactgtttctcccatagccaggattcccgggtccaggaatcactcaccatcacccctagtgatccactagaaaatttttcttcccgttcttgagacattatgttctgctggcctagaggtcttagttccagagggaggaacgctgccaccaggagacacaacaacgattccattaaactggaagttaagattgccacctggacacactttgggctcctcctacctttaagtcaacaggctaagaagggagttacagtgttggctggggtgattgaccctgactatcaagatgaaatcagtctactactccatagcggaggtaaagaagagtatgcatggagatccattagggcgtcttttagtattaccatgtattgccatgccctgtgattaaggtaaatgggaaactacaacagccccatccaggcaggactacaaatgacccagacccttcaggaatgaaggtttgggtcactctaccaggaaaaaaaccaccacctgctgaggtgcttgctgaaggcaaagggaatacagaatggctagtagaagaaggtagtcatcaataccagctacgactgcatgaccagctgcagaaacaactgtaattgtcatgagtatttcctcctccttttgttaaaaacatgtttgtgcatgtatacacctgtactaagaaaatatcttcattttatttcctttttcttttatcatatgacttaagatttattgacttcacatcagcattttaagtattgttaacttttagtatttgggttgggataggtgtgtttctggttgtacgaaggataattgtattatgttaggcataattatgactttattgtctttatttaaagattatgtatgatctcaggagatatgtatgggttcaagttgacaaggggtggacttgtgatggttaatactaagtgtcaacttgattggattgaaggatacaaagtattgatcctgggtgtgcctgtgagggtgttgccaaaggagattgacatttgagtcagtgggctgggaaaggcagacccacccttaatctggctggctaccatctaatcagctgccagtgtggctagaatataagcaggcagaaaaatgtgaaaaagagagatgggcctagcctcccagcctccatcttcctcctgtgctggttgcttcctgccctccagcgtcggtcttcaagttcttcagttttggaacttggactggctctccttgctcctcaccctgcagacagcctattgtgggacctcgtgatcgtgtaagttaatgcttaataaactcccctttgtataagtatctattcccttaattctgtccctctagagaaccctgactaatacagtagggtgttttttgttgttgttgtttattggaaaaatagaaataaataaataagctatagattcagtagtactcgagtgaatttacgttttaataatcacaactgtagctttctaagtgtttactggttatttgtgtatcttcagggaattgctgatttttccattgaattgtttgtcttttgttgatttgtaagggtatatgtgtacatttttacttggtttcatttttaaactttatgagttctttttactatatagatatttaaaatttgcatgtagtcacctcagccttgttcctttttgtctcctagcttttttggtcagatctctcttcccagaagatattattcattttattgagatataattcacatatcataaaatttacgtttttgaagtgtaaaattcagcgattttagtacattaacaaagttgtacaatcatcaccattgtttctgtgcagaacattttcatcttcccaaaaagaaacccgttagtaatcactccctgttcctctcgcctcactcgcagcccttggcaaccagtaatctagttttttgtctatagatttacttaattctaaactagacatttcatacaaatggaatcattcagcatgttatgtttttgtctggcaggtgccaagatttttgaagtatgctttttaatttttttctggtattttctagatttaaaagtttagatttttaaatctttctggattaaaaagaaaagtattttttttttttttttttttgagacggtgtttcactcttgttgcccaggctggagtgcaatggcacaatctccgcttagtgcaacccccgcctctcgggttcaagcgattctcctgcctcagcctcctgagtagctggaattacaggcatgcgccaccacgcccggctaattttgtagttttagtagagatggagtttctccatgctggtcaggctggtctcgaactcctgacctcaggtgatctgcctgcctcgggcctcccaaagtgctgggattacaggcatgagccattgcgcctggctaaaaaatgtatttttaaaaatgtattacaaaaaaaaaaaaaaaaaaaagctggccatggtggcaggctcctgtgatcccagctactctggaggctgagccggggagaattgcttgaacctgggaggtggaggttgccatgagctgagatcatgccactgcactccagcctgggcgacagagcgagattccatctcaaaaaacaaaaaaacaaaaaaaataaaatagtattctcacccttttctactcacattccttctgagctggttagtgttattggctggtatgtatccttccagtcacatctatttacccatatattcaaatgcaaaatatacatacgtagggtggtggtggttgtattttaaaatgaaattattttatgcacattactctgcatcgttgtttatctaagaaaatattttagctgttcctcaaaatagttgatagagatctgacacattcctttcagtattaggtaacattctgttacactaatgagcctcatttactcagccatttcactgaatgggtggatattcagatgttttcagttttttgacacttagctaagccttaagtaaatatcttgttcatatatccttgttaactgatgctcttaattctatagactagaatctaaaaactaggggttcctgtgtcaagaacatttgcatttaaaatttgtaatagttattactagatttacattccccaatagttgcagcaggtcagagtttcatccccactgaattgcctattttcctgcatttttgtcaggattagctgttgttaaatctttaaaattttgccacactaataaggtgagatagtatctcatctcaggtattcttaccttctctttcagaggtaaactgtgtgatgtgatggatatgttattaccttgattgtggtactcattttagaatgtataagtttatcagaacatcatgttgtacaccttaaatatatacaatttttatttttcaatcgtacctcaataaagctgaaaaaatgtcattcagaaaggaagcaaacagtagatactagcattaaaaatatgttgtaaattttcaagcatagaatgataacataaggttaggaacaagaatatgtgtatagatttaaatatttatctctgtgaatattaatccatagatacaaatgttgaaggcaagttacaatcttgaagaaaatgaaaattatgttgtgtacctataatatgaaaataaaaaatcacacaaaggcatataccttcactcaaggatgtatactcgagtatacatattatttataatagcgcaaatttgaaaacagcccaaatgtccctcagctggtgaatgaataaaccagtggtgatgccttggaactgtggaatactattcagcaataaaaaggaactactgactcggcaacatgtgtaaatctcaaaaatattatgctaagtgaaagaagccagggtcaagagatgacatactatatgatttcttaaaacttccagagaagacaaaattcaggacagaaagcagatcagtggatgccaggagtgagagttaggggaggaaatttattgcaaaggagcagtaggggattgattgtggtgatgtttgaaatgttctatgtcatgatcgtggttgtagttacatgactattctgaaagttcatatttaataagtgatataaaagaaaaaagtattaatggcttaaacattaattttccaaatgagagcactaattaaaattctcaagtgttgagaacaaagatagtatctcattgtaatttttattctttttaaggttagtgaggtttgaaaacagttcatatgtttctttgccatttgcatgttttcttttgcaggtgcctgttgacttcctttacctattattctgttatgttgcttccagttccttatgaattcgcggaactttttgtatattcagagcagtaatcctacatttttagtctgtaaatgtttttccagtcacctgtttcttttgactatagtatctttttttaaaaagaaatatttgaaatgtacaaagaatgtaacagtttcccatactgctattaacatttttatattttgctcatcttttgagaaatttatatatgtgtccacgaaaagagtcaaactctataaaatattttaagagatttattctgaaccaaatacgagtgaccatggcccgtgacacagccatcaggagttcctgagaacatgtgcccaaagtggttggggtacagcttggtttgatatattttaggaaggcatgaaacatcaatcagatacatttaagaaatacattggtttggtttagaaaggcgcgacaactcaaagtgggggcttccaggccataagtaaatttagacgttgtctggttgacggttgagtttgtctgaagacttgggattaatggaaaggaatgtccaggttaagataaaggattgtggagaccagattttgttgtgcagaggaatctctcagcagacttcagagagagagaaggttgtaaaatgtttcttattagacctaaaagagtgcctggctcttagtcgattaatctcctggatctggaaaggaaagaaggaaaacaaagggaaaaggggattctctatagaatgtggatgttttttccccacaggagactttgcacggcaaatttcaaggtatggcaaggaaatatattttggggctaaatattttttccttgtctcataatgttatgccagagtcagattgaaaagtaagtcacgatatatagcgtcaaataaaacccatctgatgagaatttatggtttgtagggcatgacttcctagaccccttaggtaggagtttgggcaagttaaaaaatcagagctaagtcctcacatggcttttaaaaattgtgaataagtaatacttccataaattctgatttaattacgaatcccactaatttcttttttttctttcccagggacagccactgcaaagggttaaatgtatattcttccagtctagcttttatatttttatgaggatggggagatagacagataggtatatagttcagtgtttctcaaagtgtggtctttagaccagcagcatcagcgtcacctggaaatttgtgagaaatgccagttcttagtttctaactaaatacttagtttctcactaaaaacagccatttttattaagtccttcaggtgattgtgatgcacattgaagtttgagaaccattgttcatctaggtcattgtctttaactgctgtatggtgttccctaaattgaatataccattttttaaaaaagagactaagtcttgctattatgttgcccaggctggtctcaaacttctgggcttatgcgatcttcttccacctcagccttcagatagctgcaactataagcatgcaccaccgcacccagcttgaatgtaccatattttaaattccatattgtcaagcatttaagttacttttctttaaaaaattaacgttattgcaaaggaaacaattggcagagtgaaaagacaacctacaggatgggagaaaatatttgcaaagtatgtatccagcagaggattaatatccagaatatacaaggaactctgatatctcaacagcaaaaaacaaaacaaaacaaaacaaaacaacaacaaaaaatttaaaaatgggcaaaggacctgaatagacatttcttaaaagaagacagacacatgaccaacagatatattttttaaaaaagctcaacatcactagtcatcagggaaatgcaaatcaaaaccacagtgagatatcatctcaccccggttagaatggctactatcaaaaagacaaaaaatagcaaatgctggcaaaggtgtggagataagtgaactcttaaatgtggctagtgggaatgtaaactagtacagccactatggagaacagtgtgaaggttcctcaaaaaactgcaaatagaactaccatgtgatccaacaattcattactggacgtttatccaaaggaagggaaatcagtatattgaagagacatctgtactcccatgtttattgcagcactattcacaatagccaagatatggaatcatcctaagtatctaacaacagatgaatgcgtaaagaaaatatggtatatatacacaatggaatagtattcagccataaaaaagaatgaaattctgtattttgaggcacgtggattgaattggaggacattatattaagtgaaataagccagggacagaacattaaacactgagtgttctcattcatatgtggaagctaaaaaaaagttgatctcagaagtaaaaagtagaacagaatactacaggctgggaaggatagggtgcggggagggtagggaacgatttgttaaaggattcaaaattacaactagataggaagagtaagttctagtgttgtataccactgtaagatggctgtaattaacaatatgttacaaagtttcaaagagctaggaggaggatgttgaatgttcccagcacaaagaaatgataagagatgatgggtatgctaattaccttgatttgatctctgtatagctatgaaaatgttactatgttcttcataaatattaatacatcaaaaaatttaaaattaataattaacaaaagataaagggccctgaactctagttttagagctgaattgtatccagtcagatagtttctatgttatttaaatgttcactttaaatttggagctgaaatatatttggaaatctttacttttagtatgttcatttgtgtgtgtgaggtaaacttggttggctattggcaaatgtattgggtagctgcttaataaaacatttccttccagtgcttcagctttctgatgcttagaaaatatgtataattaacataatatgcattatcacttttgaaagtaactaattattcgaacagttatttgtgccaaattagtaatgtgaatttgggaactatcagtcttttctatggcccggaataatttaaataatagaaattatctgattagatagaaatcattgtaaaatcatcaaggttaggatttcctttgacttttgcttatcattagttttaaagaaaaaaaataaattgacataatggaaattttcactgtacatcaggaagggaattcagtggaaaagtaagcttcctattcactcttgaccttcagtttatactttttttcctaagtcaagtactgctactggtttcttatgctctttctagaactagcctgtttattgtctatttaaaataactcattaatcaccttttatttgagctcccttatggatctgtgtagtttttctgtctctttaaaattttgtatgcggtaaaatgcacgtaacatcaaatttaccatcttagccatttttaagcatacagtttagtagcactatctttcacatcgttgtgcaatcaatctccaaaacctgttcatcttccaaaacaaattctgtatctattaaacagctctccgttcttccctaccctcaactcctggcaaccgtccttttactttctgtctctctgaatttgactacctcatataagtggactcatacagtatttgtctttttgacatgggcttattttacttagcataatgtcctccagttccattcatgttgccttgaaagacaggatttcattcttttttttttatggctgaaatagtattcatccatgttgtagcatgtcaggatttccttcctctttaaggctgagtgatatattccattgtatatatataccaacattttatttatctaaattcatctgccaatggatttttcagttgtttccaccttttggctattataaataatgctactgtgaacatgggtgtacaaataacttcaagaccctgcttttaattcttctgaatatatatccagaagtgtaatttctggatcatatggttattttatttttgattttttgaagaatttctgttgtttttaaagtcacttttgatggtttgttctttgctagaaaatatatatttcagttttatcagtgcagagttgtatataatacttacatattttgtacaattatataaaggttatattatatttccatattctcatataattatctttagtatccatgtttgtaactgtttactcatttctctttcctcattcacgtttactattttattggtctttaaaacctaggctttgattttgtttcctagcatttaaatttttctgtttcattaattttagctttcattttatttatactgttatttcttgaggcaatggcttggttcatctattttcagtttttaaaaaaactgtaaagtatttgtaaggctctaaattttattttattttttagttataggaatttttaatatattctggttattcaccccttatgagatacattatttgcaagtattttctcccactctgtggattgttgtttcatcttcttgatagtgtcgtttgatacacaaaagtttttattttgatgaaatccagtttatctgttttttcttttgttgcctgtgcttttttggtatcatatacaagaaatctttgccaaatccaatgttgaaaatatttttttttcctatattttcttataggagttttatagctttactgttaagttttggtctttgatctattttgagttaatttttgtatatgatgtaagaaaagggtccatcttcattcttttgcatgtggataatcagttttcctagcatcatttgttgaaaagaccatcctttctctattgaatggtcttagcatctttgtcaaaaattggtcatatgtgtgagggtttctttctaggctctctattccattggtctgtatgactgtgcttatgctagtaccacattgttttgattactgtagctttgtagtaagttttcaaataagaaagtgtgagttctccaactttattctttttcaagatagttttgactattatgcggctctttgagattccatatgaattttaggatgggtttttcctttttttttttgagatggagtctcgctctgttgcccaggctggagtacagtggcgcgatctcggctcactacaagctccgcctcccagggtcacgccattctactgcctcagcctcccaagtatctgggactacagggacccgccaccatgcccagctaattttttttgtatttttagtagaaacggggtttcaccatgttagccaggatggtctccatctcctgacctcgtgatctgcccgcctcgacctcccaaagtgctgggattacaggcgtgagccaccgcgcctggctttttttttttttttttttgcaaaaaataccattgggattttgatagggattgcattgaatctgtatattgctttgggtaatattgttaccttaacaatctaggaacgtgagatatctttccatttatttatgtttaatttctttcagcaatgttttgtagttttttattaagtttttcacctccctgattaattcctatgtattttattttggatgctatcgtaagtggaattgttttcttaatttcctttttgtatttttcattgctaatgtatagaaatccagctgatttttgtgtgctgattttgtattctgtgactttgaatttattagctctaacagcttgtttttggtgtgtatgtgtcatctttagggatttctacatatatatcatctgtgaatagacatagttttgcttctttctgtccaaattcaatgaattttccatctttttcttgcctacttgctctgtccggaatttctagtattatgccaaatagaagaagaaaaagtgggcatcctcatcctgttcctgatcttaggggaaaaacgttcaatctttcactattgagtatgttgttagctattggtttttaatacatggcttttacgatgttgaggaaatttccttctattcctagcttgagtgtttttttatcataacaggtgttgaactttgtcaagtggtttctctgtattgattcagatgatcatgtggagtttcttcttcattctattaatgtggtatattacattgattttttcattgttgaatcatcttgtgctcctggagtaagtttcacttggtcatggtgtgtcatccttttaataggctgctgattttgttgagtttttcatcagtattcctagggtgtattagtctgtagttttcctgtagtatttttgtctggctttggtatcggtaatgttggaccatagaactaatgaagagaagtgttcccttctctttaatattctggaagtgtttgagaagcattctttaaatgttgggtggaatcaaccagtgaaagctatctggtcctagccttttctttgggagctttgtgattactgattaatccctttactagttatagttctatttagattttctatttcctcatgagttagtttcggtagactgtgtgtttgtagaaatttgtccattttgtccaggttatccaaattgttggcatacagttttacatagtatcgtctcataattctttttatttttgcaaaatcagtagtgtcaccactttttttgttgttgttgagggggtgggggggatagagtcttgctctttcgcacaggctggagtgcagtgacaagatcttggctcactgcaacctctgcctcctgggttcaagtgattctcctgcttcagcttccctagtagctgggactacaggcatgcaccaccatgcctgtgtaatttttgtcttctttacagtagagatgggggttttaccatgttgatcaggctggtcttaaactcctgacctcaagtgattcgcctgctttggcttcccaaagtgctgggattacaggcatgagccactgcatctggccgtgtcaccactttcatatctgactttagtaatttggtgttctttctctctgtctctcttttatttatttatttttttgttaacctatctagctagagttttgttgactttttcaaagaatcagcttctggttttgtaatttttctccattgtttttctgttctctcttttcactctaatttttattattttctttcttctgctagctttggtgtagtttactctttttctagttccttgaggtatatggttaggttattgaatgagaactttcttattttttgatgtcagtgtttacaggtttacatttttcttttagctctgcattcactgcatcctataagttttagtatgttgtgttttcgttttcatttatctcacgttggtttctaatttcctttgtgattttttcctttgatctattagttaacattcacaaattttcacatatttgtgaattttttagtttttttatctgctgttggtttttcatttccattatgatcacaaaacatactttgtatgatttcagtttctttaaatgtattaagacttattttgtagcctaacataggtctgttttggagaatgttccatgtacacttgagaagaatatattgtgctggtgttgggtgagtttagtttttgacatgttacatttgagcattcatttaggagaaaagccaaaggaagacatttgttaatgaactgtaaagaggggttgacatcacaagaataggtaattttttttgagaaacaaatttagagcaacagaacagccttgaatatattcttatttagaaggctgaaggttgaatataacctggagtgttagaaaagggtggaacagtttatcatagaccagagccaagaaagtataatatttagactttaaatatcaaaaagaagatatggtcagctgaattcaaagttgaaggctaggtgtggtggctcatgcctgtaattctagcactttgggaggctgaggcagaaggatcacttgagcccaggggttcaagaccagcttggccaacatggtgaaatcctgtctctactaaaaatacaaaaattagccaggcatggtggcaggcgcctgtaaacccagctactctggaggctgaggcgggagaatcgcttgaccctgggaggcagaggttgcaatgagccaagatcgtgcctttgtactccagcctgggcaacagaggaagacaccatcttgggaaaaaaaaaaaaaagaagttcagaaaacagcttgtttgggaaggactgttttttgtattcctttaataattcaataaagaaaatagaaaaaggattttttttaaatttgagaaacatttaaatgatgaccactacttaaattatgaaattgaaaaccacaaatataaattatgcattctttatagtatgagttttagaggctgttaatttgctataatattagctacatctggaatagaagaaacttcatatattatcttatcgctatatttgaattctgtagaagttatttctggacagtctacgaaaagctcttgctggccatggaggaagtaggcagctgacagaaagtgctgcaattgcctgtgtcaaactgtgtaaagcaagtacttacatcaattgggaagataactctgtcattttcctacttgttcagtccatggtggttgatcttaaggtaacatgcttattctttctctactacaaactttaagaaaattaaatgaattttctagcataagtattatgtcaaagataattgctaacattaaagttctgactcttcgttgataagttcataggacttgcttttgttgttactgtgttcatcagcctaaatggactgagaatatgaagaaaacaccattttcttaaataagcataaatatacagacttgggtttaaaataatgtggcaattagggcctgaaatgaacctatatatggtataggaagaattgtatcagactgatgaaccacagtatgggtgctttgtgcttcttctggcagctggattttactgccatttgtgtgggtaatgtgttgatgttattacatgttagtaaagaaatactgcatgggtatttaaaggcttttgttttctgttggggtttttatagaacctgctttttaatccaagtaagccattctcaagaggcagtcagcctgcagatgtggatctaatgattgactgccttgtttcttgctttcgtataagccctcacaacaaccaacactttaaggtgagagcattggtttttatctaactatatttactgatgctgttatcctttataaacaaaaagactatagagattaataggttcacttttatcggtatttctcactattatgtattgatgttcgtttcaagaccttaaaaacttagtgttttttttttaaactttctatttgctgttctttttggcttcatttgtattactgagtatttttctcatagaaataatctgcttttttttttctttttctatagatctgcctggctcagaattcaccttctacatttcactatgtgctggtaaattcactccatcgaatcatcaccaatgtaagtccaaaaggtattgctaaattactaaaaaaatttttttctttcttttctttgcgtatttctttttaagaaatgcactcttggttttcaaaaaggttctgaatttagatgtatgaaataggaaaatttctccatggtgattctatttgataattgataaatatttgtatttttcatattaagtcttgaccgaagggaccatattaaggaagatggagttaataagatgctttggaaagattaaatctaaaacgttttattcagatcagaagcccttgagaaaaatgtcactgaaaatacagtttaaaattttcatcccgaagcttttcaaacatattatttcagcatttgatacattgacttgccaccttaccatttaagttaaaagtaatagtatttatgttgtagtctagtatagcacattgacaaaatgatgggactatatttgatggtacttttaaatcttttgatcctaaattcattcatagtgtaaaatttcatttttcttaaacaaaatgaaatattaacatactttaaagtaggtattaacaagatacaaaagcatatcagacaaagtaagtgaaatcattaaaaggtacttgcgaaaccttcaactctgtctgatgtggagacattaaatagacagcaaaactatcagatttggactgtggatttttaaaattctgttcttgtaataatgaacaaccctattttgaaagttttcaagtgttattttccattgttccacttttatcaaatgatactcacatttatgggtaaattggttgatgctttccttccttaaaggaggctgtaatcattgataacttagtatatttgacctgtttataatcaaattccattttaagactgtgcctctggtgagttgaaaataacccttcacctcatttgccctggatgttgtatttatttaaaataaatactgcccatattctatccattcctgcagtggaaaattaactattgataaagctatttggtgatacatttaatttttctcagcaggtgtttagtgagcattttgggaggacagtcctttgttgtgcaggatgccttgggcattgcaggacctttaagatcgtctggcctcatttcattaaatgccagttgtgctgcatctccccatccctagtcattatgaacaaataaacatgcctgagggaatgatacctcctcccttagttgagtatcactgagttaaattgtaggtaaaagtaacattgaatatgctttgttccaaaagggaaagtttaatgaagattgtaaataaggtatgtttgtattaaaaacttaaaaaaaatcactgtacttttgtcagcgtaatgagccagggcattgtaccttcaaggtttactttcaaggccattaaaacaaaaagatgatttctcccctcaagtttatgtgtaactcagaaataagtcattattgcttttttccgctgtggctcagaacactaaaaatattcaaagagtggatagctttgcataaatgcttaaaatttgtatacaataaacccaaatatatacttttttgatactttgtggctagttactttaattgtgaaatatttttgtctacaactgactacatagagcactttcaagcatggacttggcactgctgtaagtggctgagctgctcctttctgggttccaagcatgcctggagtggtgcttcatgcatgcctcagtgtacttggtgaaagtggctgtgcatcctcttctactctaatgagcactgcatgtgtggagggtggagtgtgtctgtatcagagatcaagttatatgaaaatctgtttttataaagaaaaaaactacattgaataatttttaaacattaagtatcagtaacttttcaatgaaatagcttgaaaaggaacataaatattagttcaaagtatctttttaaattatgctttgggtagtgatactttattattatagatagtgtgggaaattgtttctcgttaggatattttcccccttggtttgaggctaatcgctattgaatctgaagtactcttttggttgaaaaggactatttataaagtgaatatagaaatttatgagattgactattttagagtttcatttgaagacatttattatggcaatatttttgtcttgaaaaatcacatgaaattattcttagatatttggacttctgatcttaaattcattcgtagtgtaaattttttttctaatgattcttggttcaatgtacctcataagttctcttctcccatggttctttagccagtccacacattttttttaaagcatcacattctcaaataagataaaagttttagtgatgtgtattgagggtttgtgtagaagtagtaaggtgtttggagttctacttttgtgaaacatactcatactcagttcataagtactgagtttagatctaaaatattctagtgtttcttcttagaaaatctaaaatatatccactatttgattcttattataatgcaggttcctagcagttactaaaatagtagttgtactgtcatcttttttattatgatgtgccataagagatgaattaatagttgtaagatctatgttatatgcataatcttcatagacttcctttaggttaaattagatatgtaattgggaaatttaaaaagtaatatacacacttatgaaccaattatcttagccatcactggtacatgctatagctggtatattacttatttctgttttttccttacgacaatttatcgtaatttacatatggatagttcacatactgaaaatgagatgattgctttctactgagaggttgtagttgaaaggaattgtttccaaggcatttgaaaattatttaaatctcttaaggaattgccacataatttgttcatattatgtaagtgttgccatttggctataaacatggtattttcaaggaaaaaaagagtaagtctactttaattgactggtgttcaggaagggcacatttagtaactgctcaaaatactaaacttttttgccaaccacatgatgtctagtttttcatacttattttatttgaaaatgtgtattttactttaaaatgaatatattatgaaaaatgaaaactatgaaaattactaaatcttaagcctaaagttattttatgtggtgcacctggtaccacaatacggtttcaaaagctattaaaaaaagacacagtaatttgaataggatgttatatgggatgcctttcttagtttatcagtttctgacaagatcttacgagatgtgttgggtaaggaagacccttcactcaatgtactttgttattattcagctttttgttactttaggctgattaacacaagctgtataatttagtaagtataaggaaatcaagttgcattggttgctttgggcaagtcaaaattgctgagagttggaggaatccattatactatcagactaaaaattgatcatttgtagaaactagattaaataaagtaggagttgagggaaaaatgtaaacaaccatactgtcccaaaaaagcatttcttccctcccagttttgggattcctccctgaatggagttcagtattcaaaatgtgtatcataagttggttttatattttactatccggcgaacaggatttgtaatccacagtttgggttaaggtaatataactcgatgctattcaaaatattctgagaattccaagtgaagaaattaaaatgtcgagacttcaattagcttagttttgaataagaaaaaatctgggactgaaatgtgagagatgtgaggctattcaatccctcttatctacaatttgaatgtattattcttccagattttttaaataaacatctggagtattataaattagaagcctacattttaggtcatttaatgcatagtctacatatgtagtgaaaattcatccagtcagttttttattaaatgatagactttaaagatatagtgattttcacaattgtcattttttaataatatatcaagtaattcattttaaagttaaagatacacttccaaataaaataggcactaaaaactagacatcagagttaaacagggtaaattgaaatagaaaatacataaaataattgtttaaaaaatatttcactaggatcagtttgtctttgtttatggtaattgttagtctcccatatatcatgtcatcattgcatatcaatttataggtttacttaatagttttatttcatttactaatttcatgttgtaattatcattgttgtctgtaaacatataagtaatggttttccacatacacttttaatactgtgttgaaccactaatcacttttaaagctttgataatagcattcttacctgggaaaatatatgccatgtatgcacgtgtgccagaaattgtaaaacattaaacttaaaaaaaaaaaaagaagattggctacagattagctctctgaagactttatttttcaaattcactggctaatcatcgagaaaagatgtctcacatgcacatgctcataaagtgggcaatttgtctcatgctcactattatgttttataatataatatgtatgagttagtgtttgaattaaagacgttgtttgaagactttggaaatcatggtgtgtgtttgcatggtcttagaaagttcccgacaaaaggataaaacttaaaactacagtgataaacagagcatacaactcacgtaattttgtactttttcttcctattggtctttgtttttctctagtccgcattggattggtggcctaagattgatgctgtgtattgtcactcggttgaacttcgaaatatgtttggtgaaacacttcataaagcagtgcaaggttgtggagcacacccagcaatacgaatggcaccggtaagataaatcacgaattttgaatctcacctcctttctattgcattttttttagtgtctttatcctattcctgctgctttggttattttagagaattgaatgggtccttcatttcctctaaatgttgtggtatgttgtatctagaatattgttgaatactagattatgtttgttttccactgtttccatgagttgaacttaacttttcttagataaattttctcacaaaacactgaaagtcttaatgaatgtcaccttttttttctgtttttaaagttttttttctccttaaaacttttgaacaaaaatattttgattagcctctcacgttttggggatgagtaagggaagctgactcctgggttagagtgaatgttgctgccaatgcacattttagctaattgaatggtgactattaaacataggaaatgaataaaatttagagtttttgtatttaaaataaaaatattttgtatttcaacaaatatgccttgaggttttacaactgataggaactttgatactgacatttgactctaaacttaataaaaagcagacttaaaattgggtattctcacagattattactcttaatatggaattttaaaactcctatggaatcaatttaaaaagataattataagattgtggaagtcatttttttggtgtttatgtatagcaagagtattatacaagagcaactcttgacattgattggtggtgctttgtcttctgcttcttattttctattattggctgctgtcgctcacatgatcagatgccaaccagtcactgttttgcatggcagtgggcttctgtggctgtaagtatgacccattgtaactacatcagaaaagtccttggtttctttgacttttctgtgtatagttaccattatagtcacatcttgtcatttcaactgaaaatatagcatgtcttcacctgttggttttatctagtaagttagtcatttcacagttaggagataatttaaacagctttctccctggcatgcttctctttttccaagtccccttagtcagtgaaatattttggttttatacagttgtggttcactcttatccagttgtcagtaattatttctgaggattgtttatcttagatgttcaaatagagaagttttttatgtcatatattttgggattattgagcctaaaaaatatagccaaaagatcatggcaatgatgtttccttaagtaaactttaaaatgcaaggttaccttttagttgactttttgtaatgccaagtacttcacttttttttaagttgaagaaattttcagtacaggtataagttaattggaggtaagcataaataatagctgtttaaatgtcatttaataagatatttttaaaaaatcttttaaaactacttgaaataagttgtttaaaagttatttattgacctgtttattccagagatctgggaaatcagaagtttatttgacttttttgctttaagtttactaccttttctggtagaaagttaatgacctccaataataggacttgttggggggttaatattcacttcctatttaacttcaatatccactttaccagctgcccataattttctgtgaataaggactaaaaatgaaactaaatgattattttgaacagaggtaaaatttgattggtagtctaaatatgttctctacacttagaagttattttacttcttagccctagttataagctgattctcagagctacatattattttaccgaaaagccataactagagaggatttcctcttttggctcaaggacacctgtaataagaatttagtttttatttctaattattttctgaaaatatcaatatacatttaattttcaaaatcattcctaagctgtttatgtttttgaaatgttatatgtatgtatatttgtacataatgactaaaggacagcttttgggctgatattaccaggagagaaaataaatagcaaatgtaatatgaaacaatttttagaataagaaaattttaggttttgaatggctgttagggtaaaatctcacccttcataaacttggtgagttaacagtcagataaccagtatggaagtattgaccttctactctttgccaggcaaaggtgctaatgccagggaagcatggtgaactaaacatacacagcacttcccctcaccgagattccaagcaaaaggtttatagcttttgcttgaaaatgtctaatgaagaactcaacaccggacacggtggctaacgtctgtaatcccagcactttgggaggccaaggtgtgcggatcacctgaggtcaggaggtcgagaccagcctggccaacatggtgataccctatatctactaaaaatacaaaaattagccaggcgtggtggtgcatccctgtaattccagctactcaggaggctgaggcagaagaatcgcttgaacctgggaggcagaggttgcagtgaactgagatggcgccattgcaccccagtgtggacaacaagagcgagaatcggtctcaaaaaaaaaatcaaacaaaaaaactcactacaggtggcatggagtctggcaacacaggcaaatatatataataaatggtttacagataatacctaacatcagagtttcctactgttggcactattaacattttggactggataactctgttatagggggctgtactgcgcattgtgggatattcagcagcatctctggcctctacccactagatgccaatattccctttaccccccagccctccaagtcatgaaaaccaaacatgtctccaaacatttccagatgccccttgggggacaaaatcacccccagttgagaactactgtattacagagtatgttcagtgggttgtccctcatttgtattgcctcaaatgatttgggactgataaacctgagccattagcttgcttcagaagtagcaatctaggagttctgttgcaaaacagtaaaagtaaaataatatctgcttcaaggctttactaacactttgtattttggagagacaagttacttgttggaaggagctaattatttgaaaattttctcttcgaccaagatagaatcatgtctctgtcacttacagccatcactgatcctctttctgttggagctctatagaatacttctgattcttccacaaggtggccctgcagatatttgaataaggttattctgtactcctagaattcgttttatttttatatcgttttggcattggaagggattttattcttttagctctctctctttttttttcttcttgagacagagtcccactccgagtcccactctgtcacccaggctggagtgagtgcagtgatgcaatcttggctcactccaacctctaccttccaggttcaagtgatctcctgctttagcctcccgactagctggggttacaggtgcccaccatcatgccagctaattttgtgtttttagtagaccatttagcaccattttgggcaggctactcttgaactgtgacctcaggtgatccacctgcctcagtctcccaaaatgcagggcttataggcatgagccactgtgcctggcctcttttagctctctttaaaactgtatgtgtgtttgttgggtctgtttttatagctaaagaaactgaagcttaaataaagttatattaataacaaatgcatggttaatgaacagtcaaccagagttagttctgaggtttcttgacattcagttcagtgtctttatcaggttctttagttgtccttcttcactagcaagttagcttgatgaaagcagtagctttgtctggcttaatcaacactgaatccctaacgtttgaacaacatctgatacatattgggcatttagtacatgtttgcagaatgaatgaaggaatgaatttcttacttgatgtggtttcaaaatcctcgtacaggccgggcacagtggctcatgcctataataccagcacttagggaggccggggcgggcaggtcacttgagaccaggagtttgagaccaactgggccaacatggtgaaaccttgtctctactaaaaatgcaaaaaaattaggcaggcgtggtggcaggcacttgtagttatagctactcaggaggctgaggcaggagaattgcttgaacccgggaggcggaggttgcagtgagccaagattgtgtcactgcactgtcagcctgggcaacggagcgagactctgtctcaaagaaacaaaaacaaaaaacaaaaaaccctcctgtttctgatttgcttctcttctggaaagaccaacctgacaaaaatttttaaaattaaaatgccatattaagatctgatgttagtgatacagatataatactatgatgtaataattgataaaagctattaaactgctgtgtttgtataccctgtttctattaatacaatctaagatagtattattattttatgttgactttttagttatttaaactctttggccctttttatatgaatgttgagccataacttctcctttgtacctttgtagtatttttttaatatttgaaatgtttgtcttagcactgattttactatttgcaaactaacatctcctgctttcataaaattcaaaactgccaataacagatatatgaattttcacaagtatttgttatttctcaacattttttatcttaagtggcatgctggctcaccagatctttcttacatgcctgttattcagtcacatggtctaaattaacaagtggtttgggcctttaatagatatctgaagactctggttcatgaatttcttcccagacatgattgcctctcatctttggccagatcacatgtaccagcttctattcctactaatacctgcaatatagaagatcaactaatgaatgaatgaatttttttcttacatttctaattaagaaacacattgcttctttagcatgtttttcctcactttctgtaacccactaaaattaaaaggtatttgagatgaattaaatttattggaatttctgaagtcatacatttcatattaggcaaccatgttggaacagaatttacatgttgatatttgggattaagaggtgacataattaaactaatatagtcatacatcacttaatgacagggacatgtcttgagaaatgagtgcatccttagtgattcagtcattgtgcaaacatcatagagtctgcttacatgaacctagatggttatatagcctgctacatacctaggatatatggtctagcctactgctcctaggctgcaaacctagactaaacagcatgttactgtactgaataccttaggcagttgtagcacaatggtaagtatttgtttattcaaacagaaaaggtgcagtaacaatacagtataaaagaaaaaaatgtataggacacttaacacaaatggagtttgcaggactggaagttgctgtgggtgagtcattgagtgagtgttgagtgcatgtgaagcctaggacattacactactgtagacttaaaatttttttaaatttattttacttttaatacttttgcatttttctcatactcaggatctatactgtagactttataaacactacacttaagctatatcaaatttataaaaaatatttttatatgataactttacagtagcttttaaaatataaacttttaaattttttaattttttgacttgtaataacacttagcttaaaacactttgtatagctagctgtataaaatatttttctttatatcctgtaagttttttctatttgaaaatgttctattttaatttttattttgaaaactgttttaagatctgggacacaaacatacacgttagcctaggcctacatggggtcaagatcatcaatcagtgttactgtcttccacctccacatctgctcccattggaaggtttttaggggaaataacgtgtggagctgtcatctcttgtggtaacaatgccttcttctggaatacctactgaaggaccttctgaggctgtgtttcatagttaactttttatctttaagtaggagtataacaatacaaagtatactatagtaggctgggcctggtggctcacgcctgtagtcccagcactttgggaggccaaggcaagtggatcacctgagatcaggagtcgagaccagcctggccaacatggcaaaacctcttctctactaaaaatagaaaaaaattagctgggcgtggtggtgcatgcctgtagtcccagctacttgggaggctgaggcaggagaattgcctgaacccgggaggcagaggttgcagttagccgagatcgcgccactgcactccagcctgggcaacaaagtgagacttggtctcaaaatatatatattataataaatacataaaccagtaacagttatttattctcatcaagtattgtatactgtacataattgtatgtgctatactttttttttatatgactagaagtgaagatttgtttacaccagcatcactacaaacaataacgcattgtgcttggacatcacgatggctatgatactaagtgataggaatttttcagctatgttacatattgtctatcattgactgaaatgttgttttgtggcatatgactctatttacgttttttggaaatgattcttaaggaaaaattctgatacctgctcattgttctctgatcttgtgttcctgtgcaatggctgcatcagggaagagccatttgatagttacacttagttacatcaaagtaaataaattcgtttaatcaaagtttcagcttgatctgaggtgaaacacctcaacttagagtgaggaaaaaaatacagttgaaagagagcaaacagtaaaaccagaatttattaaatcatttagtaaaacatttgctttggggtcagggggcagttataaaaagcaaactatttggaagttttgctatttctcttctgtagtgacattcttgagtataaatgtgtgcattaaatagctattcttccccgcaaggactaaaacccttcggtgttcttgggtataataacaaatgcatatttcacttaaacattgaggatagttcatttgtgttgtagatatgcatgtctgcttcttaactttgaaagacagcctgtttacctggacatttgtattatgggtccacagttggtacacagtcttgttatttctgtattatatatatgtttacataaagacattcattcagaatcagatagttttgtgttcttttcaaggaaaaaaggaaggagatgttttataataataggtgatgttagctctggaatataattgttggatttttggttgaaaaacatttataattattttaattcatcatatgtctctataattgaaacatattttctgtaagtttacctttctgagttctttctgttttacaaatgttcttcaggcaaaatgcatgcattctgtaacttaaaagaggtggagtgccgtcgaaggaaaaagcaaattttacaattaaactagtaaatacaaagattgcctacatgtttcattaattctaagaagcacttatttttactcttctctaaaattgggaatgtatcttattttaaatggtgtcttacaattgacagcagtttttcattccttttgggacatcaaataatgatgcatcttacaattgataatgttgtagagtctatgaaatacttgtatgtatgtctggggaatgtttgttaaataaattacccagtgtgtatatttgtgagaactataggccaaatcttttttcccttatgtttttacattttagaaaatagttttttacatagatgttttacaacctgatactaagcttttagtattgtaatagattttcattgttttattagattgataaaaaaaaatataaatggtgcaaaaacgattttcattgttttgttaagcttaataatactgaccttatgcttactattgagtgtttctactaataccacacatttggtagtataaaaaatagcttttttcaaaggtttttaataataaatttcttttaaaaggttggatagctattatcctgagtcttatgtctgataccatgtttttgttttgtttttagagtcttacatttaaagaaaaagtaacaagccttaaatttaaagaaaaacctacagacctggagacaagaagctataagtatcttctcttgtccatggtgaaactaattcatgcagatccaaagctcttgctttgtgtaagtatttttttatgaaatgtctcaaaattatcacactaagttaattgggtttagctgaaacgccaagaccttgaggataatttttagctcaagagcacttactgatcctttctgatcatacctgaaaactaagacgtctctaagaaaactaatgtataatgaatactaatataattagatcagattcttaattgcccttatcatttcctaacatttctctttcttcttaatttccctatcattaaactaacatactttgatgagatctctgttctcatcctattactaagttatatattattcaggtataatcctggtatgggggatagaagtgaccatcgatcacagtgtctacatctatactgttggtttaaaaaatctccagattgcttttgccagtttagcttttctatccccctttctttgtgttatcagctttctgttatcattggctctgcctacaaatactgtattggaaaaagaatgaggtgaaaatgggtgtggttagtacttgagttagtgtgattatcattattattattattttgagacagggtcttgctctgcttcccaagctagagagcagtggagcagtgatggctcactgccttcgaactcctgacctcaagccatcctccagcctcggcctccccaagtgctgtgattacaggcatgagcccccatgcctggctagtagtcagttattgtcataactactcttactgcctcagatgatattaaatttctgagaacatcactctggtacacagagtaattaggaacaacgcaaataataaaaatgagtcataatgaagtgattaacagcatggacgctggagactacctactagctatgtgatttggatgactatttaatctttctatgccttagttttctcatctgatatattgggatcataatagttcctatctcagagatactgttaggaaaattgaaatagtacatacaatgctttaggaacaatgcctggtgcataataagcactaaataaatgttagctattattgctattaataagatacaatttaacactaattaatgcaccaaatgtaatagttctatattgtgtctttcataggatgacatgtttaacctttgttgagcttcttcagtccctggagagcagcatcaagcaaggtttcttatcgttttgctcagtaactggctttttaaaaagtgttaaggtgctttcgattttggtggcatattttttaaattactgtaatacagggagtttgtaactacatgcctatgattccaagagttctatgaaacttcgtgaattttttaaaaatgtgtatttatgagtaatttttcttggagagtggagaggagagaagaaggaacattcccaaaggatcagtgaccccaaaagaaggcctgtgatactttaagcctgaaaaacccattcaagtttgaaagtctaattagaataaacagatctttggcatgaaaaaattccataaaacctgtcagtgaaactctataaaaaaatgaagttccctttctcttcattcctttgttatgtgttacaagctatttgtggcattatttcatcatgaaggtcacataatactagcagtactctgtttacgtggtgataattcacattcaaagcaggcaccaaactcaccaatgccgtttctactaaatgttgcttcaagaagaatttaagcaaaacttgccattttccaaggatcatttaaaatggaaattatttgctttgctgccatctagtggttaataagttttctcaaggtaaccataagtacattaaaatagaagattcgttgtaaatatttgaccattttgtcttttacataaaaaatctgagtcttagtaatttaggaggaatgtaggaataattattaaatggtctcaatcatggtatttttaaagtaatatgattttgtcttccattttagtactctcaatttctcaagcctcctaattactcagcttgcatcgtttcttagatccccctgatcatttctccacactgaagttatggcagtctctttaaaaagcaaatcttattatgccccctctcagcttgaacccttttagttgaaattgctcttgcttatgaagaccaaactccaaatagatctacagggtcgtgcaaaatctttctcccatctaccatttcttccacatgtagcattacattttttgtcttcctttactctattcatgatggtcttcctttcagtctttctaaccacatgccttcatacctcccttgcagttgcttttccctctgcctagaatctgcttactcttaacatagtaattcctactcattctaagctattgtcactgcactaaggaagcctccctgagtcggacacttttccatgttataggctgtcatagcagcatgtaccttaataatagctcttatgtgatttgcatttttatacttgttgatctgattatttcattgatgatatcttcccccatgagactacatgctcatggaggatgggaaacacatcttctctttttcattgttgtgtctttggcattcaataaaaatgatttggttttggatgaatttatatgaatgtcagaaaataagctaacggttttgaattacagatatattgcagtgagggcttaccttagtcattataatggggaaaaatctatagttagcaaaataaaatatgggacacaagttgcattggcttcatatattcttcttttttttttttctgagacagagtctcactatattgcccaggctagagtgcagtggtgtgatctcagctctctgcaacctccgcctcctgggttgaagtgattctcctgcctcagcctcccaggtagctgagattacaagcacccgccaccaaaccggcttgtacttttaggagagatggggtttcttcatgttggccaggctagtctcgaactcctgacctcaagcactccgcctgccttggcctcccaaagtgctgggattacaggcatgagccaccatgcctggccaaaccatatattcttgaagtgcaaatatatgcttccaagttaagagaaacattttagtctctaaataggtaggcattcggcagggcgtggtcgctcacatctgtaatcccagcatgttgggaagccgaggcaggtggatcacctgaggtcaggagttcgagaccagcctggccaacatggtgaaaccccatctctaataataatgcaaaaattagctagacgtggtggcgcatgcctgtaatcccagctactcgggaggctgaggcaggagaatcggttgaacccaggaggcagaggttgcagtgagccgagatcacgccattgcactccgtttcaaaaaaaaaaaaaaaaaaggtaggcattcacatttttacataacgttaattttctttgcttagtacactatatttttccacgatgaaaaggaccgaagtatgggtatctgccgatgcaaattctagcctttgctttgttaccagctgtgtggatttgggcaggacctttgtatgggtcaagagggctgtacaggataatcatgcaatccttatccaacatgtatgtcctttacctttgatcacaatcatgtataagctcaaaaccagtaagttccaaaccagagatacgttctttagccagtttactattgttggaaaaaaaattattcctcatattgttgatgtaatttttaatgggaattcgtggtttttgttttcattaggattttccctggacattattcacattaatgaacaagtatagatgtggattaaaagaatccctaacaaaagaagttttgatttaataaaatttttattttattgagataaaaatactatacccacataccataaaattcaccatcttaaagtttacaattcagttgttttcagtatatttacaaggttctgcaaccattaccactatgtaattctagaacttttttttctttctttcttttttttcttttttctttttttcttttttccagatggagtctcgctctgccacccaggctggagtgcagcggtgcaatcttggctcactgcaaccaccgcctcccagcttcaagcgattctcctgcctcagcctcccaagtggctgggaccacaggcgcatgccaccacgcctggctaatttttatatttttagtagagatagaatttcaccatattggtcaggctggtctcaaactcctgacttcaggtgatccacccgccactacctcccaaagtcctgggcttacaggcgtgaaccaccgcgtccagcctagttctagaacattgttatcacccctaaaagaaacttggtaccctttagcagtcactgtctatttcttcctccttctaatctctctcgatttatttatttttttaattgaagtttcctttttttccttgcagaatccaagaaaacaggggcccgaaacccaaggcagtacagcagaattaattacagggctcgtccaactggtccctcagtcacacatgccagagattgctcaggaagcaatggaggtaaggggaaaatgaattccatgttcttgaaggaaagattgtaactatgtacattcatgatgttcctttggtgtgtggtttctgtgagtaacaggtagatgtcatttctggaaatggtatgtttatgtctatacattgttttataaaactccatggagaaagaaggggtttacttgctttgtatcacatagcaataacattgtacaaattctgatgcttaataaaatagttcgagattttctaattgcagttgactttaaaatttttaaaaatattattattaaatattaaaaatactaatttttaaattgagacataattcacataccctcaatttggccattttaagtagttcttttttttaaattttattattattgtacttttaagttttaggttacatgcgcacaatgtgcaggtttgttacatatgtatacatgtgccatgttggtgtgctgcacccattaacttgtcatttagcattaggtatatctcctaatggtatccctcccccctcccccctaagtagttcttattcacacagttgtgcaactatagctactctctaatccataacatttttatcaccccagaaagaaacttgactccccattccctcatccctaccaactactaatctattttctgtctctatggatttgcttgttttagatatttcatataaatagaatcatagaatatgtggccttttatgtctggctaccttgacttaatgctttcaaggttcatttatgttgtggtatgaatcactattttcttcctttttattgccaaatatttcattgtatggatctgttttgttcatctagttatcagttggtggacgtttggtgttgtttctactttttagctattacaaataatgctgctatgaacatttgtgtaaaagtctatatgtggacatatctcttaagtatataggagtggaactgctaagtcgtgtggtaactctgtcgaacttttgaggaactgtcaaactctttttctgaagcagctgtatcattttatattcccagtaacaacatatgaaggttttaatagttctgtatgcttgctaacacttcttataatgtgtctttttgattgtagccatcctaatgtacatactgtacaaatgtttatacatacccagtaaaaatgtttataaaaatattttagcacttactacgtaatcattgcttccatttgtgtacattgctattggtcccgtaaattgatacatttcttgtagtctttttggaaggctatttggcaggagctatacaaacatttcatttttttatgcaaataattcaatttctatcactttaaaaatcttatgaatataactcaaaaggaaaaagctgcacacataggtacttattgctcttaattataatagaatattaagagagctttatttactgggaggagaatgggttaatattcaatagtgagaatgctattttaacttggtgagctgttaaacatttattaaaacttatatagatcacacagcaatatggaaaaatatgaaatgtcaagtgagtatactgcatttatggctttgttaaaacatggaaaatacaaaaaaaagaaggcaatatgaaaagaaaattaaagcctggaaaaggctaacacattttctttcaatatgtatttttaaagttttatcaaacaaaaatatagagaatttgtcacttaaaaaaactagtgccagtaaattgtaccacgtttttgtacaatagtagcaaaattgaattttaatttgtgttgtttttccttgatatgagagctataaattatatagctttttaagattctcaacaattaattgcaattttcattaaatatctcaaagtaattacaataaaaatgtttgaaataagataatatgggtctggcctttaaatgttgatatgttgaccaaggactgaaagaaatgtccagagcttcacagtttctgctgggttgggggtggagggatggtgggaggaatgtgaattgggattgtagaattggagttgagataagatcagttcgaaggaagagtttgtgttttttttatatctttgatggttttaatttatataataatctatttatatgttatatattgtaaatgaattatttaattcccgttagtgttctctgagccagattccaacttcagttctgtggtcaattgaaatactttagaatggataatctgctatgaaatactgaatccattttgcttcctctctcttgattttgaaaaataattgctcttttctgttacaagagactttgtggcaagtgagacagtttaagtaaaaacttaaaagataagtaaatcttttgctgtgtgtattaattttggcaagccttcttacttggggattagctttttgtttcatagagttctttaatatctattgaaattattttgtttgtttcttaaagcagtttttacagttatatattgttccgaattcatcatttagctttatatgtacatgccagttagagtcagaatgatgggaataaaatgatttcattctgtctgtattattccctagaggtttgtgttcaccagagtttctctctttttaccttttactatatattgaaactacaaatgaaagagctcaatttcttagcatttataaaataagtactccagtgttatgtttaccaaaaatgtttgagtgagtcttctctttgtctttctcttttttaaaaaattcaggctctgctggttcttcatcagttagatagcattgatttgtggaatcctgatgctcctgtagaaacattttgggagattaggtatatgtacttttattttttaaattcaacttttaaattttattttgtatttttgtcttgaaatattaactctgtagtacttagtacattgtaaaacttacacttccaaaggttttatggttttgtattttatttgacttcaaattattagaatttcttgttttaactgtaagaaaagtatcacagcaatttagaaaataaattttaagaatagtgctaaattttgtcaccctaacataagtactgttgtttggtatattacttttttcagatttcaatgtggttactactgtatttttaatagattttcatagttataagcctagaatgataaaattttgtaacaatactgttttttcagttttttgaactatgatctttcataaactttctgtaataccaatgctttcgatgaatgaattaataatggacacctgcttagaagaaaaaaatgtatgcagaattttgtggtctgcttcctagattatacaaatcattacattttaatgagcatgaagtcaccacacggaggaaaatgtaaatgtgtaaacctcaagtttgccattatcttataagaatgggtgtgctaagttacttggcagctgaattaaaccttactctagagtagtgctgtccactagtaatataatgagaaccccatatgttaaaaacttttttacttactacattaaagagtaaaaagaagcaggtaaaattaattgtaattatgttttgtttaacccggtgtatattatctataatttcaacatgtaatcaatataaaagttattaatgacatttcattctcttttttttaataaagtcttcaaactttggtgtgtcttttatacttacagcacatctcaatttgaacaagccacacttaaagtgctcaatagccacgtgtggctggctagtggctaccatgttagacagtgcagctctggagtagggatcaggaaacttttctctaaaaggccagatagtaaatattttagggcttgtgggtcatatagtttctgtcataaccattcagttctgcctttggagcatgaaagtggccacagacatgtgaatgaacgggcatggctgtgtttaactaaaactgtatatttacaatagcaagtgataggctaggtttggcctgtggatggtagcttgcagacccccactgtggagcactgggtttataggcagtctctgctgtgcatgtggtttattgtttcttcttatgtctactacaaggatgagatacatggatagaaacactgggagtttaatgaaacatagggggcttatagataaatacttgctttttttctataacctgtagacttatttcctttgattataatgctattgacactttgataactgtttctctaaaaccttacaagaaaaactaagcttctctaaacttgtattcattatgggagaatgccattcttatgtctggttatatctgcattaggttattgatgatgctagtaacaatgaactttatgttactgcagctcacaaatgcttttttacatctgcaagaaattaactagtcatcaaatgcttagtagcacagaaattctcaagtggttgcgggaaatattgatctgcaggaataaatttcttcttaaaaataaggtaagcaaaatgacatatttaaaaaatggaagaatatttggaatggtaatggtgagagattactaaagtgttttatagccaaattaggttctatttcagcttctccttcctcccaatgttctcaaaaggaaatatgtatgcagaggacaatgactggcaaatcagcattttaaaaattattctgaggctttggccttagaaccacactgttgatgaattctagttctagttgagttaaataggtctctatggggcaggcctaggaaaagtgggggctgctataaccagagtagcttgaggagcatattgtatctttactcttaagttcatacataagacataattcatacataaaatttattttaacatatagcttctgtaatttaagaattctattatggcgtagatttgggagtacttgatttaatgggtttttgtccagttctagaatcatagctctgagaaatcgtaaagacctagatctcatggctagactagtccagagaattatctatcaagaagcaaaagggaaacagttgagggtcctcaatctagatttatttcgattcctccaataagggtttcacctcttgaaaatatcaggagactttttcattggggtggagtgaaatgttttgattctgaactattgaaacatggtgaggttgtggaagatagagaagagccttaaatttcttttaacatatagtttctgtaattaatcaatttaggaattctgttatggcctagttttcggagtacttgatttaatgagtttttatctggtactagaagcatagctgtgaaagaccttaaatgtatgaaactcatatccttttcagtatttacagcttgttattaataaattgtctctttagaaatagactaatggtgaagtgggtttattcacatgtgacttatttgatatgttaatgtagtggaatttggcattattccaaagatacagaaagagattagacttcagactttcatggcctcgcctatggtataatctccagaatgtgagtatgaggaatccagtaatgaattcatagtgccctggtaggcatagtcactcttgtgacatacttggtgtatatacataccagagttaattactggtccagaagaacttaatctcaagagccaatttctggttatcccaacatggcacagtataaaatcttatggaaaaaaaatctttgtcattgagatcaaattatagttttcatacagtagatttatattgttgatgttttactcatgtttatgtcagacttaatttatatttgtagaatctactgtttctgatgatttagagaatgggaaactgaaagaaattttaaagaattaagtaaaccttgtttgttctaatgggtttctagtgaatctccttcaagttggggcatagagattgagaggagaggttttttaggagagtctcaaacaggaagacaactcaaataagtgtttattcctcttggttgtcagtgcttcagtaaagcttatttatttatttttttctagcaggcagatagaagttcctgtcactttctccttttttacggggtaggatgtgatattccttctagtggaaataccagtcaaatgtccatggatcatgaagaattactacgtactcctggagcctctctccggaagggaaaagggaactcctctatggtcagcttcttctgtactttttctgtatcattttatgtgctctgtttgttttctgaatgaaatttggtaaatttcatctaggtaatatagtgtaatagtgaaaaactgcttagaatctagttctattactgctctttgtggaactttgggcaagttcttaacatccttgttcctcagttcctcaactttaaaatggggacagtaatagttcctgccccagagttgttaaagagggttaaataaaaggatgtgtaaatagcacttgacacttacaagctatatctgataattataattattataaacctccactccataaaaaacccattcataccacagaagtatagaattcgtaccggctaacaaaggtacagatttacagggataaaaacaaagtattttgcttcatgttaaagataagtgtttctgtgatttgtgtttgtgtgtataatttcttttaaatataaatcatatttcaagtgaaaatatcacatcattacagaagagtttattttccaaaccaaaacttttttcattcctaatttttaatgcaaccttgttaaggaagaaacacctaagcagtatgatatttactaatgtctgttttacttgtagaatttgcatttattttatcaattattttctccatttcgtgtttggagaataagtaattcagaatcaaatgtatcttctacagcaatatttagttcttgtttatgcccttgtttcaatgagtgctgcagtgtacttattttattacttccctatagcaagtagatagaatttcctgttacttcctctttttttgtcatttctaattgactgggaggtacattatattgttactgcagtagatttacgttatggtgtttacctgtccatgttagaatcagtttacatttctggaatctggaataggataatatctatttgatttgaaattgaacagatggtagcattatgttggtccagataatctcatttctcatttggacaagatattttggggtttgaaaaattcctataatgattaaaggaaaaagctcttgtgagttattgtatgcggagacacacacacacacacacacacacacacacacacacacacagtttattgcattgttagattttatacataaaattacccaagttgcaaatatatgtcttccacccttgactctcaggatagtgcagcaggatgcagcggaacccccccgatttgccgacaagcccagaccaaactagaagtggccctgtacatgtttctgtggaaccctgacactgaagctgttctggttgccatgtcctgtttccgccacctctgtgaggaagcagatatccggtgtggggtggatgaagtgtcagtgcataacctcttgcccaactataacacattcatggagtttgcctctgtcagcaatatgatgtcaacaggtaaatgtgaatagtggttttttttactcagtctgcctcaaagcacatggcatctgattttgagaatgtatttaaggtcactactttgtaagtttacaggggaaattcaagtagcttacttgaaatccttttctgaacaaagtaagatgaaaataaaaagcatttgaaataaattgttagtcttccactgagttgttaatatgctatacattttaaaaataactggcagtagatgttactatcagttatgattatgtaatttactctgcctaagttgtagatagtgaagttttacaaacattggcgtatgttttgagtaaattgtaggtgggaatagctattttattctgtggacattgtagagtccaagataagtacctttcctgtgaggttagtgaaaggaagtttttggctttatcatttgaagcatttgctctgctcttcctactccttttgggtggagcttatcaggttctccattggcaggcagggctctaagtgcagtaacttgatttgctgttgtatttgcttaggaagagcagcacttcagaaaagagtgatggcactgctgaggcgcattgagcatcccactgcaggaaacactgaggtatgcccttagcaacagaaacacccctcccaggcgcccaccctcaatttggaagcctcttgttacatatgtgtgatcaggaatagcttttgaagtaaatccaagatacgtgcatattacaagtataatatctgagtatttaatatacatcaagtttgaaacttggctgtagctgattgatgtttagctctagactaagttgctttcaagtgataattgccttcattttaggcttgggaagatacacatgcaaaatgggaacaagcaacaaagctaatccttaactatccaaaagccaaaatggaagatggccaggtaagtctgtaaagttgacttttgtctgttaactgatctgctaaatatatgtacttcactttgataatctttcaagagtcgctcagtaaagtaaacatatagctgtgtgaagactgatatttagttgtggtttatctagacctgtactttgtaatgtggtagctactagctatgtgtgactatttaacttaaattttaacataattaaaattaaataaaatttagttcctcaatcatatagtaaccacatcgcaagtaccagtagccacatatgacaattacttactctattggacagcagagagagaaaatgttcctgtcatcacagaaatactgggcagcactgctagagactgtttgttgcagagaccatttctttaccttttcttgctctttctcccttcatcagggtgtttcacagaattttcagaaaaggagcaacagaggtagagataaattaacatggaaacaattcattttgctattttgttaggtattctaattaaggaatgtcttaggcagtagattgatcccatagagtaaatgaaattttaaaatgtggacagttcattcaactattactattgactatattatctgttactttggaaattaatgatcagttagtgtttgtgtgtatttgatttgtaatgttcatattgctctcattattaggtgatttataaaaactggttgttcctccatggtgtttttgtcatgcttaattacaataggaaaaagttatatttttacgaagcaaatgtgtgtacctaatacctttatttggaggggacatgtagctttagaatgaaagcttttggggggataactgttttatataattacataccatacagttcacccatttaaagtgtccaattcagtgactgtttttaatgtattcacagagttgtgcaaccatcaccacaatcaagttttagaacaatttcatcaattgagaaaaaaaccccgtaccctttagctatctctgcctctaaccaccccccacccactttcttgcctctcttcccccaacgtctctagccctaggcaaccatgaatctactttctgtctttgtagatttgcctattccggatatattctgtaaatggaattatagaatatgtgggcttttgtgattagcttctttcacttagcatgatgtttccaaggttcatccatgtgaaatcaaaactttttaaaagaaatttgacactcggctgattatattagtgtatgataaaaatagatcagtggctctttaaaaatgtatatggtaattttatgggttgattttaatgtatattttacattttttgtacttttgtcatggaagaaatgttggataaagcataatttgtcaagtctcaactaattaaggtttaattcatgctttgcacaaaaattttgtgtttaggctgctgaaagccttcacaagaccattgttaagaggcgaatgtcccatgtgagtggaggaggatccatagatttgtctgacacagactccctacaggaatggatcaacatgactggcttcctttgtgcccttgggggagtgtgcctccagcagagaagcaattctggcctggcaacctatagcccacccatgggtccagtcagtgaacgtaagggttctatgatttcagtgatgtcttcagagggaaacgcagatacacctgtcagcaaatttatggatcggctgttgtccttaatggtgtgtaaccatgagaaagtgggacttcaaatacggaccaatgttaaggatctggtgggtctagaattgagtcctgctctgtatccaatgctatttaacaaattgaagaataccatcagcaagttttttgactcccaaggacaggtaaagtgttctcttatttttcacctttctctatgaatagagtgacttgtttgaaataagcctttttctttcagattatttaaattaggtactcacagtttttaaaaatttccaaaaaattgcagaaagaagagtcatctcaatgtaggggtcagcttgcctcttaggaactctggtgtgtatgtgtgcctaagggtatacgtgccctgtgtatgggtacgagtgtctgcgtatatctgtatgcttatttggctctatgcctgtgggtgcacttactctgtgtgtttagatcagtcagtttcatctctctagggggtctgtcttctgggcattgatggcaaatcattaatgtatttgttctttctttaggttttattgactgataccaatactcaatttgtagaacaaaccatagctataatgaagaacttgctagataatcatactgaaggcagctctgaacatctagggcaagctagcattgaaacaatgatgttaaatctggtcaggtaagcattctactgaaatgtagcagaaacattttaagagataagaaaaacctcttacacactgatactggtagtaattgataaaataactggccattctttactgcacacaaactagggtgtgacagtaaggtagccagaagttgtgtacgttcttttctaaataaatatcttattgttttcaaacttacatttaattcgttttacttgatgactaaagtatttagaatgccttctcttttgtctatatctgataatttttttattgtttctatgtctatataggtatgttcgtgtgcttgggaatatggtccatgcaattcaaataaaaacgaaactgtgtcaattagttgaagtaatgatggcaaggagagatgacctctcattttgccaagagatgaaatttaggtgagttctcaaaagagcaatgtagggtcttgtaaatcttaatatgtccaatgaagtacagaaaaagagtagatatgcggttattggtagaaaggaggacatgaaaagagagcaatttacatgtttgtttttctctacatctcttctcaaatttccctaagctttgtgcctgtgacaatgctccctttttctaaaactgtgctatacttgagctaagaatttgattctatttccaatctgataccataactaagggccatgatggaggataaatatccatgttgcttgttcccttctggcttttatgtctgtgatagcagtatctcttttataaagtcgtcatgtcacttaggttatctggcaaattatttgcactataagaaatcttacgtgactaaaggtgtgtgtgtggcttcaaaaacattgtttgctgtttctcttttctccaccattctataggaataagatggtagaatacctgacagactgggttatgggaacatcaaaccaagcagcagatgatgatgtaaaatgtcttacaaggtaaaaaaagaatgaccttcaagtattagtgggttttactgtgagagttataactacttaattacagctttatacttgtattttgtgtgtatttaaacttttgagatgtcaaacttttgtgtttgaaatatgtaaagatgctaatctttattactgcttttttttgactgatagactttcagtaaaattaaatgtgaaagagtgatatgtttgggaagttagtgttgtcagtttatgaagaatagtctacagttattgggaaataagatacataaagcctcagattgcatttgtgttatgattagatagataaaggtattatttgaggaactcattgtgttgaatctttttaagaaataattgatttcctgattcaagcaccagagacagaaaaaaaaggaagtaatcaagtctgctttaatgatacttattgacacatatcagaaaatgattaaacactatggactgtataataagcattcacatatgtttctttgaccaagcctagctttataatacagtcttctctgtcagggattggttccaagaaccactccccaaacccctgcccacatcttactcccatgaacactaaaatccacagatgctcaagtccctgacttaagatgtcatagtatttgcatataaactatacacatcctcccatatatttttaattatcttcagattacttataatatctaatacaatataaatgttgtataaatatttgttataccatattgtttagggaataacaacaacaaaaaatctgtacatgttgagtacagatgaaaccctccttttttttcccccaaatattttcaatccatgggtggttgaatccatggatatagaactcactgatacagagggcccattgtacatgcttctgatttaaggtagccattttgccaagattactttgtagaaagtaagtattaccttctccccatttgagatgattttgtattctgggatctgcatattaactcaaattatttgggttgtgctaataatttgtttaatgaaataggtagttcctaaggtttatatctgttagtaagaggtttatttgaggggaagtgaaagaacttgaaagattcatggtctctaaattttttttttttttttttttttttttcagagatttggaccaggcaagcatggaagcagtagtttcacttctagctggtctccctctgcagcctgaagaaggagatggtgtggaattgatggaagccaaatcacagttatttcttaagtaaatttcagtcaccaaaaaacataaagcaaaaagcaaataaagccccccaccacacaaaaaaagcaaagaaataatacccatgacaggactaggataggaaaataactgtgttttgtgatttttttaaagaaagtaatatgatcagtgaaattttgcttataataaaacccagattgcttcattaagtcatttacaaaagtgacattgtctaagctgtttggaccactaattttatatactaacattaaaagtgacacatttaccaggtaatattgcatctatttgatgctaatgttatgaaaggtatactaggctatatcaggtaaaatcatgtccaacatagcacacttcataataagccaccctggctgattatcgcgagagaggagagaaacagttaacccagggccattcacaccatgcacatatgattgttttggaatgtctggttagctttctagttgatacggccttcactatgtaaaggtcagtctttttatttctcagatacttcacattatttatgaaccttttgaatgactgcagtgaagttgaagatgaaagtgcgcaaacaggtggcaggaaacgtggcatgtctcggaggctggcatcactgaggcactgtacggtccttgcaatgtcaaacttactcaatgccaacgtagacagtggtctcatgcactccataggtgagatcaaatgaaagtttcatatagaaatacaaaacctagagaactggcatgtaagagaagcaaaaattacttcagcaaggccatgttagtaaatttgcatctgtttgtccacattaggcttaggttaccacaaggatctccagacaagagctacatttatggaagttctgacaaaaatccttcaacaaggcacagaatttgacacacttgcagaaacagtattggctgatcggtttgagagattggtggaactggtcacaatgatgggtgatcaaggagaactccctatagcgatggctctggccaatgtggttccttgttctcagtgggtaagtgattagagtaagcggggaagaaaagtgcctggcacatagcaaatccttcagaatatatttgttcaataaatgtttgttgaatgaattgataaaatttcagagccagaagaaagatgtttagttaggtgatttttcagctgtagggaagtggttggcaccactagacctgactagtgttctgtatcatttcatcctactaaaaaattccatttaaacgcattaaaaatcactgatctactctggtgtcttcatatatttgataaggtaattaggttaaacctaattttagttagttgttgcaatgctggaattggaatccacgatttgtgcctgtttactacctccagtttgctattcttttccccataatgtctcatacagttttttaaaaatttaagcactatatttgcatttgatattatgatattgtttattttaaaaactgaaagcgtcatatggctatgtctctctcttaatttaatgaaaaattttcctaaaatcacatcattcttaatacatgctaaaacgttgagacgggttgttgttcctttccagtgttaaaaggctatttgctttttagtgtaccaaaactgatttcagttatagtaaattatgactaataaggtaatctgtccttgttaacaagcctgtatttgttatacctgtacttaaagtaaaattcaaactccttaccctgtcctacaaggctctacctgatctgggccctacctcatctctaacatcatcttatgctattttctttcttgttcaccagagccacaccagctacctttctgtccctccttgttagacttatttctgctttagagcacccttgctgctgccaccacctgaaatgcttctcttctggtattttattttggtgagaacacctggcatgagatctaccctctaacagatttttaagtgtataatacagtattgctgtctgtaggcacaatgctgcacagcagatctctagaacttaccttgtataactgaaattttatactcattgattagcaacagccccaaattattgaaacctccttgaagcctaaatttcagaaatgttcaaatgttttgaaaatggatattctgaattatcttattagcatctacctataattagcactgaaaatagtaattttttaaataaagaatcagttaagggccgggtgtggtcgctcacgcctgtaatcccagcactttgggaggctgaggcgggaggatcacaaggtcgggagatcgagaccatcctggctaacaccgtgaaaccctgtctctactaaaaaaatacaaaaaaatcagctgggcgtggtggcaggtgccaatagtcccagctacttgggaggctgaggcaggagaatggtgtgaacccaggagggttgcagtgagccaagatctcgccactgcactccagcctgggcgacagagcgagactctgtctcaaaaaaaaaaaaaaaaaaaaaaaaaagaatcatttagttcaagtagctttaattcgttgagttttatattaaatgactttgagaaggaattttctgttaggccagatctcacctaccacattattgtaatccttggatcaggcaagaattagagagctatgagccatgatcctggcctttgttgttactgcttgaggattgaggcatctttttatggctacccctattatctataaatttcttcttatcatgtgattaaacagtgatttaccattagatcattttttcttgagtgtaccccaaactgttttactacagagagttataaaggatgtcatttaggtaatagatagaaatttcagccctcatccttgtgaccctagctttgtatgtaaatctggctcatctctgggttctgaatgcccaattccttttcttcctggtttctcaaaaatcctatagtctttctgtttttgttgtgtctctgcctagtatatattcagtattcgctgagttccccgactgtatgagaagagagtagaactcttctgatcatcaatcttatttctgctctgtgcaaatgcttgtacaaatcaaactaaattctttgctgtcatcttctgtttctgctctctttcattttgtgatgtaatttgagctgaatcttggagattttgtctcctagtaaagcgtaggcctctcttaatagcttttaccggttaatccttggaattaacagctatcatagacattgtatatagtcatctatcataaacaatgtacactgttaaatctcaggataaatattaatcagtcatcatttgccttaatttagcaagtggttgtcaactttgggtttacatttttgctactctttagcttcctacctaagaataaaaatgggattgtttgcactaacctgattttgttttgttctcaggatgaactagctcgagttctggttactctgtttgattctcggcatttactctaccaactgctctggaacatgttttctaaagaagtagaattggcagactccatgcagactctcttccgaggcaacagcttggccagtaaaataatgacattctgtttcaaggtttgtatcattcattttgtgtgtatgtgtgtgctgaggtatgtcaagtaatgattatgtacagaatgtgcagggctgattgtcttcttttaaggtaaaatatatggagcaggtataataaactcctattcgtgcatttctgtaggtatatggtgctacctatctacaaaaactcctggatcctttattacgaattgtgatcacatcctctgattggcaacatgttagctttgaagtggatcctaccaggtttgtcatcttttcacatagaaccgctgttttttgtttttttttttttgtttgtttgttttactaacactgcatgaagcaaggcaccttctccccttgatcattaaaattagtttttaattataaaagttatatacaaatacacgtttctttaatgatatctgtaatttttttttaaggtatccttttatttgccttagatccagggacaaactagagaaaggtgtctttgacttccacctccagagactgttactagttaagtctgttcccctgtcctttttccatgcatttacatattcatatgcagtcacttgcatgcatactctttttctaactcacttcttctatgatgaggagtgacttaggagaagggaaagaggctaataggtaatgcaggctgcagtttatttatttgtcatttttttaaaaatttgagacagagtctcactctgccattcaggctggggtgcactggcgcagtctcggctcactgcaacctctgcctcccaggttcgtgtgattctcctgcctcagcctcctgagtagctgggattacaggtgtgcgccaccacgcccaggtaattttttttttttttttgtatttttaatagagatggtgtttcaccatcttggccaggctggtctcaaactcctgacctcaggtgatccgcctgccctggcctccaaaaatactgggattacaggtgtgagccaccatgcccagcccagagtgcagtttaaaccaccatttctgtgaagctttctctgcttgttaccaggtactacccacgaacaaagaaatatgctttgttctgtgctgtgcaccaccattgtaacaattgtgacgatttatgagtttctctctcctctagactgtttgctcttttacatttttacatctttatatccttccatgaatatttagcatggtgtctgccttatagtgaacattttataaatatttgttaagtgaatgaattttaacggaatatcttatgcttgctttttctaagccacatgttaagatgttcttgtctgtctttcagttaggactttattttttacttttaagttcagagcttcttgatgattgttcttcctaaataatcattatttagcaactgtgtatcagttgatatttttggctctgcatttgctgaagtatcaactgtaatatctattcagaactccagcactaagccaatttttgttaaaatagttaaaaacttaaaagcaatttttatatttttatttacttcttattttttgaaatggggtctcactctgtcacccaggctggagtgcggtggcaccatctcggctcactgcaaccttcctgtgcaggactcaagcgattctcccatctcagcctcccaagtagctgggattacaggcatgcaccaccatgcaaaatacaaaatttttgtattttggtagagacgaggttttgccttgttgcccaggctggtctcaaactcctagactaaagagatccacatgctgtggcctcccaaagtgctgggattacagatgtgagccaccacgcctggccaaagcaatgttttgtaaagccttgtattttcttgccattaagcactttcagtttttttcttgacaacttctcatgtctactttttttttttttttttgcaattttcaagtgtacataatacattattacggattttatgttaattttgtgccctacaattttactgaatcttattattaagcaattttactttctaaaggttaaagaattacttagagagtgaaccagctgcttcaaataagtttactatacaaagtgctgtggtccagataagagaactagatggcaaacaatatactcaggttgcttaaaatcaaactgaggcccactctgacatgtcaagagcttgaaagtcaacactcctgtgttcacaacatgaaaaaagctaaaaaactgaaaatcagcagctcttagatccatcagagaatttaagtccactccaaaaactggagagacaggtaaatgtatacagagaatcacagtttaccaggagaagaagctgctggagccagtaactggtaggaaagcttagatcataattgacgagttgctggaggctgagcatggagtgcctagagagttaaaactcctaggggcctagtcttgcagggacccctgcacctttgtaagttttacctccagaagcctcatcaggctctcatggtgaagataggagaaaaatccctttatgctttgggcaggggaaggggaaaagtagccatttttaaatatgaccacagtgttctgttatccctagcaaaggtttgccctcaggagaaattactttaccagagctttatttgacttagaagttagccacctccagccccctctagcgtttctgtaagaagagagaaaaggctaagaaactctttgagtctggcctggtggctcacatctgtaatcccagcactttgggaggctgaggtgggcagatcacgaagtcaggagatcgagaccatactgtctaacatggtgaaaccctgtctttactaaaaatacaaaaaattagctgggtgtggtggcacgtgcctgtagtcccagctaccaggaggctgaggcaggagaatcgcttgaacccaggaggtggaggttgcagtgagctgagatttgcaccactgcactccagcctgggcgacagagcgagactctgtctaaaaaaaaaaaaaaaagaaactctttgaaggtcacactttaaggaatttggcccaataaaacaatggagatataatcagattgtagagtacttcccttccccagtatcccagttaacggggaaacccagggacaacaaaagagacagaaataagagcactagaggaaatgggcgcctacagttacagcgaacattaaacataacctaacttctaggcagattaacagaatgcctcacactaaagtccaatttacctcagttcctatgacccaatacatcttgtctggctttcaacaaaacattacaatgcatgctaacaaaaaatgaaaaattagtctgaggagacaaagcaagcatcagaatcagactcagatgtggcaagatgtattggaactttgaaattgtcaaactgagagtttaaaataactaatatgctaagggctttcatggaaaatggacagtgtgtaagaacagatgggtaatgtaagcagagacatggaaattaagaaagaatcaaaagagaaggctagagaaaaaagctgtaacagggagaattcctttagtgggcttatcagtagtctgggcaccactgaagaaagaattggtgaatttgtagttatatcaagagaaacttcccaaactgaaatgcaaagacaaacagaagaataaatgaaaatgaaaatacatcaaaatttgtggggtttaataaaagcagttgcttagcagtgttaaatgtatgttagaaaagaaaatctaaaatgaattatctgagctctcaccttagaaaactagacaaagagcaatacctaaagcaagatggggggaggaatcagaaatcaatgaaattaaaaataggaaaaaaataatgaaacgcaaagctagatctttttattttttaatttttatttttttgtgggtacatagtaggtgtttatatttatggggtacatgaaatattttgatacagacatggaatgtgtagtaatcacttcagggtaaatggggtgtccatcacctcaagcattgatcctttcttttttcttttttgagacagagtttcactcttgtcgcccaggctggaatgcagtggtgctatcttggctcactgcaacctccgcctcccatgttcaagcaattctccttgcctcagcctcccgagtagctgggattacaggtgcccaccaccatgcctggctaatttttgtatttttagtagagacagggtttcacaatattggccaggctagtcttgacctcctgacttcaggcgagccgcctgtcttggcctcccaaagtgctgtgattacaggcgtcagccaccgtgcccggcctatcgtttctttatgttacatacaatccaattatactcttttagtgatttttaaatgtacaataagttcttgttgactgtagtcaccttgtgctatcagataaccagatctcatttatattcttttgtacacattaaccatccccggtctccccttccccaccccccactacacttcccagcctctgggtaactatcattctactctctatctccatgagttcaattgttttaatttttttagcttccacaaataagagagcgcacgatgttgtatttctttgcctggcttatttcacttaacatcataaccttcagttccatccgtgttgttgcaaatgacaggaatctcatgttttgtgtctgaatagtactccgttgtgtatatgtaccacagtttctttatccattcttctgtggacagacacttaggttgcttccaaatgtaggctattgtgaatagtgctgcaacaaacatgggagtgccgatatgtcttcaatatactgatttccttttgtttcagtatatacctagtagtgagatttctggatcatatagtagttttatttttagttttttgaggaacctccaaatggtcctccatagtattatactaatttacattcctgccaatagtgtatgagggttcccttttctcacttttctccttgtcaccatttgttattgcccgtcttttggataaaagcaactttagggtgatgtgatatctcattgtagttttgatttgcatttctctgataatcagtgatgttgagcaccttttcatgtacctgtttgccatgtgtattttgtttgtgtgtttgtttgttttgagacacagtcttgctctgtcacacaggttggagtgtagtggcgtgatcttggctcactgcaacctctgcctcctgggttcaagtgattctcctgccacagcctcctgagtagctgggattacaggtgcctgccacgatgcccagctgatttttgtatttttagtagagacagggtttcaccacgttggtcaggctggtcccaaactcctgacctcaagcaatccacccgcctcggtctcccaaagtgctgagattacaggcatgagctaccatgcccagccatggaatatcttttttctttgctttattttcagtctgtgtttttccttatagatgatgtctgtttcttgtaggcaacagattgttgggtcatgggttatttttgtttgtttttaatccattcaatcactcttacgtcttttgattggagaatttagtccatttacattcagtgttattattgacgaggacttactcctgctattttgttatttgttttctggtggttttgtggtcttctcttcctccttttcttccttcctgccttccctttagtaaaagtgattttcacagatgatatgtgttaatttcttgctttttattttttgtgcatctgttgtatgtttttgatttgaggttaccatgaggcttgccaataatattttatgagccattcttttaagctgatgacaagttaacactgatggcataaagcagcaaacaaagaagcaaaaagaaaactaataaaaactctacactttaactttatccccctactttttaactttttgttgtttttatgtataccttattatactgtctgtatcttgaaaagctgtagttatttgtaaaaggttcatcttttagtcttctcaagatagtagttcataccacaattacagtgttataatattttgtgtatttactgttaccagtgaattttgtaccttcagatttcttattgcttgttaatgtccttttccttttgattgaagaactccctttagcatttcttctaggacaggtctggcattgataaaatccctcagcttttgtttgtctaggaaagtctttatttctccatatatgaaggatattttcactggatactgttctaaggtaaaagttttttttttttctttatcacttgaaatatgtcatgccactctctcctggcctctaaggtttccactgagaagtctggggccagacatattggagctccattgtatgttatttgtttctttcctcttgctgcttttaggatcctttctttatccttgacctttgggagtctgattattaaataccttgagttaatcttctttggtttaaatctgtttggtgttctgtaaccttcctggacttgaatattgataaatatctttccctaggtttcataagttctctttttttttttttttttttttttttttgagatggaggttcactcttgtcgcccaggctgcagtgcaatggtgcaacctctgctcactgcaccctccgcctctacctcctctttaaggccagtaactcttaaatttgctcttttgaggctgttttctagatcttgtaagcatgcttcattctttattcttgtctcctctgtgtattttcatataggctgccttcaagcttgctaattcttctgcttcatcaattttgcttttaagagactcttgatgcatatttcagtatgtcagctgcatttttcgtctccagaatttctctctggttctttgtaattgtttcaatctcttcgttaaatttatctgataggattccgaattccttctccacattatcatggatttccttgagcttcctcaaaacagctattttgactcctcggtctgagaggtcacatatcgctgtctctccaggattgatcactggtgccttctttaattccttcggtgggtcatgtttttctggatggtcttgatgcttatggatgttcattagtgcctgggcattgaagagttaggtatttttgtagtctttgtagtctgggcttgtttgtacccacccttctggggaaggctttccaagtatttgaaggcacttgggtgttgttatcttaagtctttggtcactgcagctatatctgctttaggggacactccaagcccaataacgctgtggctcttgtacactcatagcggtaccaccttggtggtcttgcataagatcctggagaattccctgggttatcaaacagactcttgttctcttcttctcttcccttactttcctctaaacaaacagagtcagtctctctctctgtctgtgtgtgtgtgtgtgtgtgtgtgtgtgttgagctgcctggagctgggggaggggcgacacaagcagccctgtggacaccagcactgggagtgcactgggtcttgcccaaggcctgcagtactgctgcctgactaccacctatgttcactcaaggcccaaaggctctacagtcagcaggtagcaaacccagccaggcttgcgtcctttcgttcaggcagtgagttctccgtgggtccagagatgccattcaggagccagagcctagagttgggtacatcagagatctacctagtgctctattctgctgcggctaagcattaagctggcacccaagctgtaagacaaagtccttcccgctcttccgtcctcttttctcaagcagaggagtcttttcccatggccgccatcgccccaggcccatggtgagtgctgcctggctaccactgatgttcactcaaggcccaagggctcttcattcagctcatggtgaatgctgccagttctgagtctctcccttaaggccttggggctcccctctaacccagggcaggtccaggaaagttttccaggagccaaggcctggaatctgggaccccaggagcctacttagtgccctaccccactgtgtcaagctggtacccaagttgcaacacagagtcccctttattcttacctcttctttcctcaagcagaaggggtctctctccatagccaccacagttggtaatgtgctgggtcacccctgaagccagcatgtctccaagtctcacccaaggcccacagcaagtactgcctggctatccctcctggttgttcaggggccaagggctctttagtcagcaggtgatgagttctgccaagactgggtccttccttttaagacagcagatttccttctggcccagggtttgtttaggagtgttgtctgtgaggtagggcctgaaatgggggcctcaggactctgcctggtgccctctcctactgtggctaagctggtagttacaagacaaggtcctctttactctctccactcttgtatttgaacagagggaaggcatctctgttggagctacaagctgagctgagctgcctgggtttgggagaggggtgatgtaagcattcccttggttgccctggctgtctcactaggtccaccccaagtccactggctctgagcccagcacagcaccaggacttacccagaaactgcagtccttgtgggcctagactgcctttcaagtttatttaggacctcagggcactttagctcttggtggtggggcttgctggaactcaggtttcaacagctgggatgggtgatttacctctggctaggtctgttctaagttctccatccttgagcaccagctgagctctgccctgtgttgctttctgctatgacagggcagcatttagtcctaatgcaaagtcccataatcactgtgctgtccgtcccccaaatgcagattttctttgcacaccacggggccactgccaggaggtgaaggaagggtggtataggtaagtcaagacagtttttcctacccgcttcagtgcctcttccttaatatgatgttaagaccaggtattgtgatcacttacctgattttcagttcttatgaaggtgcttttttgtatggatggttgttcaagttggtgttccaataagggggacgatccctggaggcctccattcagccatcttgctccacctccagttctcaagctagttctttgaaaatcaacttgggaaaagttttatacacaggaacacttgaataattgaacacaaatgttcattgtagttcagaattagtagaatattcaacaggttaccattggcatgtgggaagcaagagagcactgtggctagaaggtattgttttagagggaaacctgaaatggactgcagtgtacctgctgctatgctgactcaaaaaaaaaatttcacaaagtaggcaattgtcagggtttctagcagtctctttgagccttgttaaagaaattgttaatctcattcatacctaccaactcctagacctccatatcttaagatttggattactgttgtagcttaactgttctccctgcatataatccccatatttaggctgtctcttcaattagccacatattgcaagttcattttcctcctctggcttcctaacaaccatcagccattctccaatagataccaaccaggtgtccttgtgattcagttcaaccgtgacactgtttacctggagagagcatcagatttcccataggataagggctgagtaagattgctaccacttcagatgccaattacaagccccaggttgttacctgtgcttctcacaacttcaccttgagttggattaatttgctagaaggactcacagaactcaggggcatactttacttttgtttgcctacttactataaaggatatcagaaaggatacagatgaacagccagatggaaaagatgcacatagggcaaggcatgtgggaaggggcttgcagcttccatgctgtctccaggtgcactaccctccaggcacctctatgtgttcggcaacctggaagctcttcaaactctgttcgttgggtttttatggtgacctcattatataggcatgattgattaaatcatgggtcattggtgataaactcaccttcagcctctctcctctccttggaggttggggagtggggctgaaagtctcaaccctctaatcgaaacttggtctttctggtgactagccccgtcttgaagctccctaggacctcccagccaccagtcatctcattatcatataaaagacactcagcacttccagagattccaagggttttaagagcaatgtatcaggaatcaggagcagagaccaaatatatatttatcacaatacccttgaattattgtattgagtacttagtgtggaatacctggtctatatgtctttctcctttttgaaaaggtcaaaaggcaattgttgaatcctcagcacctgatactaagatggcagatagtagatgtgcactaaatatttattggattgattacctgccgcacctactttctctttctgaaatacccttacttcttttgtctatgcaaattctgtgcctcctttagaactcacctgttcaatgaagtatttcttgctttgcagtccatgctaatttctgaactcttactgtattcatatgctgtgccacacagcaaactctaaggaatctacagcaatgacgtaagtgtccaaagcatttctgtaatacgttaattaatatagaaacaaaattactaattaacctgttaaaaacaaatatttactcagtacttgctgtggtaaggcactgtgctagtctttaaggggacataggtaaatacttccttcaaggagcttacagtttagtaagagggataaaacacacaacagataagtggtgagtttcataaggggtgtattttgagagttcagattaggctagttagagagtaaaggtttgtggatttgattactattgggtaaaatttaaactacataaagtaggcattattagtcctgtattattgatgagaaaaaatgacacccagagaatttaaggattgtgaccaactcataatgattgataactgatagagctgaaatttaaacctagtaagtctgcctgcggaatctcttcctttaatcacaacatcagagtttagaggtggtactgataagagttagcaacactgggccgggcacggtggctcatgaccgtaatcccagcactttgggaggctgaggtgggcagatcataaggtcaagagatctagaccatgccggccaacatggtgaaaccttgtctctactaaaaatacaaaaattacctgggcgtggtggtggtgcgcctgtagtcccatctacttgggaggctgaggcaggagaattgcttgaacctggaggcggaggttgcagtgagccgagattgtgccactgcactccagcccggcaacagagcaagactccatctcaaaaaaaaaaaaaaaaaagcaatactgattggatatggggaataatgaagtagagcaggaaaaagtgacatcagagatggcctgaatgatgtgattaagaaagtgatagtgctattgataacatagagcacatgataagacataagagtacgaggaaaaatcagttaatttggggcatactgatttttagataccagtggggaggggacatctagcagttagaaatgtcagactggatgtgaaatgcagttcaagataggggaaacctgaatggccacaaaatatctaaaagcatgtctaaccttagtaggaactgtggaaatagaagttaaaaacatgagctacctcatgttttactcaactgctagattggaggggaataagaattcttatacagtactagttttagagctatttggcaatatctagtaaagttatatctgcatatactcaataactcagaaatttcatttttaggtagctgccttagagaatctcttatgtgcaagaatgttcattgcaatggtgtttgtaaaggtgaaaaatgtttaatgttcattataattagagaatagataaatcatggtatacaatagactattatgcagtaaagtgaactatatcttcatctatcaacatggataaatctcagaaacataatgtagagtgaaagatgaaagttgccttttgttactattgatgaaaaaagtaaagacctacatcattcagccgggcgtggtggcttatgcctgtaatcccagcactttaggaggccgaggcaggtgggtcacttgaagtcgggagtttgagaccagcctgaccaacatggtgaaaccctgtctctactaaaaatataaaattagccgggcgtggtggcccatgcctgtaatcctaactacttgggaggctgaggcaggagaatcacttgaacccgggaggcggaggttgcagtgaactgagattgcgccatcacactccagcctgggcaacgagagtgaaactccatcccccgcccccaccccccaccaaaaaaaaaaaacacctgcatcattcatatgtgtgtgttaattttttcatatgggcatatacacatagaggattgtgaattggaaaaatacatgatattcttgttttatctgtcccctctctcccccttttgttgcttgggtattttaaagcatatctcagagatcatgtttctaacatatacagacttaaacacacatacacgtgcatgtgcagcctgagtatttccacacaaattaaagttaataatcctgaataatatatctaagactagttttctgttaaatttttttcagttatctcaaagttgtctttttttttatttttatttttgagattcagtcttgccctttcatccaagctggagtgcagtggtgcagtcttggctcactgcagcctccacctcccaggttcaagtgattctcctgcctcagcctcctgagtagctgggattacaggcacctgactaatttttgtatttttagtagagatggggtttcaccatgttggccaggctggtcttgaactcctgacctcaaatgatctgtcagccttggcctcccaaagtactgggattgcaggcgtaagccatccagccctgtcaaagttgtcttttttttttttatagttggttgtttaaagattccaatgaagtctacacgttgcacttggcttaatgtctgtataagagtctcttttaaggagtgatttttgttatttgttttaaacaaaagtgttaggattttatttttatttttttgtaggttagaaccatcagagagccttgaggaaaaccagcggaacctccttcagatgactgaaaagttcttccatgccatcatcagttcctcctcagaattcccccctcaacttcgaagtgtgtgccactgtttataccaggtatgcttacagttagagattaccattattaatctaaagttaaattatgaagaatgctttatcaaagaaggatctagctgctgatggtgtgtggttaactataatactgagtcagtttggatgaataatacattgagaattgttggaattgtctttgaaaaaaacttaaatattacttaggcaacagtttgaagtaagagaatactttaaaatactaaattttacttgcattgggagcaagtttaaaatgcagtgaatccattgggtatgatggatgtggctgaaatgaacatattatggatttttgttgttgtcatctattaacctaaattatttacagggtgtttcacagttgaggcgggtctcctccttgctttttgcattgtgaattgcttgatcatctgtgattttggtttcttcattaatgtataattagtttgtgtcaggttttcccaggatagactgattgttctgtttactttatgtagcatatttcttaaaagagatactgcatcatcattcagaccaaattattagaccttctaacactagcactgcaagtaatgcgtctgaactcagaaaatagccatagtcatggccttcttttttagggaattcggtctatgttcttttatgtcttctactgtgtttttgaattgcacattgcagttttaggaattatttattccaagggaggtcctgcaaatgcatattagccttttggaaactgtgattctggaagaaacattagtgggtctggaatttgggataggggtggatataagggaaatacacagttatcaaaacccatgtctttgtgtctctctctttgcagagtcatcgcagccatttgcttttttagcacacggcttcagttgcttagagacgttaacagcatcattgaaatcaccattttaaaagctgtttgaggctgctctatgtgaattttttcaccattgctatttttaaagatgtatctgttctatctgtaaaaaagcttttcacggtatacatagatgataaaacatacttaaccttgtctctcttaatttatcatgacttttctgcctttacaaaaaggctcaaggaaacttaggaaaatcctgtatagttttttcaactagttaagtctgagtctaaagggtagtttagttataatatgaaacttaatacagtgaatatcttctcaagtttgggctgtattcaggtttctctttaaattttatttagtaattgttctattgatgaaactaggcagacaggaaatagcacatattaaaaatagtctgggtcagcttcttggttggcctagtagtaactggtttcagagagcaagtgggtttctaaaatgacagaggctttgactttagctggttaaaagtgaatggggactgactacatgattacatggtctaggagattgtagtagaatttcttcatgtggttgtcatcctaaaagaaaaatctttttgtatcatgagcaaagttggagaccgttttgagaccatgattctaataatgtaaaaggaacaggtcttagcacttatttagtacttaggaaatatttaatgaagaaataaatttcccatccctcccacctaagtaaacaagattcttgccagctttcacagctaagaaaggaggaaaatagtgaaaatagatttttaaacactatatgtggtgattattaaacagtatgttatgctttttagagcacttcacagtaaaatatcctatattattttaataacaaacctggtttattatgttaaaatttcacataaaattattatctttaaaaacatgaattaaaggtggtatcagtgcattgtttaagtattgggtaaaagcattgttgaagagcagagacagcatgctgtgttgttattaaataaggctttattttttaattagtaactggtaacagggaatgttacatttactgattagaaagaaagataggaaaaaagctttggtctcaagatagtattttattgagtctgcttcccaaacctagtttatttcttttggtttgctcttttgtttttattcatcttccctcttctggctttttcttgcccctttgcctttggcagtaacagaaaggtaccttcctgctcttctgtgttctgcctggagggatagtagtccctttgggacctactggggaaatgttgaaagggaagtgagtatattgctagctaataaacttccctggactttagctccttttttgagttcatatcttggcctttaagccttttcaaatcatgtgttaaccagctctattactttatataccttccttccttagttgactggattaaggttatttaagaatagccaactgtgaacatgtgtcagatttataattaaatcattttctcatgtgttgttttcacttctcctgatggttttaggataaagataaaatgattcccaaagtggatattctcgtatggtgagagaattctaagaactaatttatgattctaaataaatctcaccctttttcagtaaatctgcttctccaaactgaagtagtttacacacagttttaaggctataaatgatagttatataccactgttactaatacatttgtatatagtctaaagtttgaaacaaagctctgtgagctaaggggctgtgtcttgttgttttactgctatttcccaatgcctagaatggtatttgacctgtaggtacacagtaactctttggatggatgaatgggtgggtggatgaatggatgtctaactaacttaaagcccaagttatgggttatggtgttggatgtccagaattcccagaataagatgccatctatttgtggattaaataattctaacatggttttaaaaatatttttaaaataattattctgcctaggctagtccaatcaagagtcttttaattttgaaagaaatctttggtctagaaagagctctgagagatgaaaccaatatgtgcctggagttttgggggttttttaggtggctttttttttttttttttttaagatattttgataaatggtcaactgtaatatgtgaaaagttttaagcaggcctacagttttgttctgtaattttctctgcagtttcttcactttaataatattaatgcttcttactagttgagctgataaccttcttctcccaaatgttgcagagcttttaacctcctctgattagaaccatttcaggaagtagcctgcaaacattgaaaaatatgtgaaatgttaagagtaatcttttttagagagagaggtctttaattcagaatttctaaagtgaatttttatatttatccatataatttttatttctttattcagtaggatcataattaaatgccaggtgttggaaaaagaacttaaagtcaattgaaggatacacagagaagaattttacataccaagaaaaaattatgtagacacaaatgtttttagtgtgtgatctacttgtaatgaatattttatattacatttctcaaaagctaggaattaaccaaaatgtaaatatttaatatcctcaaattcacttggagagagtttttctgtgattcatagccagaaatagtagacatgattgggtctcaacatttcttgctgttttagtgcttggcttaaaaatgtaataaaaattaaaacccagaattaaaattcattcctcaaaattcagttgatttctaattttttgttgattccatttgtgttacattttatggtgtaattttatgtacaagccaacattgtttttgttgctgtatgtagtcggtgctgtgacttgtttgtgctcatctctgttctgtaggcaacttgccactccctactgaataaagctacagtaaaagaaaaaaaggaaaacaaaaaatcagtaagtttggagaactttttattagctgtttctttcaaagcaaaacaaaaatcttttgctgtttgttaagaatatcttcacttcagcctatttgaccttcactgtaaaatcattctactaattctggcacaaaatagctttcatttcaattaaccctggaattaagttacattgaaacattctctgtgttcctttggtttgatttatcccaaaggcaatttgtgggcatttgttgcattggatatccttggtctaattttattattgttactttttaaattataaatgaatgcaaagaaacttaatttcaaggccttaggaaacgctgactgtcttcattcttgcttcttgtttgaaggtaatgtgagtggtttcttttcccagagatgacagtgtttcttaattgttagaagtatatggtgggaaagagtcactttctaaatcttacctaaaagttgctaaattttatttttttactcttcatatttttatctaggcagtctcaggcataatttagatatttgtgcatagattatagaaattttaatggtaaaactacttttacctcaaaaaaataagaggtaaatgataagatagtacttttgagataaaagaaaactgagttcatatttgtagaaaaacacatcattctgcaaacataatgtgaatatactatctgcttctatgaacttgccttgatttatttaaaaggaagaaaattatgagagtcgtaattattttcttccagtgaatggaatttgtccaaaatataatatgcattcattttacatttgccattatctgtcacagtgacttatcaggctgagccctgtctttgttcatataatccaaatgattgtagagtaagatgtaaagaaaactaagtaggtagttttcttaaaagggtgtaatttagaatacagtgttcatctggtttcatctttcatgccttatctaaactttacatataataaaagctttatggctgggcacagtggctcatacctgtaatccgggcactttgggagaccaaggtgggagtatctcttgagcccaagagttaaagaccagcttgggcaacatagcgagtcgtctctacaaataatttttttttttttttaattagccaggcgtggtggtgtactcctgtagtcccagctactcgggaggctgaggcaggaggattgcttgagcccaggtggttgaggctgcagtgagctgtgattgtatcactgtactccaccatgagtgacagagtaagaccctgtctcacaaaaaaaaaaaaaaaaaaagaaaacgaaaaagctttacatataagtttctaagctgtacatataaattatctaagctttaaatatagatttttaaaattcaaatcaaaatttaaatttatagacatatacttttgttgtgtccattgaagattttatttttgattatattaagtaaatttgcctagctatgatcaaattgattggattataaagacgtttctaatgcttcagccttctaattctcagcatatgtgagtttaacataatgtacaccatcattgttgaaattaatttgctgcttctaacactcttgttcagtgttatactaatgccattttgtagtgtatcacataattaaaattcaggctttctgtgtttctctagagcatgttttctagcctttctaacactgctttatttattaagattatgtctaaaattgtttcttgaaatgtttttttttctactagagttattttcaaaaaatttttttttaatttctgggtaacaccaagttttggaatgtatttctcagcacaggtaatacgagctcctcatggaaacaaggggaatctaattggtaattcgagatattttagagtacattccaaagtatgaagacagtatactcataaatttaaaatgttgttttatggagttgtgtgctttaacaaaacctaatgatatttaagagcaagctgactttctttttgggtgtatatgtcatggattggaatatgtaaaatatagagagaagatctggcttctagtatatagctgtgtagtcacattacaaataactgtttattattctcaaatatatagtgtataatgaggtttactttgaaagttaactgtctgcctaactcagggagaatgcagtaactaagcatatatgggtagtaatgctcttgctgaagtgtagtttatgactacatgcattcgcgttatgtagtcagcttttaccaagggaagaaagggtacatttggctgataactggtctcaacacacagactggcccaagtttgaccttttatgcagaatgtcttttggatccaaattagatttttatggattaaaaaaaacactagagcatgtatgtattatgaggtaaaattacattgatgtcaattagtggtgaatgaaaaaaaaacagtccttttataagttgacttacgaaacttgttatgtagcatttttattggtttttaaaatcagtttttagttccaaaattatattgattctgccatcagtgatacatatatttatatgatacatgagacagtatgtgttcctgaggtgtcgatattttgggttttgacatgaattatttttaaagatgtggaagatggtaaaagtgtagtacttttcataaagtttacaatatgcttttgggaaatcactcagtttttcattaaattctgaggctgagtaccattaaatcaggtgtaaatatgagtcacattttaaaacttctttgtcctagagaaaaccggtaaatagctactttcaaagaagtattttgtctaattgatgataaccattacaaatttccttgttccttctccactcccagtgcttcattttactagcataaaaaataaaacagtattttgaaagctctccatgtgtttcacagcaggttaacattttataaactaactggttctttgaaaattaaactatgggttttagttttgtaaaaacttttagaattttaatgagttaaacgtatgagatgctaattcttttaaaataatctattttaaaataattataaagcagtttttaatccttttccctcctgctaactcactccttaaaggctttaaaatgttataggtttcttttgtctgcctttatttatttatttatttatttattttgagacagtctctctgtcacccagattggagtgcagtggcacgatggctcactgcaacctccacctcctgggtttaagcgattctcctgccttagccttccaagtagctgggattacaggtgtggctccaccatgtccagctaatttttgtatttttagtagagatggggttttgccatgttggccaggctggtttcgaactcctagcctcaagtgatctgcccgcctcggcctcccagagtgctgggattacaggcatgagccaccacgcccagccagagaattgtctaagattaaaatttgggagttttagaaaaccactcagtagcaatgatggtctatgaatattctaaaattatgtgaagaattttgtgtgtgtgaatgcatacattcatttttctaacctttatcagatttcaaagaggttcctcgtccccagaaggttcaacaccgtactggaatagtcaaagcactggaattttttcttaattttacatctttctatagttttagctaaaacttctgtatctaattctaaatgtatatatttgagctaaaaataaatggtatttaggttttaaagccattctaataaagcagctatatttagtcaccttcaccagtttccccttatttaagggttaaggttgttcttcatgcaataaacactgtaacataaagaaagcttcctgaactatgtgtagtgtaactgaagatggaactatattagttacaactgacctctttttatcacctcttacaaatattttctctaaaatctagtttttactaacttcctgttagagattatagaaagctattttgaggttataagcagtgataacacatttaaaatgtggactgcatgaagcactacattgaacaagatgaagtgaaataatccccattttttccagagttaatctggagtcagcctgtcataatttgtgtcataatttcctgtcataaattatgacaggaaatatttattgaagcattgtgaaaaaaatagctacgtgatattccgcatgtaaatctgggtcccctcccaccaatatcctttgaaatgaaggtttatccttgacatcacagaatattgagtggaatgctacagttttgtagtcactgctactttaaacagcagtttagccgcactaagcaagaatagctgtagagattaaaatgttacattaagtgttctttaaaaatgaacatatatagtatatataaaaatgtaaactgcaaaatataattttcatctatgacatgatttaaagcaggggactctggaaagggatgggagctgaaccagttttatagcactcttcccgagctaaggtacctttttatcttaatgtagaatgttttataaagggaaaatcatccattttaaatattgggttcacattgcttttcaggctggacaaccatttcttgagttcttaaattatttttatttgacagaattataaattgaggtagacataggggttctctcttctggtgagatccttttttcttttaggtccccaagaattcccatccctccatggtttaaataataggtaggttcttgtattataaaggaagctgtgaagaaaaggcactggcagtaacattacttgtaagtaagtttttttttttctcagtaagaatctaatattttattttgtatatggcaagcatttttttcttaaattcaattgtaactggtacacaacaaaatgtaaatatgtactatcaggtataggatgttttgggggtgtgctgttgaaaatttagtttcacgttataaagttgaccacactttcatgtctgttaatcttagtaaattatgatcatctttgtgtgaaaaatttggtctgctttcattactcatcaaacatgcagtataagtgatgatacagtgaagatcttttttcaggtttcttctacccatctcatccatgaggtttttctttcctctgagataccttaattgtactttaatatgatataagactagaattgagaggaaactttattttctcatgttttgggagaagaaaaaaatagaaatatgtcattcatgaggactgattgattcagagtttttatgcaaagtttgacctttgaactctttgttttcatgtctttatattaattcaaaccttatactcaattctcaactccttgtttttaggtggttagccagcgtttccctcagaacagcatcggtgcagtaggaagtgccatgttcctcagatttatcaatcctgccattgtctcaccgtatgaagcagggattttagataaaaagccaccacctagaatcgaaaggggcttgaagttaatgtcaaaggtgaattattttgataatctagctatcttaaattccccttccaactaaattttcagcttttcttacagtacttcctcttacatttatatttgaaataccctatggttttcagttatgtgcttttgttttatttgtttatattacaaaggaattcattagttaggtacctgatggaccttattttcatgataaaacattttattatagcagatgtcttgtgttatgaagatcattttttgcgtaatcattctagacattctgaaacagactagaatgtagactataggattttttattttaaaagtcattaaacatttttaatatgtatttttacatgtaaatataataattatatttgggaaggttagaaacactacctaaaataatttatagaatgaggaatgtttgatttttaagtactagcagaaattatatcaatgagaaaattcatgtttttaaagaatgtcttaatgtatagacttcatacaataaataatctgattatttataaccctgttttattgtgtagatacttcagagtattgccaatcatgttctcttcacaaaagaagaacatatgcggcctttcaatgattttgtgaaaagcaactttgatgcagcacgcaggtaattttcttgccacttactcagttgctctgtttgaatcaaatattttcggtttcacataaatccatgtacctgttttacatgaagttcctgtgtaagtttttttcttttcctgctctaggtcaagacatagcttgtcttattttattttactataaaagacagtcatgaaataaattaatattttttataatttggtagtgattttcatatttgaaaaccaagagggatttttgacatgtctaattaaataaaggatttgaggatggtacaatatgtggacaaggaagaagtaggattctttttatttaaaactaaaaccaaattggtatcaataatacataacaatgtttaataaggtttttttgatgttagagtatttgtgatacttaaatttggaagtgtatctaaactaaaatgttattctttaaaccaagtcaaacaaacacataagattttgtttatgaggaactgaactttatgattttagaaaacttttctgctagatttctataactagttatttcactttatttctctgagttattggtctatctgtaaagtagggataaactctttgcctgagttgtttttagagaaaaaaatgagataattcataagaaagcgctttgtaaatttatgtctggaattctgcttttcatgcagtgtgaatctaattgatcctcatcatctaagctagccttgtacaactctctcttccagtttatcatcattgtagttgttactgactttttttctgttagagaaattggagttgaaaaggtatattgctgaatgacaagccatgttggaaagagagtgaatgtcagcataggattcatattctggcactctgtgtacccatacaaagttaaaaggatcaaagttttaatcctggctctgacctagcaggctatatatctttggggaggtctttcgtctggaccttcatttccttatctgtaaaatactagcctctttccaaagtttcatccatcttaattttgttgttgtttaacttcagagcctactttgaagctgaagccgggtatcagaaatggaaagccaactttctccttgtcctttttgctttgtctaatgtcaagtcacattgtgtgaacaagccctccatatttgtaatcttagttacttcacaaagttacttcttataaatttaattcaaacataagtctgggtgtatctggtgttgaaaattctaatgactttgcatttttgaaggtttttccttgatatagcatctgattgtcctacaagtgatgcagtaaatcatagtctttccttcataagtgacggcaatgtgcttgctttacatcgtctactctggaacaatcaggagaaaattgggcagtatctttccagcaacaggtaagatttcccagtcatggggatagtgaacactctccgtttaaatttagattaatacaattattggtcatgaatagtgctttttactttgcatcttcttggactaagaattatggtttagaaagagaaagattctttttttcaaaaaaatacaaacaaaaggttaagtcatattaaataatcaacaaacctacctaggttccagtggtcattattattatttttttgtcaggttaagaaatcacagatttgctctttgggtttttatggcttgcagattgttatagatccaaagaagttcagattagcgttggcatttgactctgaagaacagccaattcgtaggaattcagtaattaaaatattgtcagtgttttaattctatgataaactcattcgtgatactcttaagtatatgcaaataaagctttatatagaaaataccggcctggcacagtggattacacctataatctcagcactttgggtggctgaggcaggcagatcacctgaggtcaggagttcgagatcaggctggccaacatggtgaaaccctgtctctacgaaaaatacaaaaattagctgggcatggtggcaggggcctgtaatcccagctactcgggaggctgagccaggaaaatcgcttgaacccaggaggcagaggttgcagtgatccaagatcgcacaattgtactccagcctgggccacaagagctaaactccatctcagaaattaaaaaaaaaaaaaaaatacttaaaaatcaaaattattaatttgggcattgtttcattagctcttattagtctcttgtgtaacataaattacttgctgtcccatctagttatataaacttgtaaagggaccaaattcctatgtatgaagagttccttacaaaggaagaatgagtccaaattatttttaaatgccaataaaaatgattagcacattcacgggaaaagtagtggactgtgaagctaagggtaagcaattgggagatgggagtttaaatgacagggcattttaatcttttatgaattattaatggattgaagtagacatggtcctgaggtctttttggtgctgtttacaaatcagctgacagtaaaaggaaaagcaaccagttacaagttaaagaaatgtgtagtgctaaatgtgaactgctaattttttttctaagtagtttgctgtatctagggatcataaagctgttggaagacgaccttttgataagatggcaacacttcttgcatacctgggtcctccagagcacaaacctgtggcagatacacactggtccagccttaaccttaccagttcaaagtttgaggaatttatgactaggtaaagtacaaccttgaaatagttgattgctttctttttggttgagaaggagagtttgccaccaggccacttgttagatatgatagaagactatgaggaaagatgtatttaataatcacattgccatgtttggggaatccaactatatattatttatatatatagggtgtgttttattttatatattgattgtcataacaatagtaacaaatcatattttatcatcttgctttcataagttttcacatttaatacttaccagggagtgaagacaacattattttcaaattatagttaaggaaaatgcaactcaatgtgaataattgacttgcctaagattccacacctgattcataggtcttttggttttaagtgcaggacttctctactacactataacatttttcagaaccctcataaaggttaatggttttaaattatttcagattaaggttcagaaaatatagtatacttcagtattgctataaaatttctgtggacatttgtttgaatcccatttagtgggatttagtttgtgaatgaaaagatcctcattgttagacacttactctgtgatgatacagtgagagtagtttgctgaatcttttaaagtacctttcacaggactttatgcttagtaagtgctccttcgtgtctgtgatttgagtgctatgttcatagtatgttccaaaacagaataaaacagaatctgatgatgagaagttaaagatttgtatataatatgccttgaattgtaagtgcctgttgttagttgtattacttacaggtcatggttttgtacatataactccaaaccattgatactgttaaaagaatatatgaatatatgaaagaatgtataaacataagaatgtatgggtatatagtgtcctttccaaattaatttttatttttagctctactagattttttttagtgtaacaaatgtttattcctatgtaattaagggcatattttccatacagactattcacattacctaattgaaaattatatactacaaaaatataatactatttttaggccagacatggtggctaatacctataaccccaacattttgagaggccaaggtgagagaattgctggaggccaggagttcaagaccagcctgggcaacatagtgagaccttgtctttattagatagatagatagataggtaggtaggtaggtaggtaggtaggtaggtagatagataggtaggtaggtaggtaggtaggtaggtaggtagatagatagatagataagataagataagataagatagataagatagatagattgggcacagtggctcatgcctgtaatcccagcattttgggaggccaaggcaggaggattgcttgagcccaggagtttgagaccaccctgggcaacatagcaggactccatctctacaaataataaaatattaaccaggtgtgatggtacgcacctgtggtcccagctacctgggaggctgaggtgggaggattgcttgaggatgcagtgaactgtgattgcaccagtgcatttccagcctaggtgacagaatgagaccttgtctataaataaagaaataagtaaaaatataaataagtaaaaagaaatataagtaaatataaatataaataaatataaatataaaaatgaatgaatcaaaacagtttttaaatttgacatcactgaggacatcctagccatttttctagaaaaatatttttattattccttttttctgagatcctaccttcccttacaaagcaatcttttgtgcttttgaagattaagtaatccaatatatataatatacttagcatagtatctggtacttgtaaagtaattaataaatgttggatcttatttttgttctaaattcccactgatgctcttggagacccattttcttttttttaaaaaaaatgaaggtagctttataatattctcagttatttaaaaaattattaaattacttgatatagaaatctaaagaaagttaaaaaaattaaaaattgtttatcctccctctcagaatacttcacttaacgtttggtgaatagtctcccagtcatttatctatgcacatgtacatttgtttctcctatcaaatgatatctaggttgtttccattaatatttttaaaattctgacctggtaccagcagcatgatgggctgagctaatgcaatctcttcccaagacataaggctcatagaaatactaggtgtaaaagaaaatatgtgtacttaaaaaaatttaggccgagtgcggtgactcacgcctgtaatcccagcattttgggaggccgaggtgggtagatcacctgaggtcaggagttcgaggcaagcctggccagcatggcgaaaccccatctctactaaataaataaatatatatatatgaattagccaggtgtggtggtgggcacttgtaatcccagctacttgggaggccaaggcaggagaatcatttgaacccgggaggcagaggttgcagtgagccgagatcgtgccactgcactccagcctggtcaacaagagcaaaactccatctcaaaaaaaaaaaaaaattaaatttatagctgaagctagtttctaagcaaattacctagcatacagtcagtatagacagataaatggaaaatatgaaagaggttaggagatgcagaagataaaatgaggaggttcaaaatatgtctagtaggtgttccctagaaactgagctcagtgagaatgggaagaagtaatatttgaaaggctaatggatgtatgttttctagagttgatgaatgacatgaatcttgaggttgaagaagcacactgagtcttgagcaaactatataaaaattaaaccaggctttaatacatatgggaacataatatatgctaaagctggtattcagaatcgagattaggatggactttcaataaatggttttgataaaactgagtaatgatttggaaaaatattttcataccatttatgataaacttccataaatcaaaaaaaatgagcaaagcaaggcctttttcatccattcaaaatccataaactagaaaagattgataaaatgaattatttaaaaaatcataaacttctgtctgggacaaaaatgtcatgagtaaaaccaatcctatggttaatattcttgcccagtagttctcttagaatagtcctaaaagtgcttttgtggttcaaagagtaataccttgaaatttttggtgcatgttgccaaattaccctttagaatgcctgttgcttttaaaatattttttcattttagtattttattgtttatccaattatagacttttttacatactcagtagacaacataaagcctcataattactctgttatttttcttttaggcatcaggtacatgaaaaagaagaattcaaggctttgaaaacgttaagtattttctaccaagctgggacttccaaagctgggaatcctattttttattatgttgcacggaggtaagaaatactatgttttgggtctcttaacagaattttttaaattatagcaaatatagagagatggcaagtttggtttttcccagttgacttaacaggaattgaagacaagtttacttgggagcatatagcagggtaaatagcctgcgtttcctaaaatgatggtcggtatctagtagctgcttttcatactacccatttcatattgcttactctgtcctacatcattttttaaaatactgcctgcaatggattaattaccaagagttaaaaacccacaaagaatcttttgttttcaagtatattctgattaaatagtactcacaacatgataactgggaactttttttaaaggaagaaataaaactataagagcctatttctgagaacttttaaaaatatgctgtgtaagacagcatcaggatgatttaaaaaataattcaaaggagtggtgaaaaatctctatgaagatggtgcaaggggtggcctggaaaacggtgcttgttcatgctgccctcagttgaggctagttcctagaaagcctttctggaaatgttgtgagctcttccttaataataggtatgatgcttgccttgctttccctaccattgtcttttcttttttgcttcattttaccttccttttgaaaactcaatctgtgacgttatttggtcagttttactttttcccatttaccatgacatacattcatggtaattgagccttagagacaacatgatacatagagaaaccactgactttggaatctcaaggaccatgtttagacctagttctgctactcattagttatagacttaatctttaccagtttcctgaatttaacagtatttaacatccatgaccattaagttagtagacttacattgttagtcagcttgctggccacaggtggcagtgtgtaggaaacaaatcaaggttgagaaatagtagagagacggtgaaggaagatcagtggaagatgggaaacttgtctaatagggtcattcagatagccttaagaccaagaagtccaaaggactggagtattagggaatcaagaaagtaagaaaattgcattgaacctcccgccacccccctgccctttaacaactctaagtaacccctgctcaccttcccatgaaaggcctctctccagctctcatctcagttgccatttctaaattgcctaagatcattttaattttcgtttgcgtttgagatgaaccatatttgtattctaaccccaacctttaatacaaccaggatatttttacttttccgttgttgtctaagtaaaaagcaaacattggtaagggaggtagaagatgtgtttccccctcttctttaaaatcttattagtttacaaatagcaaagatttctggaaaacaaagctgcgtttttttttttcggaatcagaaactgttatatttgtattccctctctgtggtgatctagaaaaagctaaaggaaagattggacctgctgcagatcccttagtgagattcaatcagtttggtttccatgaaacctattgagtcttgtggcctgagaatgctaagaattctcagctctgctgcttattagctgcataatcttttttttttttttgaaatggagtttcactcttgtcacccaggctggagtgcaatggagcgatctcggctcactgcaacctccacctcctggcttcaagtgattctcctgtcttagcctcccgagtagctgggattgcagacatgtagaaccatgcgtggctgattttgtatttttagtagagatggggtttcaccatattggccaggctggtcttgaactcctgacctcaggtgatctgcctgcctcggcctcccaaagtgctgggaattacaggtgtgagccactgcacctggccttagctgcataatcttagataagtttatttttccaaatctgttgcttcatatgttaaagctggggtatgtgcttataaaaactgtctacctctcctataaagtgttttgtgacctataaagttgtgtaaggagtaaatttgagattttctttttttctttcattctttttttgggggatatggcactgtcagtttcagattttcaatccttttagtttcttacttagacctactggagctcctcctgaccttcattttcacctggtgtgaagcctagctccaagacagatgagtacacagtatatcagagcagagcatccatttactccattatgaaggtcttgtctgtctgtatgccgtcagttttgtcaaagagcacttgggtttgacttctcttttgatattcctgtgtttctgtggcttagactactatgtattaagtaatgctttttgaattgtggattttctaatttccttatcgatggtccacagacgtttcagacttgaaatgtccaaaacttaattcagtatatcttcaaatcaacctcctcttcacaccgtatttctgtttctcagtaccatcatcatcccttctagttccccatctagagaccctaatcattttaaattctttcctcttattgtctttctcattgttagtcaccaaatcttggttttacctgtgagatcctgggcaatcagttaagttgttttagttaggcttttattgcaaagcagtcatttgtattttctcaaggatagtttttaggaaaagcatgaattagcgcagagcctacccagatatagagaactagatggctgtggtgctggaactggctatgctctttgactgtctctcggttttgtgttcaactcttcctcatgattttcatctttctgtatcctttcagcttttgccccagatagtaacccgttcattatctcagtactgcacatctgaaattccagaaagaaaatatgattcagctaaaaagcatctctgcttggcagaaactttaatgttaggttctggccagccagttgattactggctgcccctatgtccagtatgtgctcctggcccagcagtcatgtgattcaaaatgtgaccacttggctgggcgcggtggctcatgcctgtaatcccagcactttgggaggctgaggcgggcagatcatgaggtcaggagatcaagaccgtcctggccaacatgatgaaaccccatctctactaaaacacaaaaaattaggcaggcgtggtggcacgtggctgtagtcccagctactcgggaggctgaggcaggggaattgcttgaacccgggaggtggaggttgcagtgaaccaagattgcaccactgcactccagcctggtgacagagcaagactctgtctaaaaaaaaaaaaaaaaaagtgaccacttggtgctgtttcttcatcaggggctgttcttaggtatgtgttttaattttttttgttttgtttttgagacagggtctcactctgttgtctaggctggagtgcagtggcactaccatggctcactgcagcctctagctcccaggctcaaacaatcttcctgcctcatactcccaagtagctgggacaacaggtgtgtgccaccacagctggctaatttattattattattttttttgtagagatgaggttttgctatgttgcgcaggctgggcttgaactcctgggctcaagcaatcctcctgccttggcctcctaaagtgctggaattacagatgtgagccaccacacctggcctaatttttttttttagttggaccttaatggtctaatattactattacgtaccttggcaatgtctttcgaaaccattttcccccactgctttgctggaactctgtgtcttacctatactaatgtagcattattctcctcctccttcatcaccagttgactacttctaggtaatcttaacatttcttctggagccagtttccagtagaaagcttgtctgtcccattgactccctgtataaagtccaagttctgtagtcaaacatgcaaggtaattttggcctaatgtacttttctaatcttttccttctattccatccaatatacttatgctcttgccctgtggtaaggtagcataatacaaggacattgttgcaacattgtttatatagtggcaacaaaaaggaaaacaatagagttgtgtttcaaaaggggaattgttgaataaatgatgatacatttacattagggaataaggcaatgtgttaattttgcttgttacaagtgacagaaatgcaattcaaatttatgtgtgccaaaaaggaatttattgactcatgtacctaagaaaatcaagagatgtattagtttcttgcatgactagctgcagagctttaaacagtatcatctgcagaacatctgtcttctctggctcttaactctactttctttgtgtcggttttattcccaagcagctgctccctagctgtggctggtaatggtttgtgttctcccagcttaacaatcccagaggaaaaacacctctttcccagttttgtggtttcagcaaaagtggttggtcttactggcctggtgtgagtcacatgccattcctaaggcagtcactatggcaagggggatggaatttcttggttatctaggcctggatcatgtgccccttcctggaatgcagtggtaaagccagccctatccaaattgcatgaactaaaaggagggcatgggggcagggttttcacaaaggaaaattgaattgctgttactagaatgaggcaaaatggatactgggcaggcagaagtagcagaagtcctctacatccagctttaaaaaggcccagaaagatgactctgacacttaccttacaaggtacacgacagtgtgtgtgtgcacctgcacatgtgtatgtgtagactgagaaatgtatgaaagtatacatattaactgttcacattgcttatctcagaagtgtgattggaggagatagaggaccaatttaatatttctgttatctatctctatgttgtttggcttgccaggagcatatattgtttttgtaagaataattaaaaatataaaaccccaaagtggccgggcaaggtggctcacacctgtaatcccagcactttgggaggccaaggcggggaaatcacttgggctcaggagtttgagatcagcttgggcagcatggtgaaaccctgtcaccacggaagaatacaaaaatcagccgtacattgtggcatacacctgtagccccagctactcaggaggctgaggtgggaggatcacttgatcctgggaggtcaagactgcattgagccgagatcacaccactgtactccagcctgggcaacagagtgaggccttctctgaaagaatacattaaaacaaaacaaaacaaaaaccccaagttacaaagaagagttttcctcttaggaatattgtgatacctggcaattgctttttgggtggtagtagtaaataatgataatagctaacatttcctaagtgctttctctgcatcaggaaactgtgcatattacataatttctcatttaatctacataataaccttctgagatattattaacaattaattgacgtacgtataaactgaaacccaaacatggctatcagaatgatctggaacattaaaacaaacatatccccagcccccatttccaaaccaaaatctcaggggcagggccttatttatatatttaacaggcactccaagtgtttcatttattactaaagtttgggaatctcactgggtcatgtacttaattcatggtagcacaactagtaagaatcagaattcggtttcaaacctaagccaaagctcttaacaaatgcactattaattacatgcttattactattataattgtatgcttgggtaaatctttgtagatgagcatgaaaacctaaccaacagttatgagatatattactctggggaaaataagttctcgattccaggcatctgatttacaaatggttttttgaaacataagacaagagtgtactcaatataagataatcttgtcattggcgcaatatcattatacattacaaaggttagcagaattggcaccttttcttagcgaaatgacatattactattaacacattcatgaaatatgttaatacagatgaatgtgttattttgtagagcgctttagtttatcagattagcattttttgtctgtttaataaaaaataaaatatagaccgggcatggtggctcacacctgtaatctcagcactttgggaagccaaggcgggtagatcccctgaagtcaggagtttgagaccagcgtggccaacatggtgaaacccctctactaaaaatacaaaaaattaatcgagcgtggtggtgggcatctgtaatcccagctactctgggggctgaggcaggagaattgcttgaacccaggaggtggaggttgcagtgagctgaggtcatgccattgcactccagcctgggcaacaggagtgaaactctgtctcaaaaaaataaaaataaaatacaaaaacaacttcccccataccactccttatcccacacccccatcctctatcccctatcccctatccttcatctctctgtcactgttgctcactcgctctctcactctcatgtgtgtgctctctctcacatacaccacacacacacacacaccccacctacataatttcttctcttacacctttaatataaatatctgagttttggttcagttttgcaaacatttaaaaggcaaacatggtattttgcttgtttcagcatttaataaggtagtgcatacttctttcatatggaaggaaaacatcatattaagttaatatttaaacgtacacaattataatttgcaaaaaaaaatcaagatgataatttcttaaatagtaaattgaaataaatgatattttcctagcatgcttgtcattcagcaataataagaaactgagataagaatgcaggcagttgaagttcacttcagcctgagtgcaagtatacacaaaacagcaaaaatattacatagaaaataaatgttgtccattggattgagtatggtgctaccatttgtcacagtgttcatattcatagttgtggctatctttggggtcactgctgtattcagacttgtcttggaatttggagtcatctagggatttgaggtcattttgagatttgggcttgtcccaggattggtgctaccatttgtcacagtattcatattcatagttgtggctctttggggtcactgctctattcagacttgtcttggaatttggagtcatcttgggactcgaggtcattttgagatctgggcttatcccaggattggggttcattctgggattggtgctcttcctgggattaggtctggtcccgggattcaggcttgacgcaggattggatactgccatagaatttgaggttgttgatgttgaagtttgtccccggaatgttaacaaacatgaagagcaggccaatcggtgatagcttgaacatcatcctcctctgtttcacaataattatataattttaattgaacacttggatcacaaataggcaagcatatatccttaattgtgtttatcagtacatttgtgttatgtaaatgtttgctttttcactattagtgaacaaattaaaagcttccctttctttgttgtcaacatctgctgacacaagacctattttctattgagggctaccaactgaaggcaaaaacaatcccaagactgaaaaagagcttaattggcatttttctatttaaaaaaggaaaaaaataaaactctagacattcaatgcaataaatatgggggcttgagatcagtatagagtagggtaggggcaaagactgagaggcaatttgggacagtagagcaacaaaagaaataatgaaataaatattggtattttcttgatttctcatgacctttattccaacaatttaaggttttagtttaggtcacaaattaggatattacttctaaatatttacccaaagactaaagaggttaaaccaaagcatttccccagtgctgggatgaggttttcttcattaacaacaacaacaacaacaataacaaactagagaagttcatagttttaagatttagaaatgaacaaaaccaactccttcattttgcaaatgggctcagacaaggggcataacttacctgagggtgcatatctaaaaatgacccaagctagaacttaagtctgtgacttaaagcccaaattttaactgtagaactctaacatatatattaaaagttacatttggctctaatatgtaattgagaacatttcaaattaatgttaccttttgatatttttctttgaagagtaagaattcagtctttctccagcgtctatggggaatctgatttctcactcactgcatgctatttaaatataattagtgaggaagtcatgtgttctaaacttgacctgccatttgctctttggaagtatccaactgagtgtttccagacaactacatataaacagatagactttggcagagattaaagaattcaaataaagttctaaaatctgcttgctaatttaaagaatccagtgaatagcatttgttattcctcttaccatgtatacattaatgaattgcttcactggattgactctaactagatgaatttactattttgcctgctgtgattattatgattttaaaccaagtaagtgtattaaaggtgtctgcgttttccttagaacatctgtacatatgtttatagggcagtttctacccatggttattttgaagtttaaaaaataattcagtaatacaacatttcaggtatttaatttttggtaaataaagtaaccttagaaaagaagttaaacttcattaatatgaaacttaagaaaaggattacatatgaaagtgatactttttcatactgagtttacaaacttttgtgtgtttgtgtatggttttttaatgtattaaaccagtcaccttgaagtgcataaagtaaattttttgaaggaattttgtcttttggtcagccgttttccatgataactagcatatagggaaattgggttgtattctgctaatgttttcatcatattggccagcacactttaaaaattgcaggactgtgaacaatggtgttgacatacaaggaaattgcaacataaatggcagaagtacaagccagtacatgttcctcacttgttttactgtgctgtgaagatcatttttcccctgaatgaataaaccatgaatagaaccatgcttggtaaatcttatttatatggtacatataataacttcacttaactggaggttaatgtggtcagatctaagaagtaaacaaacaaaaaaaaactacttggcaaccagagtagatattatgaatcggagtactgcagtaatttacaggagtttgtcattgtcctctctctgctcacttgctcattctgtggatttctttggggggtatatagttggtaatagtaatagtaatagtaatagtaatagtaatgtttcgaacttgagcaaactgtgacttattctatttttctaatcttgaccttttgagtactacacttacacaactctttattgatgcttcaaacacctcagtctcaacttgtttaaaattcagaagttagtgttttctccttcctatttttgtatctagatatattcttctcataatctcttggttaattgtatcatcacctagccaaatgtttctccaacactggatttctcattatcttctctttcttatttatcttaagctctccaggcctcttcatgatgattaagtaaaatttaaattctatttagtactcaaatgttcccaaacaaacaatagtcaatttgccattattcaggtcttcaaatacccaccaactttgtatctttgtgcagcctccccaacttgcccaaagtgtaataatagccccctcttatcctaagtttcactttccatagtttcagttacccatggtccaccatggtctgaaaatactcaatggaaaattccagaaataaacataagttggatgtatcatgaggttaatagtagcctagcactgtgtcacagtgctgcattagtcaacccacttcatcttatcacataggcattgtgtcatatcacatcatcacaagaagggcgagtatagtacaataagatattttgagagagatgccatgtgcatgtgcttttattgtagtatattgctataacttctattttattattgtttttaatctcttactgtgcctaatttataattaaactttatcacaggtatttctgtataggagaaaaacacagcatatattgggttcaatactgtaattctgtggtttcaggtatccctgaggggtcttggaacatatcccccacagttaagggggtactactgtactttcctcattcaaaattgtgttgtttcttcaagctccactcatgtcagcaccttttatacgatccttccctaattcttcacgtcagaatcagtcattttagtactttatactttgatcagagtctcattttcactaaagaaactaaatcttccaccatattctggctttttttgtggtaagataccacctcttattccttctattccctctagcttctaatatagtgagtgtttataaagaataggacacagggccagttataaagaataggacacaggctcatgcctgtaatcccagcactttgggaggccgaggtgggcagatcacgaggtcaggagatggagaccatcctggctaacacggtgaaaccccatctctactaaaaatacaaaaaattagccaggcttggtggtatgcgcctgtagtcccagctacttgggaggctgaggcaggagcatcgcttgaatccaggaggtggaggttgcagtgagctgagatcgcaccactgcactccagcctgggggacagagcaagactccatctcaaaaaaaaaaaaaaaaaaaaaaaaggggcacaataagtattggaattcattgaaatacctcctgtttctccatgtcggagggctggtatcattaatgatgtctaaagtaagagttatttggttatttgcagttttcccttcacattagcataaatttggaaggcacaggcttgagtttaactttcatctctactttcctggctgctgttttgagaagatttcttcatttgtacaatgtggatcataatgcacattcataatcccttgtctgtaatctgaaaccccaaatcctccaaaaaccttaagttttatcaaaaaataaaaaagtttgacaccaaaatttatttggtgcaaatgccttatctgcatagatgggaggtttttagctatctttgtttcacttagtgtggatattaatgttgcgctgcagaaatattgatgagattgattttggggtgctgttccattttctactggagtgttacataatacatgataagaatagtacttagcatattcatgtttctcttcttccttctgggcacagcaccataccactcttagcattctgatagttaggtggtaccatctgactgagttctggccagtaaaatgtcagttccaatgatgtacaatcgacccttgaacaacactggggttaggggcactgaatctccacgcaatggaaaatctacgtataacttttgcctccccaaaaactaaactactaataagactgttgatcggaagccttttgataacataaacagattaacatgttttgtaagttaaatgttgtatatgctatattcttagagtgaaataagctccagaaaagaaattgttacccagaaaatcatgaggaagagaaaatatatttactgttctctgagtggaagtggattatcacgaaggtcttcatcctctttatcttcatgttgagtaggtggaggagaaagaagagggattggtcttactgtccccgggctggcagaggtggaagtaaacctctgtataagtggatcagcatggttcaaagccatgttgtttaagggtcaactgtatatgatttttaagcctgatgtctaacttctcaccaatcttccattcttgctttcttctatcaacgcctactagaaacagacggttcagtggagggggtctccaagacgccagaagatggtaaaaccattagaaagcatgatttaagagaaattaacttttgttgtcttagccagtgatattttgggattatttgtgacagaaattagttcgtgctgactaacataactacatgctggacatcttgcctttgcctcttcaaatccactctgttctttaccctgctgtgtaccctaagaggctgacctgtgtagagggtatcattgggctcccctcctttctggctttcagctggcccatagggaatacaagcggaagattagggagaagaaagagagtaaggttaggaggtatatatttttggctccgtttctgcagggtcccagtgggctggctacatccatccatgcagtatggtttttgttgggtgaccctctccacacaacctactctgtgtctgctttctgctaactgcttcctgcactcactacttcaggtgtagtatcacactgtctcttaagagtttccttaaaacctgccttctcctttatacataatctctaatatctcagtttgaatttgccacctgtttcctgctagaaccttaattgctacaagctgtatgtacactgtatcatcttcctaaaatcaccaggcatggtgggatgtgagctatagtcccagcaactcaggaggctgatgtaggaggattgcttgagcccagaaattcaaggctacagtgagctatggataccctaacctgagcaacagagcaagaccttgtctctaaaaaacaaaaattaagttaaaaaattgtgtctttctttatatacttacattactttccgttgatctgtttttgaaatgtttccagaactgtcttccctcacgtattgattcttccaaaattcttaagaaaatggaaaaaagtaatttctgaaaatgatgagaatgatcataaatttcatatagcactttcttgagaatttcaaattgcagttttaatattttactttagaaacaggtccagttttcccttctgtaatttttttctttggtctttttggattttttgggttttttttttttttttttttttgaaaagaacacagagatcttttcttgagtgatatttgcacagacattgccttggtaattgaagcttttttttttttttttttttttttttttttttttttttagaaaatcctattaagttttatgccatgtctatgctcattgcacctgtgcctcatgtctcattcattcattcgtttatttttttattattttttttttttgagacagagtttcgctcttgttgcctaggctggagtgcagtggcacgatctcagctcactgcaacctacacctcccagattcaagtgattctcctgcctcagcctcctgagtagctgggattacaggtgcctgccaccacgcctggctaattttcgtatttttagtagagatggggtttcaccacattggccaggctggtctggaactcctgacctcaggtgatctgcccacctcagcctcccaaagtgctggaattacaggcgtgagccgccgcgcctggccttcatgtctcttttaaataggacttctaaaattttgaaatgaggtcagcttcagtggctcatgcctataatcccagtgctttggaaggccaaggcaagaggatcacttgaagccaggggtttgagaccagcctgggcaacatcatgagaccctgtctctacaaagtacatttaaaaaaaaattagccaggtgtggtggcacacacctgtatagtcttagccacttgggaagctgaggcaagtagatcgcctgaccccaggagttcaaggttgcagtgagctatgttcccaccaccgcacttcagccagttaaggggacagagcgagaccctgtctcaaaaaaattttgttttgaaatgaatttatgtatgtttggttatttctgaaagcagttcaggcctacagccataccaccctgaatgcacctgatgttgtctgaaagcaattcaggttttcaggattaaaatttttatgctactaggtttgtaacctatatttaaaagtagaacatttaaaacattttagtagtatatagcactgaaaagtggctttttagcgtagacagttgtttttcaagaaactattttgtaatcctagctacttgggagcctgaggtgggaggatcgcttgagctcagaatccagtctgggcaacaaaggagaattccagcctctttaaaaaaaaaaaaaaaaggaagaaactatttgggagttttgtgaacaatggatatgcaaaaagacaggccattgttatgagaggcctaattgtgagtaccttctagaattgtatataagcatgattctcttcaatagtaaaatctcagcctcttcattttagaaatctaatataggaaaaagaacacatttctccatagttgtaaaacataggttctcagggtgaatgcccatctttgagcaagtttgtcttcctaatggtataatactgtaagtctgttatctaattttggcttgttgtcacttatttttcataatcaaagaaaaatgatttaattttaaaaagatgctctcctttctgttttcttctcttggatgatagtatccctatctgtctgagtttatagaatcttaatttttacctgctcttaccacatacatctgattagtcattaagtcttactgattctgcttcagaaattttgttttatgcttcactctcatgctaccaacttatttggtagcttcagcagttgtctaagctggggttggcaaattttttctgtaaaggaccaaatagtaaacattttaggctttatagcccatataaagtttttttttaattttttttttttttaaaaaagaaagaaatgtaagaacccacacctgtaattgcagcactttgggaagccgaggcagggtggatcacgaggtcaggagttcaagatcagcctggccaacatggtgaaaacccgtctctactaaagataaattagctgggcgtggtggtgtgtgggtatgtgcctgtaatcccagctactcaggaggctggggcaggagaatcgcttgaacccgggaggcagaggttgcagtgaaccgggatcgcgccactgcactccagcctgagcgacagagtgagactctgtctcaaaaaaaaaaaaaaaaaaaaaaaagtaagaatcatacttagcctggaggccatacaaaaataggtcacaagcaggctgtgggaaggatattgtaagtgggccatactttgctgacctctggtctaggctattacaacaatttcctaattggagtatttgtcaccggtattttaccccggtgtaagattgcctccatcttacacattactgccagaatcatctctctgaaatgtgaccatttcacttccaggtaaaatctttatgtgctccttttagctaagttttcttgcttaaggtattcatgtattacttcggggattttttttttttttgccatttcttcataaccatctatattatttattcagtatttttatagacttttttttcttaaaggaaagtttatactgtgaatggaaaatcaatattgattgccataactagaaaaccaacaaaaggcaacagtaaaaggaaatatagaactatgaaatgcctgtttcatgtagcacccaatcatatatgtactacatttcaaaaagtcactggcttataaaaatattttttagcatctcatacaagtctcttcataatctgttatacagctcaccttacttgcacgattgctgagccaaagcagatcgaaagtcattttggtaagaggctagatgctgaccttgtattctgaaaatctgatgattctactgttgttgatgtgattccaagtaagcctgtgtgaacttctgggctattctcagggaagtgtttatgacacattgttgaaggtatcatcagggcagttgatccaagaagactctaggagctggctaagccacaaagtctgcccaaaaagctcagaatgacaaatgaatgttttgtacattatctccactataatgctagaaaaaagtcttaaaagcatttgtctcaattgatcatttatatggaataatactggttaatcatcttaaatcatcatagtgttgggtaatgtctgtagaaggatgctttaaactctacttggtgcttcagctatgctgaccatctcaccattgccccctttgccatgccctgacatcctcacatgtctctctgcttttgcatactcttttccacctggtttgaatgcccttcctttatcatgggacattatcctttccatttaatacccatcttgataacctgactctgaccccctaggcaagtttaaaaaaaaaaaattcattgaaatgaaattcaccctttttgaagtgtacaattgcctgggcacagtggctcacacctataatccctgcactttgggagactgaggttgggagagtcacttgagtccaggagttcgagaccagcctgggcaacatagtgataccctgcctctacaaaaaaaattgcaaaaattagctggatgtggtggttgatgcctgtagtcccaactactcaggaggctgaggtgggagaatcacttgagcccgggaggttgatgctgcagcaagctgagatcaagccactgcactccagcctggacaatggagagagaccctgtctggaaaaaaaaaaaaaaatcttttttttaagtatacaattttgggccgggcgtggtggttcacgcctgtaatcccagcactttgggaggccgaggcaggtgaatcccgaggtcaggagatcaagaccatcctggctaacacggtgaaaccccgtctctactaaaaatacaaaaaatcagctgggcgcggtggcaggcacctgtagtcccagctacttgggaggctgaggcaggagaatggcttgaacctgggaggcggagcttgcagtgagctgagatagcgccacagcactcaagcccgggtgacagagcgagattccatctcaaaaaaaaaaaaaaaaaagtatacaattttgcatattcagagttgtgtactcattaccactgtctaattttaaacattttcatcactccaaaaagaaacctcatagccatcaacagtcactctcccctttcctcctgccccccctcagcccctggcaaccactgatctactttctgtctctatggatttgcacagtttagatgtttcatataagtggaatcatacaatatgtgctcttttgtgactgccttcttttactttaatattttcaagattcatccatgttgtagcatgtatcagaactttatccctttttatagctgaataatattctattgtattcatacaatatataagcgtttgtgtggacgtatgcattcagtttttttagatacatatctaggagtggaattgagtcatatggtacctcagtgtttaactttagaggaactgccaaatgattttccaaagtagctgcattattttacattgctaccagcagtgaatgagagtttgaatttctgtacatcttcacccaacacttgatattgtctgtctttctagacaaattttgataaatccctccttttctaaaccatagccaagtctattactgtttaacaatgaccatcttggagtataaattttctgttcacactttgaactttaacttccgggtcttagatgtctttatctggatatacagagaatctaggttttgtatgtaattattcaatgatagtattaaaactaagtccggacgcagtggatcacgcctgtaatcccagcactttgggaggccgaggcgggcggatcacgaggtcaggagatcgagaccatcctggctaacacagtgaaatcccgtctctactaaaaatacaaaaacttagctggtcgtggtggcgggcacctgtagtcccagctactcgggaggctgaggcaggagaatggcgtgaacctgggaggcggagcttgcagtgagctgagatggcgccactgcactccagcctgggcgacagagtgagactccatctcaaaaaaacaaacaaaaaaaaacactaattaccagtttttttgtttttgtttttttgggacagggtctcactctgtcgcccaggctgaagtgcagtgacgcagtcacagctcactacagcctcagcctccctgggctcaagtgatccttccagctcagcctcctgagtagctggaactacaggtgtgcaccaccatgccagactaatttttgtatttttttgtagaaacaccatgtctagctgatttttgtattttttgtagagacagggtttgtcatgttgcccaggctgatctcaagctcctggactcaaatgatccaccttggcgtcccaaagtgttaggattacaggcatgagccaccttattaggcctaattaccagttttaattatagacctacatgactacggtttgaaggaaaaagactttatttaatcctagtgattggaattggaattctcatttgagccagaagatttcttgagtggttttgttttctgtgataacttggtttatataagtaatccacattacttgggtgttagtggtaaagcaagtctttgccttgtacaacaaagataatttagtgattgatacattctgaataatctggtggttatgacttgacacatacaaaaaatgttagtggttgcagtccatctgttgctctgtaaaaagatttttgttattgtttgtttgttttgagaccaagtctcactcttattgcctaggctggaatgcagtggcatgatctctgctcactgcaaactctgcctcctggattcaagcaattctcctgcctcagcctcctgagtagctgggattacaggcatgcaccatcatacctggctaatttttgttttgttttgttttttctttttttttgagataaagtctcactatgtcacccagcctggagtgcaatggtgagatctcagctcactgcaacctccgccccccaggttcaagagcttctcttgcctcagtctcccgagtagctgagattaaacagtcatgtgctaccatgcccagctaagttttgtatttttagtagagatggggtttcaccattttggccaggctggtcttgagctcctgacctgaagtgatccgcctgcctcggcctcccaaaatgctgggattacaggcatgagccaccgtgcctggcctaatttttgtatattttatagagacggggtttcgctatgttggccaggctggtctcatagaactcctgacctcaggtgatccacccacctcggcatcccaaagtgctaggattacgggcataagccactgtgcccggccaaaagtttttttgaatcacctatggttcatttatttcagtttaagtgtataatcctcaaaggaaataatccattgggatgtatttatgaagtttaagtctgtaaaacaatgtggaggccgggcgtggtggctcacgcctgtaatcccatcacattaggaggccgaggtgggcagatcacttgaggtcaggagttcgtgaccagcctgccaacatggcaaaaccccatctcttctaaaaatacaaaaattagccgggcatgctttgcgcgcctgtaattccagctactcaggaggctgaggcaggagaatcgcttgagcccgggaggcagaggttgcagtgagccaagataatgccactgcactccagcctgggtgacagcatgagactccatcttaataaataaatagccaagtgtggtggcacatggctatagtcccagctacttgggagggtgagacaggagaattgcttgaacccggcaggcagaggttgcagtaaaccgaaatcgcaccactgcactccaacctgggcaagacagagtgagattctgtttaaaaaaaaaaaaaaaaaaaggaaaaattctgaaacaaccatgtaagaataaatgcatccaaatgaacgttgttcatctcagaagagtcacctttggaggtgatgcacttagttccaactttgctgcctttgagcacaacattttagggaaataattttttggaagtgttgtcaaagtctgaaatacattcttgtagaatgtggaaaatctcatacttgaaattttttgataagcaagacaaaatgtcacgtttagtaatactgttttttgtttaagatgaggtttttctgctggacatgggggctcacacttgtagtcccagcactttgggaggccaaggcaggtagattgcttgagcccaggagctcgagacaaacctaggcaacatgatgaaaccccatcacctgtacaaaaaattagtagagtgtggtgatgagagcctgtagtttcagctgcttgtgaggctgagatcggagaatcactttagcctaggaggtcaaggctgcactccagcctgggtgacagtgagaccctgtcttaaaaaaagttttcttatgtaacttacaaactagctcttagtggtatttgaaaggaacagccccagagttgttttcagtaacgatggtatcattggagtaaaagtatagcgatccaacctgactactttgaagaaataatacagaaaatgaggtgtatcatgtgtgacatttatgtttaaatttaaaatcagtttatagtcaactcatagttaatatacgaatattttttactaacttcaagtgattccttgatcctttaaataattttaatatgcttttttgttgttttttgttttgagatggagtcttgctctgttgcccaggctggagtgcattggggcaatcttggctccctgcaacctccacctactgggttcaagtgattctcctgcctcagcctcccgagtagctgggattacaggtgtgcaccaacacacccggctaatttttgtatttttagtagagacagggttttgctctgttggccaggctggtctccaagtcctgacctcaggtaatctgcctgtcttggctcccaaagtgcttacaggcgtgagccaccacacccagcctattttaatatgttttaaagagactttagcttttacaaggtgtctctaagctcatacttaatgacctgcagctttttttgtagaatttaaagtcaaggcaagagactcataatactttatccaagtatattttgttaaagcaaaaaaaatgtcatgtgatcttgtggaaaagccataccatgaggaaattttagctcctataaataggtgaaactatttttaaacaattgtttgctttcttagattatttgtcattggtataaggaatacagatgagtatttaatgtctaaataatataactcataaatggatgtggttgtatgccagttactcttacactacataatatctcaaatgtgataatggttgctgaggctttggatggcaaattagggctttcccagtggttattgtggtgtatggcatccttgtcttcccttacttatgttttgtttttcttctttctcaatggaaagccattaagtcttagttaattttctgttgaggcaagcatttgacattcattcgaattccctcagccttccagaagcattcagtatgtttcaactgtgactatgagcaacaaaataatacaaagtgaaaaactgcgtttcctggtgtgagtatttcattagatttattgatccttggccttatggtatccatgtgaaatgttcagacatctaattttttactgctaaataatttttttaggggataaataacaaaccttgtaaattatttgaagcataactgaagatgtcagatatatgagaaattatttactattactgtttcagtcattttcacttctaatcttgttaactacccaagaatctcttgtacaaaggatagtaatcattaaaatggttatatagcacccacaaagtgctttaatatacatgttttaatctattccttaaaacaccttctggagtatatgttcttaaccatattttttatcagaggacacatttaatcacttgcccaaggtaaaaacacacaccgtaggtgataaactttatgtcatgctctgctgttaaaccaccaatatagttagaattattttgatcagacaagagcgaagcagttttcctgtttttagtgagtgcgtatgtatgtttaatttctgtgctttgatctcattcataactgtgtgtgtgtgtgtgtgtgtgtgtgtgtgtgtgtgacacagggtgtggctttgtcacccaggctagagtgcagtggcatgatctcagctcactgcaacatccgcctcctgggctcaagccatcctcccacctcagcctcccaagtagctgggactacaggcacacgccaccacacttggctaatttttgtatttttttgtagagacagggtttgccgggctcagagctcaagcagtctgcccacctcggcttcccagtgtgctgggattacaggcatgagccactgctcctgggctcattaataacatattctcactcataggtgggaattgaacaatgagaacacatggacacaggaaggggaacatcacactctggggactgttgtggggtggggggaggggggagggatagcattgggagatatacctaatgctagatgacgagttagtgggtgcagcacaccagcatggcacatgtatacatatgtaactaacctacacattgtgcacatgtaccctaaaacttaaagtataataataataattaaaaaataataaaaataaaacatagttttaaaaatacaaaaaaaataaaaaataaaataactttccagaaatttagattcagaatctcaggtcaggctttctagataaggataagtgggtatgttgagcatgtgtctcacctggctcttaaatatgtttaacaaagttggggctgttgaaccaaactgacatttcttaacagttgatcttcttaaagacctcactttgcaccacagttttctaaatgtgaaacatactaatctgcttaacacattattaacaccttaacatgacatttgtttctacttctcttctaacttcccttgagcaattttctatattgaattgttcatgggtatcagaattaacctttctctagaattgttccaaaggtaactccacattgcccagaactagttttttttgctttgttttttttttttttttttttttttggagtgggagacagagtcttgctcttgtcacccaggctggagtgcagtggcatgatctcggcttactgcaacctccgcctcccgggttcaagcgatcctcctgcctcagtctcctgagtagctaggataataggtgcctgcccagctaatttttatatttttagtagcgatagggtttcaccattttggccaggctggtcttgaactcctgacctcaagtgatccacccaccttggcctcccaaattattgaggttacaggtgtgagccatggtgcctggcccagaactagtttcttatatgactagtagtagcctagccaaatcctccctcattcttaacttttctttgatctttcttttctcaggactttgaagctgtaactttgaaataaatgaaagaaacttagactctagaataagactcgcaggtttgacttggtctgtcctaagtaggtcattgttagccaactagtcacatctttgatctatgttaattcattcttttatttataaattcagataaaggtggtcaaaaaaacaaacttctaggggcaagtgaatgtctcagctgaaatcaaaaggatgagtagggtttgagagggcaagaagagggagagaggacatgcagcatctctgaaagcctggtggcacgaagcatggtgactaagggacagaggatattttgtttgtttgaactataaaatgttagagagctggaaaattttaagatgatactctaaagggaagcaaggccctgatcatgcagtaaaccatattaagagtttagattttattatgagatatgagaaattattgaaagggaagggttggtacacagttcatcttgtgtcttcttatttctcttgttttcttactcagtctagatgccctagacaaacatttcagtagttcttttcttagatctcttggctatttcaaggacaaggcaggtaataaaatatgcttggtctacagtgttagttagcattttggcatttttctttttgttactttttaatacatggttctatgtcctataattttttcttatttttctaatatttgcgttttccacatttcacactttaaaaaactcttcataaatatttttattggccagatattctggtcagtgggtcattgtttacttaatttcctaatggtggatatttattgttgtttcagtttttcttgttagaaagaatgctgtgatttacctataggcaaaagtttaaatgccttaactgtagacaaaagttaaaatatcttacttttttaaaaatttcattgccaaattgctttcccaaagaattgtgccaatatgtgaacatggccatttcattctaccttccccatcgttggttttttttttaattgcttgctattttaatagtgaaaaatgatgtcacatttttattgcatttctcaattacgtggttggccatattcccatatattaatcatagtattttgtatcttgtaaacattctttttatgtcctttgcccatttattcattgagaattttaagatttttttctcatccgttttatgagctcctgattaacaacctcctttatagcatcttatttgaatatttttatcaggctggttgtttcagcataatggggattttgtatagaccaatctattgataatttctttgtgattgtttttttttctaattaaatagccttccacctgaagacttacaaatatttttaaattcttctgctggttttatgacttccttgttcatgttttctttcactttgtcagtgtatcacatgaagtgagtgttaaactgaacttttttccaatttcctcatctcatttattgagtcttttcctttcccctttggtttctgatttttctttccacagctaacaatgtttgagaatttactgtgtgctaggcactgttctaaacactttatctgtattatctcattttcttctcacaacaaccctgtaaggaaatagaggcacagaaacctaatttgctgaagtgacacagctagtaagtaaagctttgtcacatattcagttcttctgtgtacctgtgctctcattgtgctgttgtttctatattgtggttatctttctgtttttatgccactatcattctgtaattattatggctgatacatgtttctctctcaagaaaagctaatatcggccgggcacggtggctcacgcctgtaatcccagcactttgggaggccgaggcaagcagatcacctgaggtcaggagttcaagaccagcctggccaacatggtgaaacctgatctctactaaaaatacaaaaattagctgggcatggtggcacatacctgtagtcttaactactcaggaggctgaagcagaagaatcgcttgaacccaggaggtggaggatgcagtgagccaagatcgcaccactgcattctagcctgagtgacagagcaagactctgtatgaaataaataaataaataaataaataaataaataaataagttaatgtaactgtagtatttacttctttttctattcttgcttgtttctaagtgaacttaaggttccaaaacatttctcattggaatatttttcagaattgccttaatctgtaaactatactggaaataattgcaacgtaatagtatcccaccaaagtcctctgtaccttagtgtttgatatgttccaggtgctgactaaatatttgttgagtgaaagaatgaatgaatgaatggagagaccttagtttgtcatctgcatcaagtcttaatttatacttctcattaatatttttcagattttccccatttgatgctgcatatttcatgttaatgttacttcttgacattgtatatttttcccataattttctaattatttgttgccaatatctgttatttctgtttttttgttttggaatttcccaaatattgttaaaaaagattggcaatagtgggcatccttgtttcgattgtgattttaatagaaatatgttattcttcaccagcaagatgttgggtggtagtgtgtaatacattcttttatctagttcttaaaatatattttataaggaaaaattttatgaaagattttaggttaactcttgactgacatttttggtattaaaggaatttgctgttgtttgatagcatcattatggaagatattgaatagcacatatttgtgatcttttaagttagctatagaagccatcttctcattctgctgtggtaagtgaatgtctttctgactttcttctgggtccctatttcactgatatctaaacctgatttctagcagggaagagactaaagcaagcacatcctttcattcccttgctctcagtgtgtagagctgaaatgtttccatatatgggaatttctcatagcattgggtttggacatacagatgtgataataatcctcacaacaacaacattactgcatctaggaatgtgggtgggccaagacactgtgaagggtttatgtgaattatgtcatttaatcttcagaaaaaaaccactgtaagttctgccagcccattttatagatgaggaaactgtgacttagagcagtgaaataacttgtctatggtcatacagctgagaagtggcagaggcaagttgcttgtaaagtagagccaagccttagagatggatgggtgaagatagatatagatgtatgtgtatataggtatgtgtatatctgtacacatatgcatacatatttgatgtgcttgagagatagatgctaaggactaatgcattttgaaatttttctggagccaggaatatagtaatacttagtggcaaataatgagcctttttccattaataataagaatataatttctttggaaggaaatactatctaattatagtttccctcagtatatctgggggattggttagcagacccctgtgtataccaaaatttgcgcatattcaaatcccaaaatcggccctgtggaacgtgcttccttgtggaacctatttatacagtatgtgggtttcacatcccacaaatactgtgctttcaatctatgtataagtgtgcccatgccattcaaacccatgttgttcaagggtcaactttactttaaggctagataattcttctgtctaagaacttagagtctgagtagttgacgtatattgtacttgtaagtttaccaagtttgactctgcattttgcagacatgtctgtaggattgacataatccataggtgctcctaatgcagtagtctataatttgactttcttattacttttccccttaaaaattctaagacagcattgagtttttggtatcctcagaggaaaagacagttacctctaagatacctactttcagggcaggcgtggtggctcatgcctgtaatcctagcactttgggaggccaaagcaggcgaatcacctgaggtcaggagtttgagaccagcctggccaacatgatgaagccccgtctctactgaaaatacaaaaattagtcgagcgtggtggcaggcgcctgtaatcccagctacttgggaggctgaggtgagagaattgcttgaacctgggagggggagattgcagtcagccgagatcacgccattgcactccagcctgggggataagagcgagacttcgtctcaaaaaaaaaaaaaaaaaaaaaaaaaaaaaaaaagaaacctactttctgtgaaagtcggtgtatatgtttttttaaataagacacaagtatgtggtagagtagggattatctaagcaattagtccctatcatggatggtgaaggtactaatcagtgtttgggagggagtggagatagcttccgtatatagagaggtaatgcattttaaaatcatttaggggactttttcaaataatcctgtttcttcatggtgagattccctgacacagtgagccaatcaggtttgctaaggcagaaaatgttcgagagccactgtactagacagcatgaaagatgactgttttgttgaagcttaatggtaatttttccataatcctggtccttaaaaagcaaaaaaaagaacacattagagtgttgttacttttctctctctcaatagaaatgttcctaaaccagcaaaggaggctatctgaatttttaaaagtttttacgaaggaacataaaaattcctttctctatcttttcccacctctagaaatgcttgaaatgagattctgccttacgtctcacaaattaaataccacatttgtgtctcacccatctcagttatgctgtcttgcattttaatcaatcctgtttcaggacttcttttgctgccttgtggctgtttcttatgtttgtcactaattcataagttggctaacttttatatttgtagagaatttctcagtgattttcttctagttggagttccagtgtggtttgatttggagtgtcaagatctctgtcccatgcctagccttagtcctcagtctgttttactgggttcaccacctggttgtagtaccaaatgcccttttccctttccctctctccttcctcacttcctcagtactgcccaagttcgtcagacccaatgattttattcttaagctaatcttatttttaatttaggtaattctgatttctgatttgtaaaagataaattttcttctccttcatgtagtaggattttaattttgtaaatatttaaattctccattaatggtgtgttaaatctgcactaaaactgcttctttacatgtttttaaattttttcattatgtttttaacacttttcttacatgcaaaaaacacaaccgttaaacttttcttattaaaatgcaaagcctagtgtcttctagctttttgaagagcttttgtccattatataatctgtcaagtagccaagagttcctcagaagcaggacatcatttagatttaaaacaattatggcttgtctgtaaaataatgttgtagcataaccattcatgggatggcagctacgattttacttcagtaaaatatccttggatactaccgccattttatttaccttaaagattttaccaaggtaccctagaacaaaaatggtgaggtcattttgattctgctaaagttggtatgactggaaagccaaatgacacagttatgagcatagaccttttattttccagatgtttgacagtgtaaacatacataaaatacatattaaagtttagatgctttatattttgtgcaataaattgaagccttaaaacatttcattttttttataaaagaaactcattagtttacttaattaagacagtaaaatagcagcaagtaccaagacattgtgcatttcttttatttaagacaagttacttcatttacatcagagttagaaatgttaagactggctttcttgaatacttaaatatagctcgaatcactggttagatatggacatattttcccaactgtacatcagggaggagtgctttcattagtttcagaaaatgcagaccctcagacagccagcatgaccacaacattgagcaataagagaaatgaagcatttactttccaagcatttgccacagaaggtaatggagtctttacatttgtggttgtctcttccctccataagttaagggttgtgctttgttgaggcatttcagagaaattatttggcatgccactagtgatacttagggtcatgggtgttggggatgattttgttgagctagtgaggcttgtgtttgtgaccattccatcttggagatgaatagttagagttgcagctgctgcttcatgtgaattgatagtctctgtggatgtatcttctggatagggcacaaaagccttatcagtgctagtaaaggtggtgtctttgcttagagtggcaccaaacgttgtttcctttgttcgatattgtttgggtattttggtcactttgggttgagttaccacactcagagagttaatggtgtccactgtctgcatcccacttacagtgaataagcttgaggtaaatccagaaggtgtgggatacatgttatgttcctttaaagatgatatttgggtagaacatggagtccctatcacatgggcttttgtttccatcatccacttcagtaagtaagtaatgttttgtttgtggtcacatgaccacctgttattgtaaagggttatctcttgcaactgaaagagttggtcaaaagattggtctggaatgaatgtgaacttattgttgtgcaggtaaagatgtgtgagatttgtcaggtttattaatgtacctggaagaatttgtgtcaaagaattattagacaggtccacgatatgtagtttggagggcatgttggttggaactgtccaaagtttgttactactgaggttgagaacctcgagacttcttagtgtatttttaatgaggacaaccttttccagcatgttcttagaaacatccagatatttaagattccactgataagcagtatcagatttgtcaagaagtttaatgttgttgttagcagcagacatgttccacagagaccgaggtaagtgagcaggcaggctttcaagcctgttgtttgaaatgtccagggtcctcagattggtatattgggttaactggttatgcagatcagtaaagtggttataagacaggtttaaatgtataatattctcttgcagtccagatggtaatgtagacaagtttctgcctgaacagtccacatgcctgtgcctctctgtgcatatacattggagaggacaaatgcataaaataccaggtgtgagaaacagaaggatgaacaggcagagagacattttcaatatctgatattccatcaaagcctagaaacaaacagatacacccttcttttaatatgcaaatacagtttaggcatctgcatgggtcagttagcattaggcaaaattttcaataaacctcgttgttgtcgagtccttttataattgttccagtgattaaactaacaaagctccccttcatttatagtccaaatgcttaatccttcaattgggctatgtggtagagagagactctctccctactctctcctgcattttctcctttattttctctctccctccccccttttctaaccatattctttcttatttatctttctagagccttaatatgataaaatagcattctttgcaaataaatagttgcagttgtaggctattactatttttgatgatatgctttcttactcagatgagaaaaaatggctgtcgtgtcttttttttttaatctctgcagtaatgtaattcaatgtgtgtatatagggtagattttatttagatattaaagcagttcttcgaaattttatctgtatgtttttaggataaatatatctttgtaaaaagcacttgaaaaatccagaccaacacagtacctataaacctcacattttataaagtgatttttttctgtatatttcagtgcccattttaaaggaaaacaatatgtatatttacagagtgactgaatgtataaaaaatatccctcaactgacactgcagcaaatttctggtgcatgcacttgctattgaatatatatttaatcctaacgttgactttttcttaaaagaaaaaggaaaaagattccaaagtcagccttttactgatttaaataacatcttaccgtggtgtcgtcttcaacatcagcatctcattttctctgggaaacttaaaggtcgtcttgttctgtagagtcggaactgtttctggctgtgggctgtgcttgcctgctcagctgcattgtgttgctgtgagctgaagctctgcaaccacctgatcagtaccacataggaggactgcagagctgtcgctggtgctgactcaaatttatggcaagaggtgcacacgcaacaaaatggacaattttttaaaaaatttgtggcatcaagcgtacctatatatctgatttgctataggatgggataccttatgcatgagagttggcccttactcctttctatgtatttgtctgagattgggttccatattttaacatttgcctcattaagaatctgtgaatttttaaaatacctctactctttatcctttttacatgttgaaaataaatttgaccttcctcatggatagttttctatgatattagtcccactattttttaactcctgcctttttatattcctttctaaaattgtataattttcatgtcacttttttaatattataaaaaatctgttttatgacttttatgtcttcccccaacatggtgattattatgtttaatcagcttttcaaatttatcaaccacttaagtgttccgtcttcccttttaggatgtatagaagtactgaaatacgattattttttctttatctttctgatacaatgatcatttgaccaaggctacacacaagccaggatacatttggaaattagcatcttatacttcagattatcagttcctatgtaaaataaacatgttttattttatatatttggagttaaagttttttttctttatgcaaccttgggtggtaagtggatatgagtattgttttttccaaagacatttttggtgctgtatgaatgaccatttatttgattttatgttttaagaatagcagtatcaatttaggtgatttcagagtgttgcacatttcatctttctgggaaagtagtttatagttttaaaattacatgaaatgatataaaaggaaaatttttcatcatgagttttataaagtgagatcagatttatgataaattttgctccactcttcagtggactgcttgtgtaaatctgttaaaacacaaatctgatttccagaatggcaagtttaaagaaagcaaataaagttacggtattttcgttaccaagtggcaccatttaaaaacgagtaatatttagcatgttatgtgtaaggaaagtctctttatgccttgttactaaatcgtttgtttttctctaaattatattagcattatttagattataccacaaatagaatttgttgtattaaaatttgaagtttattttcttacaagagaaactatactctaggagccaccttttgtataaaactaatgttcctcgaaaagtatctgcattttaagagtccgcaacatagaagtttattgttgattgggtgctttattgccactttactttgagggttcagttgaactctcaattggattcttactgtggatttaggaaaccagccatcaatcatagtgcttaaaataatgtgttaaaaatactacattcagcaatattgtggaaatagggaatgcattgacatttagagttctatttaagctcatatatacactgctgcacttctaaagatgtgactgagggtcaatttaccgaccacttaaatctcttaattttaggaaacctcattaagtcagtgtagaagtagagttatgcattttcattacacttaacagtacttttgtttgaaagaaaagacatgttacttcattaatggattcaaatgaatttgggtttaggctgtatcaagtttagtttctgttgtatataatagaaaattccagtgcaatagtagtggcaatgtttctcatttcaagtttgggacataccaaattgcttcatattattcaaagattattgtaaaattctcaaaaagaaaaagggagatcatttcaatatatttgaattctaacaatctcttacactgggtgcagcacaccagcatggcacatgtatacatatgtaactaacctgcacgttgtgcacatgtaccctaaaacttaaagtataataaaaataaataaataaataaaagaaattctcatgaaataaaataatactgtattactgttactcaaaaaaaatattttttagaggcataagtatgtgttacaacttattttaaatattattcagactcattacattttctattaggctgtctaggtcagtaatgatagttaggcaacttttacattctagattaagcagtaaattaatttacgtattcttttgtgtcctaggatatattaccccaacattgtgaaaggtatcacaaagcatctgccaaggaatagctatcccacgctaatcagtggtttcagttttccattattataggtaacatttgctatgcttgagagtcagatattgtttatttttggtaatatggttggctatttagactgattttcctgctgaatacaactgagagtactcaataaagtactttaaaagcatgaaagaaataacaacatagaaattaccaagtcaaaatccaaatgaatcagtttctttgcccacctccctactcctttttttctttatgccactggcttgttgccaaaactcagtcaattatttcctaaaatgtctctcatcttggagttttctctttgactctttgggaagatttaatttgttcttctgtcccccatattttctataagtgattcctcatatcattgacataattgctcatttgcatcatctcacaataatttcaaaataataccagtattgattgctacaattagattatagactaccgaataaagtttaaaatttgtttgtagctctgcttgctttattttactaaaagtgtatagtaaattctgtgttctaatgcaatgtgaaataattcttttctgtgtatttttatatcaccaacttgatataaactttgtttcagttttcagcttttcaggatcacaagtcaaaattatatatataacaatgtatattcagataaatcttgcttctctgtcttttccatcctatttccttccttctgctattagtaactgtttttattagtttttcgttgtatcattaacatttctttttgaaaacctaaaaaaaatgtaagcatatgtatggtatgttcttatccccccttctaatataaaaggtgacatatatacatactgttagataacttgttcttcttttcttactgtatcttgagtatcactccatatcagtatataggtatctgtatgattcactgtttgatccatagtactccatttgggaatgtaccatggcttattcaaccagtcccctattggtggacatctgggtttttcagacttttgctgttacgaataatgccacagtgaatacccttgtacctaaataattttatatgtttgccagtaaatctttgaaaaagattcctagaagtaggattgctgggtaaaagggtaaatgcatttggaatttttccagacattactaaattcctctccattgattataccattttgcagtcccaccaacagtgtatcatggtgtcgagttctatacagcctcactgtatactttgttgttgaactttgggatttattgtccatctgataggcaagtatctccatctaattttaaatgcatctctgtaattatgagggggagtatatgtctttacatatgtttaaagaccatttaaatgttttctcctgtaactgtctttttaatgttttgcactattaaaagttgtgttttgggtcttccccttcctgccccatattaggagcattttaaattttagaggtattagcactttgtcttgatttaagttttaatttttttttccagtttgccatttgtcttttggctttattatggtgaggtgtgtgtgtctgtgtgtaatgcgcacttgcatgtgtgtgatatttaaaagtttcatataatttgatttccctttttattgcctctggattttgagtctcagctaggaaggttttttcccgcttccagattataaaggaatttactcatattttcttctattacttgtataatttcatggtttatatttagaactctggtccttggtgttccaatatagtgtgaagtatggatcaaattttttcttttttccagatgtctatccaattgttccaatgcttgtttccactgatttgatatttatttctggactttttcttctgttccattgatctgtttgtttagtcatataccggtaccacagtgttttagttataggttcccaaaggtgctactttactttttgatcagaattcagtaagaacaacagttaaagatcaccctcatctaattcatttgtgtccctcaccactgacaccaaatagaagacttatgtgatatatgtatgtttcagtgcatgatgtaggtgctctttggtcctatattagtgaaaagagtgttgaaccaatagtcagggagcaaactcagcttttaataccacttctaagcacatcacttactttctctggtcctgttttctcagtagttaacaaacaaaaggagttgaaccaaatggtcttcagggttgtgtctgactctggttaatgctattttggttaagagcaccactagtatgtggtgtgaactttaatctaccttttattcccctgtgccttattcttttgcagtattcatgaaataaactttctcttctggatcttagttctttaatcttttctctaaaagatttttctttgttccagcattttcttctgtcctgcatttattagtttgtatctcttcctgctgattaagcaaggattgccactgtttggctgctcagcttccactgacctcactggggaaaattacatgcagttaaatgtgaattattcttcccccagcaaagaatttctttaaaaaaaataaaaggaaaaaagacaacataaaaacccggctgctgccagtagtctgtcctgttatacaaagaacagaaagagaaaacctccctttaaaagtacttaaagatatcagacaacactgtggtcagctaatcagctcccgtttaatctaagaaaattggtatttccctatttttccctgtatttctttcaggaaagaaggtggtaaaaaggggcaaaaatgtggaacgagcccattaagtaactgtcacaaatgtaaaatgagaacagttatgatgatttaaggcatgtcaaagacttggccaagtataaaaacatatcttatttaccataacaaaaattcgtaaaattaaaaagaataataggaaattctcaactccagattgctgctggggaaattagctttaaaagtactaagtttgggccgggcacggtggctcacggctgtaatcccagcactttgagaggccgaggcaggtggatcatgaggtcaggagttcaagaccagcctggccaatatggtgaaaccccatctctactaaaaaaaaaataccaaaattagccaggcgtggtggtgcacgcctgtagtcccagctactcagtaggctgaggcaggagaacccctttaacgtgggaggcggaggttgcagtgagccaagatcatgccactgcactccagcgtgggcgacagagtgagactctgtctcgaacaaaagtactaactttgaagaatacatgaaagaaaatttttaatgaggaagacaaaagatgtaatatgacaataagtatcatgcttattcaggaaaagtaagaagctcaaggaagtgtttctatagattaaaaaattaatggtcagtaaagatggcttgaaagattttaggaaaaacattgtatgtaaaattcctgtgtccaaaaccctactggttcttattaaatatggagctttgttaatgtcatgaatgccagtgctatgaataaatgctatgttctactctgaaaatcccagaactatgagtggttctccaagactgggctaccattttattctaagtgcttgtttccccctggagttagatgggactaatgaggaagaatatgtgcttgttgggcaaaggagcacttctgcagacaaaggctggcatccccaaaagtataggctgatgaccactcttgactttgacaaagattgggcccattcctactctaataactcagacttaccaattgtcagataatggataaagatgaaattctgtgtaagaaaggtgacttaagagtggatagcatcagaaagtataagtttagtaaaaagttgagaatcatctgtgttttgatagtctcttttcctgaaaaaaaaatcacccaaagtcacccgtatttagaatgaagccatagtcttcttttccttttttttgctttataaaacttgattttgtttgggtgtttataaagaagaaacttgtaaagatgccagttttaaaatttgtgcccccccaacatggtaggaaaatatttacattttatgatgcatcctcatatttttttcagggtaaatgttcctaacccaacccttcagttgatgttttaacatgtttgttttactctttgcaatgaaaccaagaagaaaatttctctattctcaaacatgcattttaatctcccattcccacaaacttggaatatttatttaatacttgaggtattaatttaaaacttgaagcatatacttagtctcttattcctctccaccctggtctttgaaatggaaacataaaagtttattcaccataattttatacacagcttttcaggggaaaaaaaactgtactgggtaataagtatatgtagattgtttcagagttcttaaattattgaaacataccatttacatatgtaaaatgtactatactttaaagataggtactataattagtaaatagattactgttaaataactttttttaaaaaaaagtttcatctatgcacataggctctgagcagatttcagatagttcctgaataaaaatcaaaattgactatcagttgccattttatatatgttaacatataaagaaaaaagagtcatttgaggatggaagatcagctaaaaagcaagttgtaatatttataacagttctgcaggtggaggtggcagggattcattaagatcttgatcagagttgggaggaatagagaactcctgacactggatctcaaggttggaatcttcttggtttttcataaaatctactggtggcaggggcaagttaagtgagtcaagcggtggaaatgattgtattatctcagatttatgatctccacagtcttgattgagacagtccagagatggagggagactagtagaatcatttggaagaggagatacaattgtcattgtgggtttgtcagattggttactttcctgtccttccaaatccagaaggggaggtggtggaggcagatctgcatcatctgaagaagaaacagcagttccaactgttgaaccatcagcactatcttctgatgtaccatttacttgatcttttattttctctgttttggggttgttggagtcttcaatgttttcacttgattcaaacaacttaatttctaagtcatctgctaaaagtgtgcttttgcttggtttccagggtgtaagtgaaatgattgatgtacgttttgtggatatttcattttctctgatgttatccatacaaatgtcaggggtttctccatcagcaaatggagatctacctgcccaattttgatcatttaaaactggtttccttaagcatttccaaagtacaatgatgattatagctaccaacatagaagtcagaagtacaccaattagtatggcagctattgaattataattgtttttttgtggggtttgtttgttactggtagtatctaagataaatcctggtgtactcctaggtgaatttttgacagttgatgttggttgtgtggatggattatgaacagttatttgttttctagaagggatctggacagatgatgattgttgagtaaaagtatagacaaatgactttggtggttgtgtggtagaagtacgggcagatggtagttgtctggcagaggtgaacacggcttgctgggaggaggtgttggctattggtgttggttgtttggtgttgtaggcaagtggttgtccagcagaagtatgtgcttctggtttttcagaagaggtatagacagctggtgttggttgtccagcagtgactttggcaggtgatattgattgtccagaaaaagtgtcgctgaattgtgttggttgacccaaaggattccctgttgtgttttgagaattagccaatacctgtgacattgatgatgtgaataaggtaggctgtgactgcttctctgttgtaattgtctctgtctttgaaaaaaatgtattgttcaggtgtccacaaaacaaaattaagatgaaatatttgggatccatttcagaatatttcctcgttatctatagcgggtttataatgaaagagaaagacagttaggcgtcattggtgtctagttaaaaatttgacttttcattatgattcctggcataaagtaggtagacattattcctaattagtagtagttgattagtagttattattcctaatttagacttgatacactgtaggtttggtgtaacaactcttggatatactctaacccatcatacagcatttggacctcataagcagtgatctctcttcttttattaatacaagttctgtacttggctctgctgcccctctagcttcattatatttcagtacttcacttagtcatacttctcaaaacgcataggctctatatgctggatccatgtgttctctaccttttttcaccattttctactagaaatatattgattctcctgccttgaagaacaccagtgatcatctgttacctaatctaattgttctttatttcttctctcccctcccctccttgaccacattagacactactgttccttcactaatattcaagtagctttttgtaatcagtcttcctttcatgttactctcactagctctttttcttctgcctcctaaatatggttaattgatattctgtcctcacccttacctacttttctttgttcctgattctgtaagattttagttctcagctttatgccacaattcctaaacctgtacctccagcctacatcttctttgtcctaattctatttgtgtgacttcttggtggatttttccatattttatatatatagatagatagacatagatatagatataaatatctcccactatcagcaaattcaacatatttaaaatggagttcatctttaccctcacaactgacaactgactcttctcccaacttctctgtatctgttaatggtaccactaagtttcttaggcacagagtctattagtaatctttgaagcatccttagtgtctctgtagcgtggtagccttatgttaatattgcatatttttaaagaatttcattcaactcagagtcttaggcttaaaatcctagagtgatctctgaatctggtggagtaaattcaatccagttggtcaagtagtcctgctgctgctttcattcatctattggtaaatgccacatttgtgtggagctctgttctaggtttaggagattaaaaaaaaaaaaaaaagatagtcactgcctttaagtgtttcagattctagtgatagaagcaaacagtaaaggccaggcgtagtggctcattcctgtaatcccagcactttgggaagccaagatgggaggatcgtttgaggccaggagttcaagaacagcatggaccacatagtaagatcccatctctaaataaaaagaagaaagaaaaaaagctaaaaaataattacaataattttttttttttcaagacagtcttactctgtcacccaggctggagtgtagtggcacaatctgggctcactgcaaattccgcttcccaggttcaactgattctcctctctcagcctccaagtagctgggattacaggtacacatcaccacgcctggcctatttttgtatttttagcacagacggggtttcaccgtgttggccaggctgctcgagaactgacctcaggtgatctgcctgccttggcctcccaaagtgctgggattacaggtgtgagccaccacgcctggcccaattacaataatttgataagctttctcataaaagtatgcaggagatgtacagagaagttaacctagcctggaaaggcttcagtgaagtaaagcttgaactgaattttaaaagtctataaaaactaattaagtttccagccagggagagcaacaatgtgggcacaggaaaataaggcacatatgaaagtttggcagatagggctttttctgggatgtggtagatgctaaaacttggagagttaagtttcagttctacttctcccatctaactacctgtctaaccatgagaactagttgcttaacctttcctgttctcaattgcctttcctctaaagtgaagagttctactgagacaatttgcaacttttggtataatatacttgttttgcacatcatcaaacacaatggcaactatttggttatctcttaacattagggaatagaaaatcttagggtgttagatattggtatacatgattagaaactatagttcttctgactcataagcctatatttagagagatttgatgttctgttggaaggtgcaataaaggttttacaaattaccttttcagcatatctaaacagcatatcattgcttactcctctaccacttggtacacagtgatgataaatggccctgttttagtagaagaaaagatatgtgatttttttccctatacgaataattcaagcctgaattttaaaacagttctcctttgaactctcctgcacactgctgaattaatcttaaaagtgtgcatgatcaggttactactgccttgcttgagggtttaatttctgttaagataaaacttcctttttctttttttttttggagacagagtcgttctgtcacccaggctggagtgcagtggcatgatcttgtctcgctgcaacctctacatcctgggttcaagcgattcttgtgcctcatcctcccgagtagctgggactacagtaggcatacactaccacacctggctaatttttgtatttttagtagagacagggtttcaccatgttgtccagaccggtctcgaactcctgacctcaagtgatctgtccgcctcagcctcccaaaatgctgggattacaggcatgagccaccacgcctggcctgttaagataaaacttctaaattgagttttcttccttctggcttgagttaaccagtccagattcacgtatcatgactgaaacttcttatccagccaaatgcatccctttcccaccttgcatactttctaaacacacgatttttccctgctaaacagacacttctatgctgttttttacccttctcaagggtgttcttttttttttatttttcttccagacctagcctcttcccctttctggctgcatatctgaatctgtcctcatctttcagacctcagtttaaattccccttcttaacccaagttctctgtgactgactacagcccaaacagatcagtcatttactgaattccccctagctctcatttattgtttttatggttccttacataattcatgtatgtatctcactcacacttctattctcttaagtaattgtgtttacttttcacattttcctatacctacttccttgaacaagattataaagaaccttgaagaaggcagaaaggagaaagaaaaatacttatctagagcatattatgtgttgtactatcccagttttgcatactttatttcacagaaccttcaaatgactttataaggaaggtaaagggatcccttatttacagataaagagacagtgtcaaatgagttaagcagtttgcctgatgttataccactcgaagtgacagattgggagtttgtacccagggccacctgattccaaagcatacattctttctgctaccctttattgcctcatgtttttatattttgatttctttgtagttaatgccttatatattaggagcacagtaaacatttaacctgtattgggcttcttgattcctttccattttagtttttgctttttactagtacttctaccagaaaataagcagaggcagtgaaatctgagttaataaattctgctttttatccattttgcaaaagatttaaaagggaaaatttgaacacttttggcatagatatagggatttgaataatctctggatggtcatcatccatgcagttcctacccattattcttatagattacaaaaaaaggcggggggacttctttagaaaatgttattctcttcagaacttcattttaaaaatctgttttaatgctatgcaaagcatcagaaaatataagccatgaattgtctttagccaaaaatgtttcctcttttgtgactttgcttaaaataaggaaaccatacggttcctcttttcagttagctgaaaaaggcattagagaaggacagggcccaaacaggaacataattttaaacccaggttagtttgtaagatcaattttgataggctcctatcctctactgtcagtagtaagctggtggaaccctccatgtatgagattttcacttgtcagttaacggttatggcaatattaaaaccaaattccattttttgcctatcctaacactttctaccactcttcagttagctttttatcctcctaggatctgccacatcagagtactagaaactgtattagaattctatgatggcaattcagtgtagtccagagaaggagaagaaagatttaaaagaggaataaatagggaatatggtagtggaaaaaactgacttttttcccagcggtaatgaggccagcgttactaccagtgtggaaggttatttagcatacacattttaaaatatgtaagtggtgtgtacctgaagtaccaacattgtttctgtaggtaaagaacaatattgggcaggggaataaaaaggagatttagaataatataaaaggcaatgcaaagaaatacaaaataacacaaaagagaaaaaacaaaaactctaggaagcagcgaacagaaaagaggaaggtcaattgactagagaagatacagaaaagaagaaaagttaataaacaggtgaaaaaaaaagcagtggttatataattagcaagaaggcagtgtagatgattgaagtaggcaaaatgaagttgggggtggggggagatgattgaagtagatgaaagaagcaacggcaaaatgctgctctgttgtggctggcctgtgtttgtgagtgcagggagacagtaaagaggagcttgctttctaaaatggaggaccagaaggaaccatcctttcaaattcatttacctttcatttcaggctctcctgtctgctgtgagtatccttaccatcctctccctttttttttccctgacactatccagaagcatacctagcaattattccaaagaacccatgtacccgtgtacgttttatatagagttttccagaaatcccttagtctgctgctcaagcaaatttgtcagccctcatatgccggtttttactcattattataggctggcactttgaggtttaaatctgtgattttggttctttttctttgctgaatatttagaatattttaaaaagaaaaacataaatttaaacattttaaagacagttacagtgaagcaggagtccccgtgtataagacatgttctttttttttttttttttccgtttggagacagggtctcactctgtcacccgggttgcagtgcagtggtgcaatctcagctcactgcagcctctgcctcctgggctcaagcgatcctcctcacacctcagcttccctaaagaagttagaaactgcaggtgcactacaccacgcccaactaatttttgtattttttgtagacatggggtttcaccatgtcacccagacttgccttgaactcctggactcaagtgacccacccaccttggcctcccaaagtgctggaattataggcatgagccaccgagcccggccatagacatgttcttataaatataatgcataagtacttaaagggtccagcatttaaaattgatgctgttaagttggatatgttaggaagtatgccattatcttttaaagagaatcaagatttggagagcatatcctagacaaaagacaagtatagatagctgtatcaattactttgatataataaaagttgtgatgcaaatataatagattaaaatttagcagtagtattatctctaactagtgaagttttgaaaccgtaaaagaaaaaaccagccattctgcatcttgaggaaaagtggaaagagaaattgaccttcaactacaataggaagtatttgatgaccatcttgtatcatgatagtgaccatttactgagcacccaccaaaggctaagcagtatcctattttaattagctaggtggtggttttttcatcctacagataaggaaactgagacaccacgatgttgggtaacttggcagtatcacagctctaagtagtggcactaatacaaaaatcatgctaatcttgtgccagaaccgtttctttctatcacatttcactgtatgtgctatactgcctttcatagaaaagttatgaaatagaaatgctttatgaaggaaggagatgtgagttggtgggaattacacgtaaataacacttgtaggtagtcttagataaagggtaggaaagaaatacctgaaaacccattttagtcctgattctacgaaaactattataagaatttggaatggtttctataaagtgtcatatttagtaagtttactgaaaattttgtggtgattttttttttaaagcttggacattgaaaggcatcagatttatgtttctcaattcaaacttaatcagaattaaagtttccttctaagtagaattatgtgggaattagctggaaaacacaggcactactagtaaactttagatttgggactaaccctttaaaaacatgtatgggaccaggcgcagtggttcctgcctgtaatcccagcactttgggaggccgaggtgggccaatcacttgaggtcaggagttgaagaccagcctgaccaacatggtgaaaccccgtttctactaaaaatacaaaaaattagccaggcgtggtggtgggtgcctgtaatcccagctactcaggaggctgaggcagaagaatctcttgaccctgggaggcggaggttgcagtgagcctgtgagccaagatggtgccgctgcacaccagcctgggtgacagagggagactccatctcaaaaaaaaaaaaaaaaagtatgggattctatgacaaaaacacaccataaggatcgatgggaaattttttaattttatgaaatatgacagtgaaaaaaatttaatataattttatgactttatgcataatgaaataaactaaatattagaagtagaaaaatatatagacaagcctaatctgaaaaagagataaatatctttattttctgacttccacagtaattacttagaagaaatccttctaagagaaagtcatgaatatttattaagtgttgaaatgggatatcacccactatgaacatattattccctgaaattacaagtctatgtaaaatactctttgcagtttttatttgcccattttacccacagcaagcatcttttatgcatattaacaattttctattgtttattctataggtttcttctatcttatactatgttctaaagtctcagataatgtgacataaacacgtagatgatattaatatacgcatgcatgtttgattattgactaacatttttggcttagtaagcttttaaaatgagccataatgttttcatgtcatcattattaaatataaaatctatatgtaaaaaataaagcatgtataataataatagtcaaataccacatctgatttctttttctttctaaattaagtgaaagtgaccattcttactatgcaaactaaaggggatacaaaaattttaatttatgcattatattatgtacaggaaaattctataaaaagtacattagaacttttaacaattaatattttggaggttataaattcagtcatagcctgtggaatctagttctatttctaacccttagctttatctgccatggctatagtttctttttaattctaaaactaaggttaacaaatatgattgtggctgggagcggtggctcactcctgtaatcccagcactttgggaggcggaggtaagcggatcacccaaggtcaggagtaggagaccagcctgggcaacatagtgaaaccccatctctactaaaaatacaaaaaaattagccaggcgtggtggtgggcgcctgtaatccgagctacttgagaggctgaagcaggagaattgcttgaacccaggaggtggaggttgcagtgagctgagatcgtgccactgcactccagcctgggagacagagcaagactctatctcaaaaaaaaaaaaaaatatgtgtgtgtgtgtgtgtgtgtgtgtgtgtgtgtgtgagattaaataaacttaaaaggtcttatacaaacctaggtgaaaatatttttctaaggcaagctgaactgagtattttttaattctatgcaacaaaaccacaaaaacctgttatagacatctttagactatcagagtttaagtttaaaacactaatgacagtttttaaaataaattttatataaagcaagatcaaaccaaattgtgtgaaaattttcttacctcagctgttaacttcttttgcagaatgctaaattcttgttctaactggacattttggtgatttggctaagaaaggaaaatgggtggttcaattcagatttaaaatgttcctctagcaaactgaaatagtttctgtagaaaaagaggaagtttatcaatagctggttccggaagtgcaataaaccacaaagtgactaagaaatatattactttaacagaacttattttgaaatacattttggagccctatgatttgagtgcttttaattatgtaaataaatatttgagatactctagtaatatgattatgtaaattaaatatttaggatggagtcccgaagagaaaattacatgttctaagaagaaaagctgccagttgggttatcacttacagtgagatttcttctcataagaagtgagtgatgtgttctgtttacttgtatgaccttaggcaagactctgcacttctgagtcaccgtttcctcctctaaaggaatattttattgggttattgtgaggattaaataagatagcataatataacatgtataaatgcctcaccaactgcaggtaaccaataaatgtaatgttatttcctcataatataaaaagtccagggtaaaagtataattacattattttgcaaatgacaggatctcattcttttttatggctgaataatactccattgtgtatatgtaccatattttctttatccattcatctgtttatagacacttaggttgcttccaaatcttggctgttgtgaatagtgttacaacaaaagtgggagtgcagatgtctctttgtacagttttcctttctgttgggtatatacctagcagtgggattgctggatcatatgatagctctatttttagttttttgaggaaccaccaaactgttctccatagtggttttactgatttacattcccactaacagcgtacgagagttccattttctccacacccttcccagcacttgttattgcctgtcttttgagtataagccattttaactggggtgagatgaggtatcattgtagttttgatttgcatttctctcatcagtggtgctgagtaccctttcgtatgcctgtttgccatttgtatatttgtaattaaattattttgaccaaatattttactagtgacttttgagttcaagttctcaactatttatttgattacccacaaagtagttacttctcagtggaaaataaaataaattggggatcattttttaaataagaagttaactaaagttaacttgttactaaagggtaatgaggggttggggagatggtgttaccagttaataggtacaaaaaacaatagaaagaatgaataagacctatttgatagcacaacagagtgactgtcattaataccataattatacattttaaaataactaaaagtgtaattggatcctttgtaacacaaaggataagtgcttgaagggatggataccccattctccatgatgtgattatttcacgttgcgtgactgtatcaaaacatctcattaccctttaaatatatacacctactatgtacccacaaaaatttaaaatacaaaaaatttttaagttaactaaacaaagtgtattgaaaggagtgagtccatctgaataaaaatttctttgagtaagtcacctttcctctcttgaaaaatggagatcataattcctaatttataagcttattgtggaattaaataaatgtaaagtgccttggatgatgcatattatagtaggtacggaatgtgttaacccatgcactgctttttcctggtcactgcgggaaacacaggttattatgaccttgttcttaacttcagggtacttatagcttggtgcaaaaagaatagtttttttttatgggctcctactataaagcataatataatcaaatgctataaagcttttgattcactggtttttggaagtattgttgtttttacggacagggtattgctgtgttgcgcaggctggtcttgaactcctgacctcaagcaatcctcctgcctcagcctctcgagtagctaggactacaggcacatgctactatgctcgctggctggcttatttatttattgtaaagatgaggctcttactttgttgtgcaggctggcctcaaactcctggcctcaggtgatcctcccaggattataggtgtaagccactgtgcctaacctgattcactatttttaaatccctgaattaagctggtgaactgtaatacccaggggtagggaatgtgtttttgttcaaaactaaatgacttttaaattttgaactcaaagatatcttacctaccattttaaaatacctgtcatttggaaaggaaacacttctgtttgttcagtaactatcattggatagtaccattctgagagtatatgtttaatagccaagatagtgagtggtgaattttaaatattcttttaaatatccttgtggtagaagctctctggtgagaaaatgtttgaccagtatgttgaatatgaaagtaatttcctatttttatgatgatattaatttcttttaattttctctgacacgtgtttatttatgacccttgattcaaggagtgctttgtgttactcctggatgtactggtgcacaatctcaaattttcaatttttgcacagaatgggaagtctgcccagtttcatttctaatctgggttatttttcccctcaaaagataacctgatttcagtcaccatgactggcatgaatattctcatgctttcctttttactttgttaacacttaactttatctggaataatattgttatgatttctcgtttagagaatagatttgttttttacaaattgctaataaattgataataaaaatgatgctttatttttttcctctcattttaataatagctagacgtttgaatttgatgaccaagagcagttatcaccttgagagttacgtaaaaattaccaatgcttagagttcaccccattccagttgcatcagaaggaagacatgggaattaggcattggtgttttttaaaaactcttcaggtgattctgacatgcagccagggtaagaatcactagcttagaagggagagtaagattgtagtcatacttgggaaaaaacatataaaaaatatttttaaaatggttactatattgcccgaaataaatgcccagtaagggatgagatttttgaaatgtggcctgatcttagccctgtgttaatttcagtagatatttggaaagtctctcaaaccaatttttgtaatatatttaattgaagatgggggggttctcaacttaaatgtaagtcattattttacttgaagccagtttctttaaaggttaaattataacctgaagtatgcagttttccagatttgaacacacacacacacacacacacacacacacacacacccctaataaatcattaggctacttggcatccttgaagtccaaaaattaatcaacctttggtacttgttgttaatgttccagtaagtagtatttatagaaaagatgaatattattaatcataaacagtgaaacatactttgcgtttacacttagcctattggtgtggctataaatcttatttattttagttgtgctctatttcttattgatctttacaatgtgttctctaaagtaataaagtgaatgcaaatatacgtggtcacaggtttattctgagttttaatttattatacaaaagtaaaggttttaatttaatattaatagtagaaaaacactttcttacgtgtgccatatggaaagataaaggatctattctaaaattagctgtgttggttgataagctggtgtggattctgccacatccagcaaggaagataccattaaattacacagtttagctctctctatctatgcattaggaatttgacttccatttgatgttaaagcatatacttggctttaaggacacactaaaactattcaaagtttaattacattcagacaaagatcatctaaccactgttgctacatagggaatatttatttaattatcccttgctatctctattaatcagtttcctcaatttatccttaaaattttcctcaaatgcttagttattttattatttgctttttaaaatattcagtgtcaaaacaaaagtacacagtttaaataattaagcaggcatacttctccctgtctcacctgcttgattctaaattgcaaggtctaccatgtcaaattttagataatcagaacaacactttgggattaaataccaactgacttcatttttactccataagccttctcattgctactttgcatttttcttcactaacctatctgtttgttagtaagtttttcagttccttcttcatcttttctttcccttgtagctgtgagcactccagtagattgcatcactaggttgggtcctgtgagctgttttgttcttttccaagtgtctgattcagcgggccatagaccgcttgccagaaaatcgccattgcttctaggctgacgcttgcctacttgttttgatcgtctgagagaagagactttgtttgccaaaaccacagttgatagaaatagaaaggtacagataagaaaaagcactgcaattataattaagcaaattagcatagccatgttgttgttgttttccgcacagacatcctttttgaaaatttcaccatgacttttgcttgtgttttcaatgctctgtactgttgaaggactgttgctgacgacagaaggtatataaagctcctgttcagatttagaagttaaagctacgatgtgagatgtttcaggcatgtttgtagaattacctttataatctacttcaggagttatagggtttgtgttaatgttttcattttggtttctgcctgtcttgttttgaataactgaatcccaggaagaagtactgttagcccacagacgggtatagtttgcttttgttccaggagacaaagaaaaaactgttgtcatcagaaaggcaagatgtaggtaatgtcctgtgtgttccatgtccgtgggcatgcttggcaatctgttgggatagcaatataatttgttagtttgtgaaagaataatggatcctagttttggtaattgtagttaaaagatagtgttgagatgttacaagtaaactacaagcttatgcctaatattcgctaccctgaattccttctcaactaaatttcttttctattcagctatgtatgaagaagcattttaatttctattaacacttttagatgctagaagttagcattacaaataaatattaatcattttaagtggactatcatggctttatatagttttcttcctttgaagcgtgctagacttctgctttgagtcagttagttctgcttttacttttctgattccttctttaaaaaaaaaaaaaaattaaggatcattcttacagaaactacccaccctctaacctgtcaccaatctttacagaagaaatgtggccttgagcttcttgcttcatgtatgaaataaatgcaaatttttttggtggaaagaggggaagtttggtagcaaccaaaagaaactgaacttcaaatagaaattcaaggtgttctttttttttcttgggtgttcatcttgaagcttagaataaagctggtacttagaaatacatttgtaagtgtatttgtgaacgcaattttactgtggtggttgtctcttttcatttatatttccctggactgactgtgtctttctgaaggcaaaggcataccagttttctcaacctaaaaatctgaagaaaaaaaaaaaaaaacagcaaatttcctctgagtagacttaaaagttcaacaaaagttgctgggttttcttttaaagcatcatttatacctagcattttttctgattttgacataattgtaaaaaaaaatgtgtaataaaatagaaatagagcatcaggatcttgatgatttgggatgaagtggcaggttataagcatctcaacagataattgaaaatgttgaatttccgctttggccctgagcttgctggaaactagtacaaaaaggagacaagttatattatacattttttaaatctaccaaatgattgatttaaatagaaatggcatatcttagaatttaacagttccatgtactgctaacccagcaggaaagatttataatcattattaaggtatcttataataatataccagtttgtcttgagctacttttgaaaggagtattttattgttagcatttatttgaatgaactaaaagcaaaactatattgttctcctgagatttactaaatgaaattgcctggttaagaaccctacgtatgctatagaaattcttctcaaatgtacttaggagtccttttatttaaaaaaaaaaaaaaaaggcagattcttacctagctagtataggtagggcctgaaagtctttgtttccaaaccaactcctaagcaacatggatgccactgctagtcaggcttttgaacatcaaggttttataagaaatggttgttatatgtcattggctgacatttgtatactattaaaatacagaaattgaaaataagaaatgtgatacgttgagttatgcaaacaaaagtagcatgtaataaacaatgctaactggagactatatttcatattaatagtagggaggaaaaactattaaatattccaggattaagattactttttagattatgacctttagtagacaattaaaggcccaagtcactggcttttgtataatagtgttcagctttaatttttaagtttagtgacataaatctttggatatttcatgattcttccacaaaaagaaatacttgaaattggattagcaagtaatttccatctttttatactagactggacttctgtattagatgctagaatgatttaaagtagattattcttttcacattagttcattaacagtgtagtatacatcatagtattggtacacattttaacagtgcttaccacggaacagataataggcctgctgttgattgtcttcagccagatgtactgcagtgcccaaataaacaaactgtatgacaaaatgagactttctcttgcccttacaaatgcctgagaattgaggactgtttttactccagtttatgccttggaggccaggttgtgttatcagaagttttcttatatctgatcattttcagtagaatttattttcagtagaatttgtaatgtccaagcattagtaatgagaaatttattttttaacttttgaaaaataacaaaacatttccagtttacttgaggaaaccaaacttagatccttcgtaatcctaatttaaaactccatggcgatggcaaattttttcatttctaacttaaaatttatgtaacaggacagaaaaaaaaagtatacattttcagtcacaattctagtttgttagtgagattcttacacactttgatagcatttcctcgaacactaatctgtcagacgttagaagtgaaaaggcataagaaaagccgtatatatatgacctaccttacaaaatgcttggtcaaaatctgattataacgtgattttgataaaccacttcttttcttgtcttctttttaaagcagaatagacttggagaatatgagccttaaagtaaatctgcagtaaaaaaggatatgtgcagctagttttccacttttaaaaccaaaccacagatgacacatttcctttccactgcaactaaagcacatgtcacaggagggaaaaaaaaaaaaacaacgaaaaagctccaacttctctagttggccactggcatgacaggaggctttgtagaaccaatccccgcctccagagcagggagggttttccacttaatgccttttgacagtatgctcattctataggcctgctacatgctttagtgtcattcaaaagaggttttgaaatggtatcttccatttcaaatcttctctaaaagacttatttgaaatctacagactgatttgaaaatgtgagtttggagtccatgggatactgatcagataatgtaacaattgtggaactgcagcaattatttgagaaaatatctagtaaacttagattatatgggacagaaaatgctttcgtgtggtgtagtgtgtgtatacacacacacacacacacacacacacacacacacaactgtcaaacatcctgtcatcacctcaagtttaacatgactgaaacagactttaagaactaggtatgggctgaacacggtggctcacacctgtaatcccagcacgttgggagggttgacgcaggcagatcacttgaggccaggagttcaagaccagcctggccaacatagagaaaacctgtctctactaaaaatataaaaattaaccaggcagggtagcatgcacctgtagtcccacctacttgggaggctgagacaggagaatagcttgaacccgggacgtggaggctgcagagatcatgagatcttggctgcatgagctaagatcatgccactgcactccagccaggaagacagagtaagactctgtctcaaaaaaaaaaaaaaaaaaaaaaaaaaaaaaaaaaagaactggatatggcagcacatatctgtaatcccagctactaggtaggttgaggtaggaggatcactggtggagcccaggagttcaaatccagcctgggtaacatagcaagactccatctcttaaaaattaattaaattaatgaaataaaaagaactttattttttctttaaaggaggctgcctgtgacagtcttcttgtttctgttcatgatagcaacattctaatatcagaggcttagtatacaacacatcattttaatttaagtcctctcagtcctgatcagactttgaatcatgttggtccttccttcatattgttggatcagtttctttttccctgtttttactgtcaacagtactattttagatccttatcaggtcatacctagactctacagtgccttttcggtagccctgaatccttcttatatcttgtatacatcactgtctttggtcataccaccctttctttaagggaaaataaaaccggttgaacagttccctaatacatacaacaatgattcagaaatgtttgtgtacataaacatcagatgagaagattgtttaaaaattataaaagcaggacatggtggctcacacctgtaatctcagcactttgggaggctgaggcgggaggattacttgagccacagaaattcgagaccagcctgggcagcatggcaaaatcctgtctctacaaaaaatacaaaaaaacaaaaacaaaaaactagccgggcatggtggcgcttatctgtagtcccagctactcaggaggctgaggtgggaggatcacctgagcctggggaggtcaaggctacagtgagctgtgaccgtgccactgcagtccagcctgagttaagggaaaaaaaaaaaagataaaaatttccaggccccactacatagatccatatttagtaggtccaggttgggaccaggaaactgcatttttatcaagcaccacagttgattctgacgccagtagtccacagaacatatgctgagaaatggtgagcccctagtagaaaacctaagccctttggttgggcagttatggtctctccacaatttgactattctgtattttcccagctttatctctcaaaacttctctacctgaatcctccattctggctagactagctgtctcttcaacacatctagttacctgtttcttttcctttttgcctttctccataaggcctgcccagtcctcttgctgagtctgcattcctccttacctgattcagccactgtatcttctatgtagctttcactgactgcccagtttgtgttaatctctctctctctctcctttgtcttaataacagtattttctctgcatttcctttgataagtgattactttctacctcatatcttctatcttgaaatatttgtgttgttttaaaatcatttgacttgtcatatttttatcttattttctcccaacaagattaaaaattctgaggtgaagttttttattgatacatgataatttgtacatattaatggagtatgtgtgatttttttggttttttttgtttttgtttttgttggaatctcgctctatcgcccaggctggagtgcagtggcacaatctcagctcactgcaaactcccctcccaggttcaagcaattctcctgcctcagcctcccaagtagctggggctacaggcacgtgccaccacgcccagctaatttttgtatttttagtagagacagggtttcaccctgttggccaggctagtcttgacctcctgacctcaggtgatctgcccgtcttggcctcccaaagtgctgggattgcaggcgtgagccaccatgccctgcctgtatgtgtgatattttgatacatgcatataatgtgtaatgattaaatcagggtgattaggatatccattgcctcaaagaaaagaaattgtttcgtctagctgttttgaaatatacaatgttattattaactagtcaccttactatgaatagtagaacttgttccttctatctaattctaacaatacatatattatttattttattattatttttttaagacagtctcactgttgcccaggctgaagtgcagtggtacaatctcagctcgctgcagcctctgcctcccaggtccaagtgattctcgtgcctcagcctcccaagtagctgggattacagacatgtaccaccatgcctggctgatttttgtatttttagtagagacagcgttttgccatgttggccaggctggtctcgaactcctggccttatgtaacccacctgcctcagcctcccagagtgctgggaatacaggcgtgagccactgtgcccagccctgattatatttttatatccattaaccaacctctgaggtaaagatttattttaacttacttagtagtattatcaccagaatcatcacatatggaaaactttgggcctaagttaacatagattgttttgatttgaaactttggtaccattacttcagggctttttcatggtcctcactgtggctgctcccatttattagtattcttttggttttaagcaacatatgacctaatatggcttaatcaaaaaatggtatttattggcttatgtaactgagcagtcctgggataaatttgaccccaggagaggctttatctcatacacaaatgatatggccagggttccagtttgtctatttctcagctccttctcttcagtcttttgggaggctcttcttttatatcccaaaatatgagctagcaactcctagggctacgtattcccttgtttataaacaccaggaaagaaatatctcaaatcccaacaatttaagctaaactacctgaactgggcctctttggccctggttgtcctggtttgaataatgtgttcattgctgaatcagtctgtgatcaaggtgggataaatggattggctaaaaccatctcactccagagctccagatgggtcattcctaccagactattcgcctaaggagtttggtgggccctgcaggcaaccaactaattcccactgttttcttcctttcttgactcatgggcaaattttttattgttgtcgtggctcaaaatttttgaattggagatttgtctcttctcttagccttatttctcagtgtccaaaaaacaactgatttaaaaaatgaatccagactttgaagaattgttttatattattctctctagaaaatgaatcataaaataaaattgattagtggcatctgtatatttattttaaacactgctaataatctttgtcttttttgtcattttccttaggttcaaaactggtcaaatcaatggtgatttgctgatataccatgtcttactgactttaaagccatattatgcaaagccatatgaaattgtagtggaccttacccataccgggcctagcaatcgctttaaaacagactttctctctaagtggtttgttgtttttcctggctttgcttacgacaacgtctccgcagtctatatctataactgtaactcctgggtcagggagtacaccaagtatcatgagcggctgctgactggcctcaaaggtagcaaaaggcttgttttcatagactgtcctgggaaactggctgagcacatagagcatgaacaacagaaactacctgctgccaccttggctttagaagaggacctgaaggtattccacaatgctctcaagctagctcacaaagacaccaaagtttctattaaagtaagttccagtctgtgttttgtaaacgattcattgcttttcttgactaactagactatatcctggcctccctaggtgtcctacccctatagtggtgtataaaatgtcacgtaaggctgtcgcggtggctcacgcctgtaatccaagcactttgggatgtcaaggtgggcagatcacgtgaggtcaggagttcaagaccagcctggccaacacggtgaaaccccgtctctactaaaaatacaaacattagccgggtatggtggtgggcacctgtaatctcagctacttggaggctgaggcaggagaatcgcttgaacccgggaggtggaggttgcagtgagccgagattgcgccactgcactccagcctgggcaacagagggacgctctgtctcaaaaaataaaaggttatgtaaatctagatgtaggaagaccaacatttgtgtcatcatggaggtcctgtggaggatatgagacgtatacattttattctagcttaggctggaagtagaagagtgttttggagagggcaatttgttatgtcattcaaattgtaggaatgtgtggagagtagaaattacctaatgagagttctgattattacatgcttttttcagagtgaggaacatgaaccttcaggataaaatcagtacttttctataagattgtttgttttgttttgttttgttttttgatatggagtctcactctgttgcctaggctggagtgcagtggcgtgatctcagagtgcagtggcgtgatctcagagtgcagtggcatgatcttggctcactgcaacctctgcctcccaggttcaagcgattctgctgcctcagcctccccagtagctgggattataggcgcccaccgccacggcaggctagtttttgtaggtttagtagagacaaggttgttggccaggctgatcacgaactcctgacctcaagtgatctgcccacctcggcctcccaaagtgctgggattacagggatgagccactgcacccggccttctataagattcttgacctttttaaaaaggaaaattaaaaaatttttaaatgttttttgtttcttttgagaacatttatcataataattactgaaccatttgaatatacaatggtgggaactcttccttaaatggcatagtgttttgtttggttggttggtttctggagccttttagaattttatgtaaaagagtttaattcttctccacttcaccccgtcaccaccactttccaggttggttctactgctgtccaagtaacttcagcagagcgaacaaaagtcctagggcaatcagtctttctaaatgacatttattatgcttcggaaattgaagaaatctgcctagtagatgagaaccagttcaccttaaccattgcaaaccagggcacgccgctcaccttcatgcaccaggagtgtgaagccattgtccagtctatcattcatatccggacccgctgggaactgtcacagcccgactctatcccccaacacaccaagattcggccaaaagatgtccctgggacactgctcaatatcgcattacttaatttaggcagttctgacccgagtttacggtaggttttttaaaattctcttcagtttgatttggggtttgttgcttttaaaatgagaccatttaatgaattttaaaacagcctctaccttaatattgtaaattggaaggtatgcagtgttggttaaccactgtgacctcatcaagttgtggggtattcacatgaactgtggaattccaaacagggtgattcacactaaaccaatatatgtcctttctccatcatgtaaaacaacacgacatagcagatttttttttccaaagtatcctaaattaagtttttcttcctctaagtcctctaatttttttccattttcagaagtatatcactatttagtttaaaagtcaagtcagattattgctttacaaaagaaggcctaatgttcaataacttggtaacattattgcatactttccacctacatcactcttaacaaaattctcaaaataaatcttaagacaaataagtcatctgagcagagtgtaattggttccatttaggcttaataacttgaatatgcatgtggaaagagcatggctgtggagtgagtagatgtggtttgaacagatatgccactttctagctatgtactttgagcaagatactgaagttttcagatatctagtttccttatttgtgaaataaaggtaattgcctttcttatatacccacaaaagcttaaaaaatagtatgtgtagtagtatagtatagcaaactagcaaatagtttatacttagtaagtagtattttcttatcttttccctccctgccagcatctccttgcaccctttctcccttttctcccctctccttaccaagttaggataattctttgtctcaagtaccctgagactttgaagatttttcagatgtaaattcttaacttctgaaaattttccctgaggataacatagcccaggttttatagtgggccttttaggattccaaattctcctttacttaaagggaaaaagaagaaaatcaagatatgtttacttggatgggcttcagaaattgtacataagattttgtgtatgctttgcttcctttatctcataggtgtctgtgacacctgtcctgggttgaggaagtccaattctttataagtgttgaaatacacaggataaaagttttgtcaaaattgtataacttagaattcctgggaattagtaaaagatacaagctgagcactggcactgtagtcccagctactcgggaggctgaggcgggaggacagcttgagctcaggagttcaaggctgcagtgtgctataatcatgtctgtgaatagccaatgcacaccagcctggggaacatagtgagactctgactaaaagttttttaaaaaagaaaaaagatatgtaaacagaaataataacactaattttcacattttaggaaaatggagctataagcctgcctttaatttctaattcaaagatcttcattgaaaaatacaaccttttaacaattattagcctgggtaaacctgtattcttctctagtgacctaaagcaatctctgacagcttctgctttttgctgaagcatgtcatcccagagaaaaagcctttaggcagacttaaattccagtggctttttttccctatatggttgttgcatcaatatagtagcatgataaacattcagaggtaaggaaaacctgacagttactgaacaaactatttcctttactggacaggggagaaaattaaaatttttaaattgagtctgagtcttttaggctgtctcctaaattgcttaaatatattttcagacatttgtaagtgatgtttggtctcaatgaaacctggatattatagtttttttccatattggtggttatatatgatgtaatgaggtcatagagggaaaaatgggaggacttaattataagttaattttgtttttaaccttcagtttgtagggtaacttttaggacacccagaaagaagttcagcagatcctgattaaagattttcacattctaatttgatgaagggaagggccatctgatatctgtccctatgatccccattataactggatctagtgggaaagagaaccagaatttgagttttggctttgctaaaaatgtatggtgtgccttattctgacttaatttctattgatccacattaggaccataagtcctctcatattttatgtctcagtgagatgtattttaggaaagcctataccccgcccctctgtcataggagcctcacagtgctcttatggttatatcaagtgtgtccctttttataaaatccctaaatgattaaggggtattttggttttactgtagaattataacatcttatttctaactgatcataaaatttaaaaatagttgatcatactttgtaacagaatcacaaattgtatgttatgaaaaaattttggaactataaggaaaaatacgttttaaaacaacttcatttgtgttttctcctaggtcagctgcctataatcttctgtgtgccttaacttgtacctttaatttaaaaatcgagggccagttactagagacatcaggtttatgtatccctgccaacaacaccctctttattgtctctattagtaagacactggcagccaatgagccacacctcacgttagaatttttggaagagtgtatttctggatttagcaaatctagtaagtaatgataattttctttaatactaacaattattctaagagaattcaaagaaaaccctttcatttcagaattttccagtgaagactttcacttacatttttactttttttcctcttctgattttatatctgtggtatcctgtaactgaaggaactctgaaggaactttttggtaggccacattgagaaatccaccaaaattctgataataaaagcaaagcggcaagagtttggtactttacacacctctggaccacttacaaagtattttcttcactgttgcagtttaattagcttcagcatttctcttcatagcagaaaagtccacataagtatccatgttgcctccttaattttagagaactagtcattttctcttttctttaggttgactttgaacaatgaatttattgtaaatgtacagttcacggagagcacagtggcacataatacagggcccagagtcagttctgactttgttttaactaagtcttataaatttaatatccactctttatatttgtccatctttatatcctatagttttataaatgttgatcttctcccagcatatttcctgaccttttcttccctttcctttccctgtaatatataaaacttttttttctgcattcaaacacatttcttgacttttatatattagataattaaaagcttcagcaattcactaagactctttgtcaggtaagagatgtaggactataaccctaacaaaaaaatgtgtaggactgacaaaacaagaaaagtataaactttattcataaatattaatatgagagaagatttgagtgaatgtaaaggcatattgtgttcctgcatgaacagttcttcccagattattacaaatttaatgtaatttcatcaaaataaccatgggatttgaggattgagaatggagatagaacttaaatgattctaaattctacataaaagtgcaataatagctaagaaaatattgaaaggaaagagacttgagacttaatagtacagatgtctgaacactttatagcagtacaataattaaaacatacatgtgcaagaatcagccatcagatcagtttaagagaaacagattgataaagaagcatcacaaactgatgagggagagattaaatcatttaataaatgaggctgggaaatgacttaaattaggtcttcgtcttcaccgtacaccataagataccaagtatgttctgcctgtatttaagagttgagtagggctgtgtgtggtggctctcgcctgtaatcccagcactttgggaggttgaggcaagaggattgtggcaggaggattgcttgagccccagaggtcagggctatagtgagctatcatcgtaccactgcactccagcctggatgatagagtgagacccttctctattaaaaaaaaaaaaaaaaaaaaaaaaaaaaaaaaaaagttgtatataaaagcttggaaccattttaaaaagaagaggaacaagtgaatatttaattgctttctagatgagtaaggacatatgaagtaaaaaagtgataggatgaaacaaaggaaatagcgaacagatttgactacataaaacttcaaaacatagctactcaaaaataaacacaagtgaagataattaaaaactaggaaatacacttggagcaaatatgagaaatgattaatatccttaatcggccagacgcggtggctcacgcctgtaatcccagcactttgggaggctgaggtgggtggatcacaaggtaaggagttcgagaccagcctggccaatatggtgaaatcccctctctactaaaaatacaaaaattagccgggctcggtggtacatgcctgtagtcccagctactcaggaggctgaggcaggagaattgcttgaacccaggaggcagaggttgcagtgagccgagatcactccactgcactccagcctgggcaacagagggagactctgtctcaaaataaataaatgaatgaataaatgaatgaatgaatgaataaaatccttaatcatgaagggtgctgaccgattaataaaaagtggattaacagtaacatacagatcatggttttttttttttttttattatactctaagttttagggtacatgtgcacattgtgcaggttagttacatatgtatacatgtgccatgctggtgcgctgcacccactactgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatgttttttaaaaaagaatatttgtacaaaaaaagaaaaaagccaggcaccatggcacatgcctgtaatcccacctgctcaggaggatcgctaagcccaggagtttgagaccagcctggacaacatagtgaggcccccatctcaaaaagaatatttatattttaagaaattcactaataaaagccaattgaaagaatagtgagataatcagttatcagcttggcaaagattttttttttaagatccattcctggtggtctgtggaattgtgagtagaggcaatttttctagaaaggcatttggaagtggataacaagaccttaagactattcataccttttggcctcataattctgctttttagcatttatcctaaagaattaatgttaaaatgtttattatagcattatttttatgtagatttttaaattgaggtatatcttgtcatcagtaaagtgcaagatcttaagtcaacagcttgatgaacttctacatgcaaatacatcatgaaagtatctccagatctagacatagaacatttctagcatccagagggatattctcagtaccctcccttcaccaagagtaaacactattatgacctctattgcacagatttattttgcctactttagaacttcatatgacattatttataatagcaaaaaaatgaacaggccaaaagtcaaagaataaggaactgattaaattattggttctccatctgatggaataatatgaagccattgaaaaatggctttgttacagaatttcagtttggaagatgaaaaggttctagagatggatggtggtgatggctgcacaatgatttgaatgtactcagtgccactgaactgtgcccttcaaaatgggtaaagccacggaactgtacatttaaaaatagttaaaatggtaaattttgtgttgtgtatattttaccacaattttaaaaactctttgagactttaggtaaagtgtatagataaatttttgtacaatttttgtcttataaatgtgaagctttttcaagtaagtttaaaagaagtttgcagaatttgtaatgttgaataaataatctcagtataggccaggggtggtggctcacgcctgtaatcccagcactttgggaggccgaggcgggcagatcacgaggtcaggagattgagaccatcctggctaacacagtgaaaccccgtctctactcaaaatatgaaaaaaaatttgccgggcgtggtggtgggcgcctgtagtcccagctactcgggaggctgaggcaggagaatggtgtgaacctgtgaacccgggaggcggaacttgcagtgagccgagatcgctcctctgcactccagcctgggcgacagaggagactccatctcaaaaaaaaaaaaaatgaataatctcagtataatcactgaaaaaaatattcagagcctactgcatgtatagcataatccccgtttttgcgggggagtgggagtgggttatacctgtgtacacacacataaatgtacattaactctacataaatttgaaagcctgaggagagatgagatgatacaccaatgttaatacagttttcattttgtggtgatgctttccttttaccaaactttctatgattaccacatttccttttataatgagaataaaacaactttttaacaagaaaggactaaaatggaggaaaataagacaaaacttttcaaaaattggcttactggcttttaaaattactttcttcaaggactgttctttcttcgcctctacaaaaatatatttgccaagtgtcttttctccaggcctgattctaggtaatagtctttaccttttaccattttttccccgaattctttatgttaaataattgttgatgtgattttcattgaccatcacatgctaatagtgtatttttttccaggtattgaattgaaacacctttgtttggaatacatgactccatggctgtcaaatctagttcgtttttgcaagcataatgatgatgccaaacgacaaagagttactgctattcttgacaagctgataacaatgaccatcaatgaaaaacagatgtacccatctattcaagcaaaaatatggggaagccttgggcaggtattgagtttgctcaaatatttatctagtatctcctttgtgcacatatttatctggtgccacattgggcaaagcactgcgctagacactagggatagagttgtaaaaaacacagtttcctccttcagaaagcatgtagacactcacccagctcttcatctggttcaaaattgtaaatgtctagtgcatgtctcagagccagagaaaagctagttatttgcacagtctccttcaaggcataattatatatatatatatatatataattatgccttgaaggagactgtgcaaataactagattttatatatatattatatagaactgtagaaatctggtgacatttctagtgctttattctagttctctacattccaaaggtgtcagtagatgtttcttcttattgatgctatttgggacatctgctttcatttatagttctacataagaatgccaatattaaaataggatataatgtaaattttatttttatctgacaagaattaggcatatcatttcttcaaagtaatcatttaaggaaataatgccctcactcaaacactgctgctcctcctccaaataattagaaataaccttggagccagtgttgcagccctagaaaacatcctggtacttaatgtcatttcctatattttatttttttttgagactgagtctcgctctgtcacccaggctggagtgcagtggtacagtctcggctcattgcaacctctgcctcccaggctcaagtgacccttccacctcagcctcccaagtagctgggcctacaggtgcacaccaacacacctggctaatttttgtatttttttttttttttttttttagagatagggttttgccatgttgcccaggctggtcttgaactcctggcctcaagcaatccgcccgcctcagcctccccaagtgctgggattacaagcgtgagccactgcacccagctctgtattttcaaattactattttatattgatgctacattactgtcttagaaaagcatagagatactttgcaagtgactgaagatagtattgatagagatttaaaatttttgaataccaatctcttaatctctgaaggagtcaaatgaatatactcatcctttactggatattttataataaattgtatttactgacaggcctgtaaataaaatctagtatttttgaggcctcaggtaaaatagaattttcatattgattaggctgttccaatgaatattttttaattaaaaattaaattggtagagtgattaaaaacatgttattttccttcttcaactagattacagatctgcttgatgttgtactagacagtttcatcaaaaccagtgcaacaggtggcttgggatcaataaaagctgaggtgatggcagatactgctgtagctttggcttctggaaatgtgaaattggtttcaagcaaggtaatcacttttcttttgccttctgtactatagcatatctgttttatcatcaggaggttttttgttttgtaattacttttaaattaaactgaacttttttgtgctaaaactttgagtcccatgtttttttttttaaaaaaaaaaatcctgcttctttacaggttattggaaggatgtgcaaaataattgacaagacatgcttatctccaactcctactttagaacaacatcttatgtgggatgatattgctattttagcacgctacatgctgatgctgtccttcaacaattcccttgatgtggcagctcatcttccctacctcttccacgttgttactttcttagtagccacaggtccgctctcccttagagcttccacacatggactggtcattaatatcattcactctctgtgtacttgttcacagcttcattttagtggtaagttctaggaaaggaatttgtgtttaccagttcctttctccattttacttcacctgatcaatatagattatcttatttatgtttgtgctctaacaccaagttgctaatttaagcctccagtaatgacatgaaatattaccaaaaagaaaataaattacttccattccatatcaagctatagtaaagattttctatgcatacttgtcatgtagagttatcccataagcggaatactcagtgccagttgaccatgttcagttaccagcactaatttgtagataaatgaagcaaggagcattaatacaatgtatctagaggtttgatttagggaacatgattatgtaatttttatatggtattcaaattttctaaattcaaaatgaaacatggaactttagaaattaaaaagtaatattttctgtctttacttgttcctttattctcttacagaagagaccaagcaagttttgagactcagtctgacagagttctcattacccaaattttacttgctgtttggcattagcaaagtcaagtcagctgctgtcattgccttccgttccagttaccgggacaggtcattctctcctggctcctatgagagagagacttttgctttgacatccttggaaacagtcacagaagctttgttggagatcatggaggtatagaagccaaaatgataagaaactaagttaaaatctttttttaaaaatatgttaatactatatagaagaaatattggtttattgtgctattttgtacttaatgcttaaataaaaacacttgcatggactgtgttattggtaacaggtcacttaatgacatcataataaacattatttaaacagttctaaaaacatttatgtacaatatgtattcagagtatccccttttttaggcatgcatgagagatattccaacgtgcaagtggctggaccagtggacagaactagctcaaaggtatgtcctaaattaaatataagttgtaaaaatatgcatattgttgaaaatacagctattactgtatgatcaatgttataatttattatttagtatatataaacacaaaggtttttataagttctgtggatcttttaattgcagatttgcattccaatataatccatccctgcaaccaagagctcttgttgtctttgggtgtattagcaaacgagtgtctcatgggcagataaagcagataatccgtattcttagcaaggtacctgttccgccctcacttctcccaaatatttatggttctcaagttgtaaagcatatctttcatttttctaaaagacgtttaaatttgaggtcaatgaaatatcttatatgttacttattaagcctttaaaatgtattttgattatttattgtaattctttgaagaagtcttctctaaagaagctgtctttatatgtaaactctgattacttcattaaggaagatgtctttaaaataaaatatgttgcctcttttgctaagcaggtacacttagtattttaccagttttcaaagcatttaattatatggtaagactatagccttgcataaaattatttaatttgtaattactataataatgtctgactcttataatgtagaaatgtcaaaaaataagaaaacaaatgtacattaagctagctaccaagatcaccatagcatgagaaatcattctagcatttattaaataagtaaatgttcctgaattcattccgagattcagtttaggagttaatgttttatttcaatgaaagtaaaataaaaaattctgttttcctaaaaggcacttgagagttgcttaaaaggacctgacacttacaacagtcaagttctgatagaagctacagtaatagcactaaccaaattacagccacttcttaataaggtaattactgtatagaaaatgagtgcattcattttgggtatcagtgttgaatgttactttctttcaaagagtttagaaaataagatgaattgagaataagttataaagaaaaaactatagttaaagtagaacctcttaaagtttagttgtttgaagtagtcatattagaagaagagtaagtatggatagtatgttctcaagcgcttgtaagtttttggtctcatcagtgctaaaggaaagataggtatatattcttaattattttatcttataactattaattatctgctattgccaagtactgttttaggcgctagagatagagtactaacaaagcccataaaactcactgccttcatggagcttactttctggggtgggtgtggaggttggggagtgaatggataatgaagtaaacaaaatacgtagtatgttagtgattattactatggagaaattaaagctgggagaagtatacttgatcgtcataagagtttgggtgccaaatgaagattatatttaaaaggagtaaaatgaagtggccactgttttaggatggtctgaccttatcccatttttatatttaagatatctggaaatcatgtttttgtattaataaaatgaaaaagattcgataatggcatggtattaccatccagttctaaagtggtttaattctgtgatttgagtacaaaggtatgccagacttgggagaaataacagagaaataatacctgttatattcctggtttgtctacaagcattctaattttgtattatacaaaatggttctctggtccccatcttctaagtgaaaatgagctcagaagggctaaataacttgcccaaagtcacatacctaataaaagaaccatgattctaatgtgatactatttgactctaaagtccatgtattttccctaatatcacagtgctaagtaaagattgccagtaataaatacttttaattcagagcagcaagagattaccatactggttaagagtgacaagaagttgaaaagacagtttaaaataaagttaaagggaaacataggagttaatgtaggtagagagaaagggagagagctgcacaagaatgccaggacaatggagggaaggtgggtagaacattctagttgtaatggagaagcttttcaaaggaatcgagagagggaaagttgtgaggactggatagacctcatctcacattcagcattgttcaaaagagtttggaaatgtacagtttttaagcagacaagtcatacgatgaaagcaggacttagctcctggtggtagtgtgcacagtggattggagtagggagaaactgaagtaaaaagaatccacctttataataaagaaggttggcatgtggtaatgtcattagcaataagaaagaaatgacaaaagatacaaaagagactactctagaagaatcaacaaaccttggtgactggatttagaaatcaaagaacagggagaagtcaaaggaggtgctaagtaacgttctcagtccagctaacagtgtctttagttatacatatggaaaagtgaagagcttactcatatctttatcttccccaaaagagaaaacatgggtaatttaggaagataagctgctttatttttaactgcagtgtgttttgaaagagactatgtcatgattcatcttactagcctcaaacatatcttctttgccaggactcgcctctgcacaaagccctcttttgggtagctgtggctgtgctgcagcttgatgaggtcaacttgtattcagcaggtaccgcacttcttgaacaaaacctgcatactttagatagtctccgtatattcaatgacaaggtaagcaaactttgccttgaggttcctagattactcaaatttagtactcttccatcttttcttgttgctattcttttaaaatcacaagaagtccataacttaagtaggaatttgtataatgtaacttattgtgagtatatttccttaccagctcataaagaactatgtaaacttgaatgcatattttttacataaaaatagcaaaaaaaaaaaaacaaaaaaaaaacagtactggcctaatactagtagaattacagaataaggataaataatacatgatcatccttacagaatgagcataaacaatacatggtaataatattaatagctaccatgccaggccgtatgctaaacactatacatttatttttaattttcataaccttaaggtaaaggttagcattctctgccccccatttcacacgtgaagaaataatctaaaagtaatcttagttttacttaataatgccacttaatgaaaaatacgtataattcatagtagataaggaagttggagagtctaaaggaaacttttgggtacttaattttactagtttttttattctgtctaatcttactttaaaatataccattagtggccaggagtggtggctcatacctgtagtcccagcactttgggaggccaagacaggtggatcagttgagctcaggagttagagaacagcctgggcaacttgcaaaaccccatctctacaaaaaaggcaaaaattagctaggcatggtggcatgcacctacaatcccagctactcgggaggtgaggtaggaggattgcttgagcctgggaggcagaggttgcagtgagctgagatcacgccactgcactccagcttgggcaacagagcaagaccctgtctccaaaaaaaagtgtgtatacatatattacatacacacatatatatgtaatgtatgtgtatatatatatataaagtgtgtgtgtgtgtgtgtgtgtgtgtacacacataaaatatgtaaaatccaactccaattaaggttaataaatgttaggaggggtgctaatggggtgtgtgtgtgtgtgtgcacgtgtgcatgtgtgtgtgtatatatatatgaacatgggcaaattacttcttagttcctttctaatttgtaaaatggagatctaattggggttggattttagttcatagagaatagaggagagaataaaatagtatgaaattacgtcccttttgtctttggataaaaatgggaagggtctaggagaaaagaggggaatgtttttaaaagaatgtgtatatacagtgagatttgcttgaagtgaaattaactgaactgtgggtacaaagaacaggattatggttttaagtgtaaaaagatacttggtctaaacattattagttcagtctaccagatgtagtgtgaacctggaacagatatgggtctgaaaaatatagaagcaaaattttagaggtaagaggtcttatggagtttattaatcagacctccattttgcaaattagaaaggaactaagaagttaagtaacttgcccatgcttgtacatctgttttgggactagaacccctctgtcctaattctcattgccgtttttctaaaactgttttgggacagtggtggtcagcgatatctagttgttggctatttatatgttaagaatatttgcaaattggccgggtgcaatggcgcatgtttgtaattccagcactctgggaggccgagttgggaggatcacttgaggttaggagttcgagaccagcctggccaacatggtgacaccctgtctctactaaaaatacaaaaattagccagggtggcacatgtttgtaactccagcgacctgggaggctgaggtgggaagatctcttgaacccaggaggttgcagtgagccaaggtggtgccactgcactccagcctgggcgacagagtaagactccatctcaaaaaaagaatatttgcaaatggagcattgcaaatggggcatctgcctcggtattttcatcttcaaaacagcccagtagcgggagctaatattgattctagtgccctttggatgctaggcatcagagttaataagcatgttaaaagtcaccgggatgtaaattgacagtcatttattttgtattgtaaataaaagtgatttcatcttccaccatcttcttatttatatgcttgactgtcttgcaccagttaatttgtagtagctaaaatgttctgtggttttctgcagtcaactgaaaataatttctctcaaattgaaaggattacttatcttgtcatactattgaacacaaaattaagtgagcctttaaagaaagctactgtgtgaacctcatcaaccatctcatgattatctttaatagagtccagaggaagtatttatggcaatccggaatcctctggagtggcactgcaagcaaatggatcattttgttggactcaatttcaactctaactttaactttgcattggttggacaccttttaaaaggtaaaaaagccttatttagaatatttttatgaagtactattaagaaaccagaagtaatttgaataagtgattacttgaaataaattgaagtaagttagcccttatgtcttactttaaatgcaaactaggccaggcgtggtggctcacgtctgtaataccaacattttgggaggctgaggcaggaggatcacttgaggctaggagtttgaggccagcctgggcaacatagtgagacttcatctctacagaaaatttaaaaattagccaggcatggtggcacgtgcttgtagtcccagctacttaggaggcatagatggaaggattgcttgagcctgggaagtcgaggctacagtgagccgtgatcacaccactgcactcagccctaggtaacagagtgagactttgtctcaaaaaataaataaataaatgcaaactatatctgtcttaatgagttgtgttttattcaatatgtgttttaagagagcttcatttccaattcaaatatcaaatttgcctgaaaaacaaaagagtttattctggctgggtatggtggctcacacctgtagtcccagcactctgggaggccaaagcagaaggatctcttgagcttaggagttcgagaccagcctgggcaatatggtgaaaccccctttctacaaaaaataaaaacattagccaggtgcggtggcacatgcctatagtgccagctacttgggatgctgaggaaggagaatcacttgagcccaggaggtcaaggctgcagtgggccatgatcgtgccactgcactccagcctgggtgacagagtgagaccctgcctttaaaaaaaaaaaaaaaaaagtgttgattcttacaaaaacctacatactgagtctgataatagctatattaatagtaacaatacctaagtatcttactgattttcaaaatgaaacagactgcaaatcactaagtgttatttgaataatttatattagaaaatgttaagagatttgatcacagattttcttcaacttgtttatagtttattgttgattaatactattattttataccattgtacatcacctttctggcaccctattctcacccctttctatattgcttatagccagtgatctccagctattcctcagagcccgctcattcacttcctaacctggttttactccccgttgctgacttcacagcttgttaactttggttcattaacatggggcagtcatggccagagactgcagttaataagaacagcatgtagtggtgggtcagaagcaaagcaggataaagtaagacctgggataaggagctggcatgaaccccagtggtctcagaagtggatttggccacaatagagattcaagctatagcttgagtcaacaattttgtattaatttaaatcataggcttgagggaccatggagattctcccagtttttatgagagagagagagatatgcatacacccactattgtgaatgtatgcatttgatttcactttcttatgaaatttctacaaaaaatattgacagtgttaatctctaaggtcaatggggatttctcaaaaaatactaccttactaaaggataccaagataagtaattgtaactgggctaataaagtgcttaattattctttatatctaaaagaataccaggctgggtgcagcggctcatgcctgtaatcccaacactttgggaggctgaggcaggtggattgcttgaggccaagagttcaagaccagcctggccaacatggtgaaacccctgcttgaaggcaggagttcaagaccagcctggccaacacggtgaaaccccatctctactaaaaatacaaaaattaggcaggtgaggtggtgcaaacctgtagtttcagccactcaggaggctgaggcacaagaatcgcttgaacctgggaggcagaggttgcagtgagccaagatcctaccactgcactccagcctttgtgacagagtgacactctgtcttaaaagacaagaaaagaaaagaagaccagatactttccatgttcaaatcacctatttttaaatgggggaaggattaatgattaaaagctggccaaagatcaaatttatcctctaatcaaccctatttattgggctcttagagcatatacttcctatgtcatcagcttttcttttaattaaaaatgtttttgtattccgcctgcgactcggtcccggcgctgggctgaggggaggggttgtcttaaaagtctctccttccccctgtaggggcggccggcgagtcccagtgagagcggagggtgccagaggtagggggccgagaaacaaagttcccggggctccctccggggccgcggtcggggctgcgcgtttgaccgcccccctcctcgcgaaggcaatggcttccaaactcctgcgcgcggtcatcctcgggccgcccggctcgggcaagggcaccgtgtgccagaggatcgcccagaactttggtctccagcatctctccagcggccacttcttgcgggagaacatcaaggccagcaccgaagttggtgagatggcaaagcagtatatagagaaaagtcttttggttccagaccatgtgatcacacgcctaatgatgtccgagttggagaataggcgtggccagcactggctccttgatggttttcctaggacattaggacaagccgaagccctggacaaaatctgtgaagtggatctagtgatcagtttgaatattccatttgaaacacttaaagatcgtctcagccgccgttggattcaccctcctagcggaagggtatataacctggacttcaatccacctcatgtacatggtattgatgacgtcactggtgaaccattagtccagcaggaggatgataaacccgaagcagttgctgccaggctaagacagtacaaagacgtggcaaagccagtcattgaattatacaagagccgaggagtgctccaccaattttccggaacggagacgaacaaaatctggccctacgtttacacacttttctcaaacaagatcacacctattcagtccaaagaagcatattgaccctgcccaatggaagaaccaggaagatgtggtcattcattcagtagtgtgtgtagtattggtgctgtgtccaaattagaagctagctgaggtagcttgcagcatcttttctagttgaaatggtgaactgataggaaaacaaatgagtagaaagagttcatgaagaggccctcctctgcctttcaaaagggtggtcacctacacatgtttaaggtgtctctgcacatgtctcaagcccatcacaagaaagcaagtacagtgtggatttcaaatggtgtgtaacttcagctccagctggtttttgacagctgttgctgtggtaatattttttacatgtgatggtgatagtctctggttctccccatccccacaaaggctgttgaaccacagcaccaggaagcctgagaatgaatcctgagggctctagcccaggctttgtcccaggctttctggtgtgtgccctcctggtaacagtgaaattgaagctacttactcatagtggttgtttctctagtcttgagtgactgtgtccacagttcatttttttccggtaggaataactccttttctacatccacactccatagagtctctccttttcagacatcctgggatgaaagaatttggcttttttttttttttttttttttacatctgttttcactcttaggcttttaaacaatagttattgctcttatccctctcagattctaataactgagagcgatggggctatattgaatctctgtatgcactgataactgagctatgaagaggatcttattaaactgctggtctgactctatggattgacactgttcctttcttttattgtgaaaaaaaaaacccctgaaagtcttgggaaccccctaaagtcttttgggaatcctcaaaaagcatgggaagttaagtatttagctacataaatgttgtaagatcatatcttatgtatagaagtaataagaccatttggaattactggactaattgaatagttaaggtttctattcgggacaataaaatgtattttgaaagtgctgctaactattgatgctgacagtgtttcactcctatgagtgacccaaacatattataaatatgtggtaaagggaatggagcctgtggggttgagcagaatgttgtactagctgtgcctggactgagtataacagctttatgattatgagaaaacaaattctttatttttttttctgttccaaagattcatcctatggggtggccataaagtctagaattagatactaatattttgtcattcattataacatatcgataaaccatttgttaaaagatttgcctggtttccagacttggtggccaccttgaataattcttgctgtcttctgggaaggatgatgaaatttattcctgctgccttaaaaatatgtatcccttcttcacccatcatgactgtccccagtgagtgtcctttactattcttgggagtgactcctgtctaacttttcatactggcgagaagaaaagaagcctattttaacactttagtggtgttgaaacacattacttactttctgaagatgtcccagtgaatcctctgtcaattcactgccatatgtaatctatatgataaggaatgcatcttccttctaagtactgcccaaactcttgccagctcctctcccattgtcccttcatgtgaatatttcttggctaccttagtggaaatatagatcagtcttctccccatccatcctctcaaacataatgagattgtttactttttagatttatgcagtgaaaatgcccagtcaggtctgaatcgtcagtgcattatattgactctgagcactttagaatttagagttgcaattgaatgccagctgtggagatggggtgcatatcagatatataaataaagctcaggtttgctagggaaccaggtatagagaaaaataagtctgatatgaggaaggaaaattgcacaatttagagtagttatgccatagagaaaatttccacaaactaggaaatgtagagagttattctatagaatactcaaaagaggaaagtatgtgatttttggaaacaggaaaatcttcaaacttctttcttcacttccctttgtgtttagctgaccctccaatgtgatcattgcctttggagtttgggagaggtacgggaagtggcctgatccctgcttccatacttcactcctccatccatccttccctccctcttcccctccagctaaatggacaattctagccaacattgagtcactcaataagtctcaacagtgggtgtgtttgctgagattgtccagcagttgagcagtttggtctcacctccctcgctagttgagaccaaaaagagacaaataactttttcatggtctttgaaacataatgcttatttcgtggtcaatggctttaaaaaaatctgtttcttgttttcttcaacaaactcactagttttcccttaactgatattgtaaaaattaaagtaatcttgaaaatgttttgacaaaagtaaaattaaagggacatcttttcttaaaaaaaaaaatgtttttgtaaaagaaccctattttcaaatgaaatcttaaggagaattataatacatagatttttttttttaatctctgtgctgctttagggaatagaagatctgaaagactatcatgttttttaattttcctcttcctggagtactgtagagttctagggaatattatattctacacatttttggtacttaatcttatacataattaattattctcattcacatatgcatgttttaccttcccaaatggctattcttggaaagtaggagttatatttcctttccttgcagagttgttagtcagggaagaagacctcagcagatgcttgttcaaaaaattaattcttacttgtttgtttgtttgtttgtttgttttttgtagggtacaggcatccttcacctgctattgttgcaagaacagtcagaattttacatacactactaactctggttaacaaacacagaaattgtgacaaatttgaagtgaatacacagagcgtggcctacttagcaggtaaaaacacaaaataaacaaaattaatcttgctacatctatatataaggatcacccaaaaagtacaaatacctataggttttttggcggttgcgtggcagagcagaaagttcacagtctagtcctttagtggtggttacaattttgagagttttgccagaacatttttctgtaggaaaaaatttaattcccattaaaatctgaaatgtgttcccttggtcatctttggttcaagacactacagtggctctctgttatctgtcataaaatctgaatgcttcagtctagcaccctgggtccttaaatagccctctcagttctgttatctttctctaaatttcatgagcctcattttttattaccactccaaatggatgagctattttaagctaatctacttgccatctcctacaagcaactgcctcttcaatattcattccttatgtcattttatctggagtatctgccctatccccaccattccattaaagcttcctatttgctcttatctgatttttgtttctctactcagcaacacttagcacttatgtacaatacaattcttgaacatagttgtttgatagaaagtgctgattctcagtttcacagacttgtatttgttcaacttttttgtttgaaccgtatcatcttgagcaaatcatttaacatctcagtattttttctcattcagcttaataatacctgccctgcctactttgtgtttgttaaagatcaaatgtatattaaagaacttggaaaataaaagatgcttattaaatctctctgtatatttcacatttatgtagtcttccaaaatatgtgcacatttaacaggtactatgctctttaggagactgtaagaagttcatcctgttttaagtcacacttgtgatttgttaaattttttaacctgccaccgttttccttttagctttacttacagtgtctgaagaagttcgaagtcgctgcagcctaaaacatagaaagtcacttcttcttactgatatttcaatggaaaatgttcctatggatacatatcccattcatcatggtgacccttcctataggtaagtggatttactctcctataattacataatcataatcaagtttcaattttccaactaatggaggcaagcagcagagtaatctagaaggtaacatgggagaaatctagagatggcctaggaagagtaagtgaaactcattttataaatgtgtggtattttatgtgggttagtaggaaagttattcttccagtctgattgtgctaatgttaacattagtttgcctctgaagcacagaccaaatgaacaatgaaaagagatgctcttgaaaatattaggttgcaggggaagggcctggggaaaaaaactaacgcgaaatataaacaacacattacgtgcttggatagagaacgaatctatacagatttgtaaaaatacaggcatgctaacacatttgttgtatttactcatatcacacaagttatttaaaagttttctataatgtagacatagatggtaaaaattatatctgctatacatgggtttgggtagtatatttttcagtataatttagagaaatttcatgaaaatggcatcattgggggatttttctgtattttcaattaaataaaaatatctttaaggtttagggacagtgttgaacacagaaaagttatcttctgttcgcaaaactcgtatcattccatttatcaacatcctgctttttgataaaaagacttcaacaatttccttaagattctaacaatgtacgcaaaaatttttcaaacatggtattcaatagtcttactttcgtcagtcccattattatattactttgagatatgccctttttgttatagaaagggtaaaatagtttgcctgtgttcccctgtcaaagtataaattaatatctgattttcttggtttttaaacaattgcctatttagacttaattttttctgatttaaaaaaaatcagtgcaataagttcaaggtcttttatcaacataactacagttaatgtattttatacttgaaaatagctacgagtagattttaagtattctcaccacaaaagataaatatatgaggtaacacatatgttaatttgcttgatttagccattctacaatgtaaacattttatttatttttatttttctttattaattttttttgagacagagtcttgctctgtcgcccaggctggagtgcagtaacacaatctcggctcactacaacctccgcctcctgggttcaagcgattctcctgcctcatcctcccgagtagctgggattacaggcgcgtgccaccatgcccagctaatttttgtatttttgtagagatggggtttcaccatgttgggcaagctggtcttgaactcctgacctcaggtgatccgcctgcctcggcctcccaaagtgttgggattacaggcgtgagccacagcgcccagccaatgtaaacatattttaaaacatcatgttgtacaccaagcttgctcaacccatggcctgcaggccgcacgcagcccaggatggctttgaatgcagcccaacacaaatttgtaaactttcttaaaacattaagtgattttttggggtttttttttttttttaagctcatcaactgtagttagtgttagtgtattttatatgtggcccagtatattcttctaattccagtgtggcccaggaaagctaagagattggacacccctgttgctatacctttttatttgtcagcttttaaaaattgcagtacagatctttttgttcagcatttggtgagtacctactatgtgcaagatactatggcaagaaagttgataattcctagggatacaccaagagtttgtatcctaaagccctttaaagtgcaattttaaaattaattgattgctgttgttaggaaataggacagccacttggaaggagcaaacgatggttgtatttgtcaccatattaattgatttttctctattgttttcatctttcaggacactaaaggagactcagccatggtcctctcccaaaggttctgaaggataccttgcagccacctatccaactgtcggccagaccagtccccgagccaggaaatccatgagcctggacatggggcaaccttctcaggccaacactaagaagttgcttggttagtttatctaaattatgtagattttttttattatttaaaaaaatagatatttttactcttggaaaattatttgaaatttcaggattatcaaaattttccatgtcagtgtagcaaagtttttgatgccatttaaaagagagtttgatagatcagttaagcattataagttgagatagagaaatgagaatgggaccttgaaacagttttttctgaatcttatactaaatattgtgactctccttattttgttttgcctttgctggccagcagggaatgggactctgagacatattagataaatacctataagaaaggaagagtcttgctgcactcaggggatttaatgatatactgtaatacttcccaaaattatcatctgagagaatatatgaatatggtatgaagctgtaatagtactatttgccgtgctttctttgaaaagacaaaaagacatgcttctcaattaccgaaagaaaataggattcttttttttcttttttcttttcttgatatgaagtcttgttctgttcacccaggctggagtgcagtggcgcaatctcagctcactgcaacctctgcctcccgggctcaagcaattctcctgcctcatcctccctagtagctgggtttacaggcacacgtcaccacatctggctaacttttgtatttttagtagagacagagtttcaccatgttggccaggctagtcttgaactcctgacctcaggtgatacaccctcctcggcctcccaaagtgctgagattacaggcatgagccaccatgcccggccggaagataggattcttgaaattaagattgctcagttacatcaacatttatagaatttttgtctctgagaagtacacctgaaatgctgcgagactcatttccattttagtaactgaaagtaaatgaatgaaaaaacccactaggccaggtgcagtggctcacgcccataatcccagcactttgagggactcaggtgggaggattgctcgagtccaggagttcaagaccagcctgggcaacatgacaaaacccatctctacaaaaaatacaaaacttagctgggcatggtgacgagcacctctagtcccagctacttgggaagatcacttgagcccaggaggtgggggtagcagtaagccaagattgcaccactgcactccagcctgggtgacagagtgggaccccgactccaaacaaacaaacaaacaaaaacactgatcttacatcgctcctcagaggaaatgcagagatgttcttgcattccattgggtaaaattgtaattgttactggaatacattaggatctgtatttcagtagccagcactgaatggttcaacagatttcagttatccatgcaaacatatttaagtatctttaggtattggaaaaatgtttgtgttcataaggaaattagtgaacaaacaacaaattgtaacataaataacgtgccagtaaaccgtgaaagaaatagaaaccatgaatgtgtcaatcacagttactagccacataggtgtgttactgttgtttgagttcccttctgttagtaccttgccataaataatcatttaggagtttcctggttactttgtgttttgtaattctggattttcatgccaatgaagttgtaaatgaaaaactaacctcagaaaaaaatatattgaattcattcaacccatgtactaagtgaaaaagataaggtaactgccctggaagactttgtaatttgtgtccaagacttataatcagccaatcacaacagcaactccaggtgccattaaaatgatatgtcttgatggagaaagctggagatctggggaaattagaagaaaaaaaactgcagagaggagataacatttgggctgtgtcataaagatttaatatatgcttgcaaaatagcaggataagtaggggcatatgtttaagagcagtggggaatagcaagaataaagaaaaggcaggaaagcaactgatgatacatcatggcatcatggggaatggggtaggaaatgagatgagaagaaggactagaactcgattggaaacgactgtatgccatggtaagatatttacccttatcacacattcagctgaggtatttaagtaggagaagaacatgaccaaattttaatttttgccaagtttttctagcagcaatgtggagagacaggaagagatttttagcaagggaaccatttaataaaattgatatagcagtccaagcaaaaaaaatggtgtgggccccgcactaatgcaggagcaatgggagaatggagaagaaccagcaggtttggagctgggcataatggtacacacctctagtcccaggaactcaggaggccaaggcaggaggattgtttgaggctgacctgggcagcatagtcagaccctgtctcaaaaaaaacaaaaatcaggtttggaataggtttctgaagtacaatggacatgacttagtgaccaattgttgcaggtggggaaggggagaagactgtgaaggatgtcagaagcttttagttttaaaaactgtctagatagtgataccattcatagagatcaggactaatacgttcacagtacatgataaatttaggttgattacatttgatatattttcaagacatctatgagtatatatctaagagataaaccacaagatgtacctggaattcgggaagaaagtaaacaagtaaacatttagaattgattagctcacagatagttgaagctatggaagcagaatgagatcttccaggaagaatgcagagaataaaataaaaaggacaagtgagaaaggaaggaaaactaaatgtagaaagtagtgtcccaatctcatgtactttggaaagcactgactggttttagaaaacctgagttttccatctggtcattgtctagatccctagccatgctacctcagactaattacttaactgctcatggcttcatcagtgtacatgtgcatgaaacgaagaagccggactagatccctttggactgttaaattatttggccttggtatttatgactattatgaatagttattcatattcttgaggtaatagactttgtatttctcaagtgttaaattgtcagattttattatattggctttaattctggctttaataaaataatactgttggccgggcatggtggctcatgcctgtaatcccagcactctggggagaccaaggcaggtggattgcttgagcccaggagttcgagaccagcctgggcaacatggagaaaccctgtctctactaaaaatagaaaaatcagctgggtgtggtagtgtgtgcctgtagtcccagctactggggaggctgatgtgggaggatcacctgagcccaggatgtggaggttgcagtgagctgaaatcatatcactgcactccagcctgggccacagagcgagaccctatcaaaagaaaaaaatagtgttaatacatgattacatgattagagaaactaaaagccaaatgggagataatgctacttgctatttttgaagcatctcccagtgtatctggtttttagtattttcaggcatgcatatctttttttcaaagcttaaaaaattaaaatcaaactctgctttcttcctaagcttggaaattactcatgtattaatgagtagttcttggcaccagcagcgtttcttaaactgaaaagactggtcagacatagttgacctttgctactgaataatgcctaccattgcatttattatcagttatcatatttgttgatttacctccagtgtagtttggtttacctccagtgtacagaatacaatctcagtttaatttgcaccagtaaggtgcaacctatcctgaaacagaaagctatgggaacaaaaccctttgagaagatggaaaataaaggaaagaaactgctccagggatgtattagagctttctttgagtcctcagtgaaagcttaaacactttatgtccaaacattttctttttagtgtattcccatttatagacactgtagttaatgaacttgcatattcttaacttttgtttataggaacaaggaaaagttttgatcacttgatatcagacacaaaggctcctaaaaggcaagaaatggaatcagggatcacaacaccccccaaaatgaggagagtagcagaaactgattatgaaatgggtgagaaacaaagtattgatctagatcattgaaaataaggtgggagagtacatgaaagtcatgtttattttccagccatttcttagaatctttagagtgaaatatagaaacgtttgccatttctcaaaagataaactctaccattcaagacagttatcttgaagcttgtgtaaaaattaatcatatatattatatacagcattgtaaataggtagccaaaacttttgtgtaggcgaatagtaattctctatgatgtttatgttagtattttaagtatctactaaagaaagctgttgaattttagaagtaacattgaaatagttaggtgaagtgattatccaggtgtttgatcacgttaattccctatcttgctgcagaaactcagaggatttcctcatcacaacagcacccacatttacgtaaagtttcagtgtctgaatcaaatgttctcttggatgaagaagtacttactgatccgaagatccaggcgctgcttcttactgttctagtaaggatttcccctttttgagtcccccaccctcaaatttttattccagtctacttttaggaggcccttaaatattaaaaacatgaataggatacagtcttctacttctcacccaaacagataacaattcagccacaaagtaaaaatgttgtgtgtttacttttttgcatcttggcaggctacactggtaaaatataccacagatgagtttgatcaacgaattctttatgaatacttagcagaggccagtgttgtgtttcccaaagtctttcctgttgtgtaagtatctccttttgattttaattcaccttcgtgcctgtctttaagttaaatgcttacccagtaatgtgcactggttgcaaagagggcaaaatgagatattgtgatagtgattttagctttgagacagtaggtttaatgagggttaagattagttttgacctactagatctattagaaagtttataaggaaagacttttaaaaaatctggttgatttatttaagtggtttattttgatgatcattgctcattttcctcacttagaagcaaactattagactgctatatctaaatcagcatatctgttttggtttactttttagtagagcttttgtatttatccacagctgagtgaaaacaaaattgaccttctgtttaggaggtgaattgtttactctctcttaaggactaaaaaatattaacctcaaagtgttcaaatttaaatagttcaaataaattcttttcctgatctaggccttctatatcatgtcattattttctttttttaatctcatgttagaattttagagagttagaactcagttatttttattaatggagtgtagccgggttagaaataatttttttcctaagtttcagttggatcatgtatttcactccctctaaactattttgctttccctatttgatctgactcagcattttaaaagcactgattaacattaaatttaatttttttctttttgttttgcacagatcctaaatttagttttaacttcctaagcgcatgtcagtatacaacagatggaaatagtactaaaacatgctaagtagcagacagagccaaccttgtcttaagcaaacatttaccgtatatggttacacatggttatatgacactaccagttgtttgttttcacaatttcttccctggtgactaaaaacaaaagacaaacaaaaacagacacacacacatgttcattgtagaaaatttggaaaatgaagaaatgccccagaaagtaaaaagcactcatctccctttaattttggcacattattctggggaatgtatattatgttttccactacatattttcatttaattttcctctaaaatgttcctctgttgactttttttttcttttaggcataatttgttggactctaagatcaacaccctgttatcattgtgccaagatccaaatttgttaaatccaatccatggaattgtgcagagtgtggtgtaccatgaagaatccccaccacaataccaaacatcttacctgcaaagtaaataaatgtatctggagaaggatggttgatgaacttgctaacatgcgcgctgttgtagaatgcactgactacagaattctttataagggatagacttgttcatacttttatttccatattccatttttttactctctcaactgtatgtccaatgtaactggttgacaactttttatgctgagtatattttaagtaggttttagttgctttgacactcattctaaaaacatgttttcaacatgtacatagggtttatatatcatcagctatatgacttatttaatttctgttacaattaaaagataccttgcttgttataagagtaaaatttgatttgttgcaggttttggttttaatggcttgtggcggtttgcaggaccgttttcaaaggtaagaaaatatatttttctctaacttttggcaaaatgaaggtttctgttcaaattagtatgcctgctttaagaacacacaatgtgctgaaaaccagaaaaataattcacaataaacacatatgttacttttataaaaagtttctcatcacaaggtttttttccaggaggcagcatggtgttggggtgtgtgtattcacttttacaaacaaagtcaacttatgatcaatttttcagaagagtatgataaacctctgtgatacttttctgccacagtcccttgtgtatttgataatcttaatgcacacagttagatatcttatgactagcaaggagcattaccatggttaaaatctatttcatgaaaacatttttatttccagcctattagattagattaatttctctctggatttgtcctcatttgctcttattcagtttttttgtttgtttgtttgttttgtgagacggagtctcactctgtctccaggctggagtgcagtggcgcaatcttggctcactgcaacctctgcctcccaggttcaagcgattctcctgcctcagtctcccgagtagctgagactacaggcatgcagcaccacgcccagctaatttttgtatttttagtagaaacagggtttcaccatgttggccaggatggtcttgatctcttgacctcgtgatctgcccacctcggcctcccaaagtgctgggattacaggcatgagccaccgcacctggcctcagtttgttttttgattggcattagtttatgtagtgctacataagatgtatatgatcattttctctgtatgtgggctctctccaaattgatcaaagttccttgaagacagggtttctgtttcttccttaaacagttcctggtgcagtgttttagatacagggggtgctaaatcaatatgaattgtataaaccttgttccagtttttaagaattgggtattttatttatttcctttcactattacttgaatatctgtcaacatgcaaaggttgtcacttaaaaaatgggcctgaagttacagaaataagtatatcatacagaagtttttgcatttggattgccagtaaccctctgagccctttacagtgtctagtgagtggaatctaaatggcagctggaatgatgatgctctgctcattttctctgttttggaaaattggctagacatcattcctggtgattgtattgtctcagtattacattcagtctgtcttgtgcatggctttcagaaaatgcaggttcatctggaagctttaagctgaatagaactccctgttgtaagtcctatggtagtctataaatattactccactccccttttttaatgataagtaatacaaaggaagaaaaatagtaaattaagtccaaacaaaattaatatttttggcttcagatggggatttacttaaaaaaaaggaactaaaataatttcctattttccattacagcaaacacaaattccagactatgctgagcttattgttaagtttcttgatgccttgattgacacgtacctgcctggaattgatgaagaaaccagtgaagaatccctcctgactcccacatctccttaccctcctgcactgcagagccagcttagtatcactgccaaccttaacctttctaattccatgacctcacttgcaacttcccagcattccccaggtcagtaaatgtgatctttatatgactttgagcaacaatataagacaccaacattaggaattcccttgtgatcagtttatagcaaattttgctcctttttcttatgagattcaccttacatttcttctttaccttgtaactgacttgacttttgttattctatgaagctttctactttcaaacaagttgtacataagacagtaaaatgttaaaatgtccacatgatattccaaggttgacaagtttgtagagtttgggcaggaagaggaacttaaaacacattattctgtaagtgaacagaactataatttatttactagatatactaacattgccctaagggcctctttctctgtctctgatacagcatactatatcaaaaaaaaaaaaaaaaaaaaaaaaaaagaagaagaagaagaaacacaaaatctattaggtacctcactttcctgctgccagcaataactcaaccatccatagaccatcctgaaaatctggaagtaaataaataatcaaacaaaaaattcatctcaagaaaataacatcttaaagcccataagcatatatataccaattcgtaatgcaacttagatttgaatacactgagaaatactaatagctaatagctccagtgggactgagataaacaaggtgggagaaatggcaaacctacagaactctggacttattcagtgtcatagtgaatggtttcatacaactctggttgaccctggaggtgctattcattatagaacttaaactattgtgtgtgttattatgacagtgagtaatgaaggaaagcttttgttatggttgtgttttctatttagaaagatattcttctaaaatggttaaaaataaaagaaactttagttgtttaacgttccattatctgaaaagttcacttatgaaacacatcattgtataaggaaaagttactatatatagttcttttaagtgttagcataaatttaaaaaaaatccaatgacataactattctgtgatattcaagatcaataaatagaattcccagtttatgatctcagttttgcatgaacatttcaacttatgtaattttgaaggttctgaagaatttggcaatacccaattcatattataaactattatgtaattaactatattctattaaattctgcttaacaacaaagctttggtcagcagaggaaacaaattttatttccacatttgtcagtcgccttacaagtaatccttttttcccccagaagtaagagaagtctaactttttttcccatgtaacaaggtttgtttgccctctgccactaactctctagtacagtgtttctccacgtgtgatcccagaccagcagcatcatttgggagcttgttagaaatgcagatgctgtagtttcacctcagatctgcacaaaaaactcccaagtagagcccagccagcagtcagtgtgttaataaataccccaggcgattcttacacacactagaattggagaagcactgccctggggtctgcttctggtcttgcccattatcagcatttcagctgtgaaggccagggcaaaacttaaaatttactttttttacagatactgcagccactgaattccttcctgcttccccgctgataaaccttttagcattttggagctagggaaccatacaggtaatttagttttaggctcacaatattgtgtacattggggagactgagttttagaagagctgggttaactgctttatacagttcttatctagaaccaaggccaggcccttttgtactacattcattgccttccatggctgttgtctgtttgattatctatctactttcccttctccttctttatttccttgtttttgtttgtttattgctaattcattacttctgtctgccttgccttaagcccaccagttcttttttttctgttggactattttctgggttactgaacagaagttgaaaagtttttaaaagtctgcttcatcttaaccaagcttttgccttttgggctactaaactggtgttaaacatgtcaaaaatggttagtttttttattgactttttttacccagtctaattgtagggaaatttctgcctatctttgcccactaatggagacaataaaataatctggatgagaataaagaaccattacaggtttctctgctatttgattagttgcatatgtccagtgttgattggctatttgccaaatcatttgctttggtgaaacagtcttactctacaaccttttacttaaaattgtttattaaaatcagaataggttttatggctttggttccagtttcaaactaatggtgtcacctccattagctctccaaagttggtgcctttattcaggctggaaatctctgactatacacagaagagatgaggaggtttaaaagtaatagagttaagtggtattgtggtgttcaactcttcctgtcactcaattgtgtgtcattggtttgacagtttattttactacatgttttcagagaaagggtttatcttttcaaaagtaaccttactctcccacaaaacccatttgtatctctaaattacaggctcatgttcacaaaaggatcccaatttatatgcccaatcactgagtttttgtcatttgctcttacagaataactcttaatggtaagagttgatcttttgtttataattaggtatattgcttcatatctttagctccatgtaatcttatatccttatctctctctttttttttttttttttttgagacagagtctcgctctgtcgccgaggctggagtcagtggtgcgatctcgactcactgcaacctctgcctcccaggttcatgccattcttctgcctcagcctcccgagtagctgggactacaggcgcccaccaccacacctggctaattttttgtatttttagtagagatggggttttatggtgttagccaggatgatctcgatctcctgacctcgtgatccacccacttcagcctcccaaagtgctgggattacaggcgtgagccactgcgcccagcattttttttttttttccccctttggagacagtgtctcgctcagtagcccaggctggagtgcagtggcgcagtcttggctcactgcaacctctgcctccttggttcaagctattcccctgcctcagcctccctagtagctggaattacaagtgcacaccaccacgcctggctaattattgtatttttagtagaaacccggtttccccatgttgaccaggctggtctcgaactcctgaccttaggtgatccacccatctcagcctcccaaagtgctgggattacaggcttgagccacggcgctcagccatctcatttctttatggcgttgagtttgcttatatcaaaaaaccaaaagaaagttgtccagattcctaactcagtctggcgtttcaactttgctgtttagctgtatagaaaccaaaacatttccttatctccattcccagcagccaagtctcaagcagtagtattgaaagaagttctctgtcattccccgatatggagcataagtttgatttaccatcaaattacccaacatcaacctatacttagtcaactgagatttaaacagataaaggttccattgccctatttcaaaaagcaaatgttgctgatctgcacgcattcaatcctttgctataaatgtttcatgtcaatgcaaaactcttcattctagatctttgatgtttagcaggatcagctactgagctgtattttcttttgtccaacattttctactagcaaatcaacaaaataagagattcatgaacctctcctcctccccctcctgccccagcattaggtcttacttaaattaaacatttgggcagtatttcgttagttaccagctttgaggagaagtggtagtcacttacataaagcaattgtctctgaaaatgcattcttcttgacaaattagcatagcctaattctccatcctaagggggactgttttacaagtctacatataaaagtacctaaatggttgtcttctgaatccctccctagtagaaattgaatttggcatcagtggagccagtgactgtacctgggattcagtgcatatagaattgcattgactgtgaccctttaggcaaatggatgtaagactttggctcttaggattttcccaaacaccaataagagcatcttgaagagaatccatttactttatgatatataaggatatttcaggtttgatattatgatccttattaggtccagtctagctgagctggacatgaattgaagaaccagaattagaactagaaaatgaaacccaggctgagtgcggtggctcacgcctgtaatcctaacacttttgggaggccgaggcaggtggattgcttgagaccagcctgggcaacatgacgaaatcccatctctacaaaaatagaaaaattagccaggcgtagtggcatgcatttgtagtcccagctacttgggaggctggggtgggagaatcacctgagccggagaggtcaaggctgtggtgagctgtgatcatgccactgcactccagtcagggattgagaacctatctcaaaaaaaaaaaaaaaaaaagaaggaaagaaagaaaatgaattaataggatccatttccaaagcattaaaatttaatatatactttatcagggtcttctgatattcttcagaggagaattgttgtaagttaattcaataaacatttgaatacctgttttgtaggtgtatgttaagtatgtattagaatccttgatcaccagagacttgacggtttttgccttgaaagttatttccttccgatccatgttgtttaacaaattctaagtgtgcactattttttttattttaaatacaagattaatactatagtgcactgtagaaaataccaaaattccagatatttatcctacatatatgtattgtttactatatgcaaggggctcttagaccccaggggagcagaggggctgccagggcatgatacctgccttcaatatatttcagatcagaacgggcagtagaatgtacatagataactattttgacctctattgtgatacctgtcatgttgtaccttgtactatatagtattctgatagttcaaagggacatttgtgtggaaggatcatgtaataattatggcaaaagttttataacacatttttcacctcaaaaatgtttttaaacaaaacaagtaaattcgtgatctatttaatttttttttttttttttttgagatggagtcttgctctgtcacccaggctggagtgcagtggcacgatctcagctcactgcaacctccgcctcccaggttcaagcaattctcctgcttcaccctgctgagtagctggcactacaggcacccactaccatgcctggctaatttttgtatttttagtggagacagggtttcaccatattggccatgctggtctcgaactcctgaccttgtgatcctcccacctccacctcccaaagtgctgggaattacaggcatgagccaccgcacctggcctaaaatttttttttactaggaaaaaggctttaacttttttttgtttgatcagctcattttactgttagtattggtgcgtgaattttttagaacaaagacatacttagttcatcgttactttagactcccttcttccatttttatttctggccttggtccaagcctaccagtcattctctcactttgcttctgtaatgtagaccttcttcctgagaagctggctagatcaggtagtgatcataacattcctaaaccaatagtgctgatagctctgtgtacggagggatatttcatctaaaccattgctctaaacttagacttggctctgagtcagtaatacttctgtttactaggtttgaaatatctccctcttagctgggcacagtggcacatgcttgtggtcccagctactagggaggctgaggtgggaggattgcttgagcccaagagttcaagtctggcctgggcaacatcatgagaccctcgtcttttaaaagaaggaaaagaaatatctcccttttagaagaaacctagaagtctctattttgaggccacttaagatctctgaaatgattttaatgttttagagaattgtttatggtattacctgacctttttttcttgatttgttttctttttctttgttattatcctatgtttaagggagaaaaataattttaaattgagcgatttcttggtataattcttgctaatttttaaatctaatttttagcttaattcttaatttaaactaaaattcttaattttaatataagtggtaaaaaaatacatctacaaagttgtaagttctctcatttatttaccaactgtaatatttaggaaattaatggtcagaattcaataattaaaaccagattccttctgaaaaccaaggaacattataattatctagtatctaattgtatttcacccttttttaaatcttatgaacatcacttacttgcttttttttcttccattctttgtaaagcttctctgccttgctctaaatcagcagttttcatgcagctgttccctcatcaaggtactctttattttcatcatctttgcacgaaaatactgcttaccccacactcatcctgggcacatagcatgagactttactcaccggtccctgtaagctcagtctgccttaggcactttaggaacttgtaaagccaccactttataaggtcttggtacttaacaggaattgcacggccagtgtgtggcctgtcttgtttaaggagctgctaatacccacccagaacaatgaagatgcaatcccatacctggactaacaaaggcaggttaataagaaactcaagagagagttaatagagaaagagcagaatacgtggtttgatgaagtttttttagcttagaaaataacttgttttccccaaatagaaagccaaccccagtgtttcctcagaaattaaagctggctgtctattcaatcacctgtggttaaaaaaaggaatatggccaggtgcgatggctcacgcctataatcacagcactttgggaggccaaggtgggcggatcacttgagtccaggagttgaaaaccagcctgggtaacgtggcaaaaccctctttctacaaaaaatacaaaaagctattcacaggactgaggtggggaggttgaggctttggtgagctgagatcgcaccaccgcactccagcctgagtgacagagcaatactctgtctcacaaaaaaattaaaaaaaaaaaatatatggtcattagttagctataaggactaagatgaaaaaatttgacacatttatgtctaatttataaaagatgccttttcttttattcacctgtaattaatatacaaaaagattacacctaaacagaaaaagaagtgctagcagttggtgaacgtcatttttaaaaattcttttttctttttgagacggagtctctctctgttgcccaggctggagtacagtggtgtgatctcagcttactgcaacctccgcctccccagttcaagcgattctcctgcctcagcctcctgagtagctggaattacaggcatgttccaccaagcctggctaattttttttgtattttcagtagagacgaggtttcaccattttggccaggctggtctcgaactcctgacctcaaagatctgcctgccttggcctcccaaaatgttaggattacaggcatgagccacaataccaagccaaaaattcttatagttacaattttttatatttagctcaaaataaaaatatttctaagtatatatttaatacgcctccatgaatgtatttactgtagcttaaaaataggctgtagctacctaagaagatttattctattttgtgcttatttatattagcttcactcattttacaaattctagcataaaattaaagtcctagtatttgttctaaaactcctttgtatcacctggtcttttacttcagatattaggagcatcttaatttgtggagtaattattttatctgtgtgcaaaaattcttcacatagattattttgtctaacaaccctttgaaatagacaagtctgctgttatccttaattgccagattaagaattacaactaaataagaatattgatccaaacaagtctcaaacctaggtcttctgacatgtttaagttctcctgtatgtaataagagttttctaataagtttgccatattgtatatgaaataaactaaatgcagagtaaggtaacctactagtgctcctgcacaggtggcaggagatttcagtttttattagtctgtcatttttgtagtataacttctcacaaattacctaacccatttttccttagcttttcaagagttaaaagcgattctgttgttttattatttcatgatactattataactgattatttcagtttgggaaaccaaaagtgttttttaaaaatgagtgactaaaaaattgtcaggctggagctacatcactagttgtaaaaatacacaaaccttgatacctgccttcaaggaactcatgttctagcagggaagatagacatctaacttaaataacaataatgtaatctaatccttttccccagctactcaaattcactgaattttggccaataacaccttctagttaggattttgtctttatctggaaccaccacaatttattgaaacatagtactgctgatatactgctgtacagaatgtccagctgtttctgctctgcatgtttgtaattggctgcatgtttgaccacagcatatctgtggggtcatttaagctggcaaatcaggaccacagaagttttagctttatttcctttgtgtggtagcctctgggtttctgtcagtcactttgtagttttgtctgtttgttgtccaccaaaggccagaaaggagagccaatgctttaggggcaaaagagataccagaatacaaaactttaaaggggttttgatgaaaagaagtgcagcaccaaggccttctcactaacttaaaatatggcatatagcaatacaggatgtgttctgtctgcattggagtggtctatcagataatctgagagtttttcctatgggatattgaggtgaaatccttcaccagttcctagagagatttctagatttaattttagaggataaaaagaaagaatgctgccaaaattcttagaagtgagaattatgctgagaaacttaaatgccagaactagatactatgatcattctgtttcatactaccttggctttttcaagatatattttggtgtaaacgtaatgcattttaattgtttttttttaatgactttccaagatttttgttagtttctcctttgatccttacagtaaaacatctttgctgtgaagttgaacttaggaatcacagtcacaccacatttacctatgtgtgatttatacagttgggtcactaagtaggaagaaaacatacattccaaaaacaagaatttagatgaaaaatgaatttgagaaaagaagtagaatatcaacttttgacatagtgttgaagcttttggttatgagggatggggctgacaagtcactcgtacttttacatttttaattaatgtgctcattaggaaaaaaattggaaaattcagaaaaataaaaggaaaaagttacccacaatcctatcattctaagatagataaccactgtttattaacattttggtgcatttccttccagtttcttttttttatatacttgaggtcatagtatgtgaacaactttatagcttgttttgtaccctcaacatttaacaggagataaataaggcctttaaaattatttgaggtttgacggttatttgcttcacaaaacagaaagtggaatgttcttagcacttttttgaagataccttcaccctagtgacttcatctacattactacaatttatgtaattgtaattctcaggaataacactgtgcccaaacagaagcattgccacccatgtcatgactgttttcccctcagagtaggccatggtctagtagtagcaagacacacaagaacgagccccagggtagcagattgctggcagagagtcacagggccttcctagtggtcatccatgcttcatgcccctcctgcatgcgggccagctccaagttgtttcaaacctttgtctttttaaggtcctagttttgcctgaatcttattttctattaaagaaacaactcagaattactggacttgaaacttgtaggccaaatgcaaatttgaggaaatggaaggtcaaatacgctgacaaattcataattttaagtggaggatgccaaagggaaaaaaaaaagttctatcttttcaactaaaaatattataccactctctggagatcagggattgcatgctttggggctctgaattacaggtatctagctatcacattttaaaatggaagtgttcagttcattcagtattaattgaaaataatttttcaatgtattgaaaaaataactagattttacaggaaaacaaaaatgaataataatgatctttacccttctcagtgcctttactcagtagaggaagatggatgtacaagttgtagaatcataggcaagttaatttaaaagcaaggaaggagaaagtagttctggcaagagacagaataatgcatcatgaaggaaaaggatatgagaaaaaaaaatatgggttgaattttatcttgtagagatacgcaagacaattaaaagagcctacacaaacatacatcccaaagaagctcaaggcacattccagagatcatgagcagctttctttcagttttgttatttcttttgtaaatagctctggagaggatgcaaataaatatacagaagagaatttaaatagaccagaattctgttacccagagaaaagttccatgaatgtttctagtcatctttctatgcatatgattagattagattagattagaacatgactagccttaaaaaatttaataagggttttaaaaaagatttgaatagaacagattttcagtggtggttcagctatgctcacctcctggagaaatgtcgctgatgtttttccttgcactcatatgcctgatgcagtgcacatgttcataaacagtcactgacaaatgcccatgttcctttgacagcagttcagattttcaagacagcaaatctctgttgagcacgtgtaaaccaggccacgtgcttacagatgcctgatactcttgagtcgaattcagagctgaatccaaatgaaagatgagtggctcctagagggaggtcatcccaagttcatttcctgttcatgagccaacaaataactaactgggtagatctatgtacattttctgtaacataatgaatacttcttgacttgaaatattactttttgtccaaaaatggaaatttttctattctaagatttaaaatttcaatatataaagaagaataaagtacaaattagctgaaatcttgccatacagaggtaaaatatattttttagtcctttggcttctgacagagataaaatattttggcagatgtttacccagccctacgccctctccccacagtgtgtgggtgtttttttcctactccaaaaattgtggtcatctttttgtatcagtaaatatcaatcagtaatgtacattttgatacaaattactaaaacgttctgcagctgtttgctttcccgccaaaatttatgccagcagtaagtataatcagtctaattttgggggtaaattttattgatgtttaacagaaaagttcacaaattgcaagttttcagcttagtgaacttttaaaatgtaaacacacttgaaaatccatcatctacatcaagaaacagaacattaccagcatcccaagaagccatcctcatgcccccttaagtcactacttccgcaagggtgaccacagtcctgttacccaatttgtaatctttcctaatgtgatagataaaaataaaaatcttattttagtttctggttacttttctgaagttactgcttagattatttataatattaattggggtggggtgcagtggctcatgcttgtaatcccagaactttgagaggccaagatggaaggattgcttgagaccaggagttcaagaccagccttggcaacatagtgagactctatctctagacagaattttaaaattagctgggcatggtggcatgcacctgtagtcctagctgtttgggaggctgaggcgagaggatagcttgagcctggaagttcaaggttatagtgagctatgatcacaccactgcactgcagcctgtgcaacagggcaagaccctgtctctaaataaataatcaatcattgttaggcccaggttttggaggtttaatctcctcctcaagagaaataaatggcatctgtttaaggttgcagaatgtgaaatgacttggcatagctgaaaagaagcaaagattctacagtatgacctttgtgatatattattttctcagtaaatagtttctttgggataggcactgtgattaaaaaaataaaagcatcttgagttttctttgaagtgacaaatttgctggaaagatcagtactttctgctgctggagagtatattctgtttataaacatgaatgaggatgtgaataaggctagaagatgacctctgctggaagtttctggtatgatttggaggaaggagcactagtcttccctggtggctgctagcctttcatttagttcaagcctgccagcctctagcttttccttgcaacttgtcttttcatttttcttgtgctattttctgctatgatagcaaactttgcataacaaaatgtgaagttttccatgtgacattaacttagtaaacattttagcaattgactattaaaatgaaatgtgcataaacaatttgccaggttgtatcttatcacaaatatagtcatgtgctgcataacaacattgcagtcaacaacagaacacatatagacagtggtcccgaaagattataatactgtatttttactgtaccttttctgtgttagatatacaaatagttagcattgtgttacaactacataaagtacacaatatggtaacctgctgtacaggtttgttgcctgggagaaacaggctataccatatagccttggtgtgtagtaggctatgctatctaagttcatgtaagtacactccacaatatttgcacagacaaaatcgcctaatgattgtttcctagaatgtgtccccgttgttaagcgacacatgactgcaatgaaattcagtcctggaaggaaaagaagaagtaactggctgttctctttttctccaggaatcgacaaggagaacgttgaactctcccctaccactggccactgtaacagtggacgaactcgccacggatccgcaagccaagtgcagaagcaaagaagcgctggcagtttcaaacgtaatagcattaagaagatcgtgtgaagcttgcttgctttcttttttaaaatcaacttaacatgggctcttcactagtgaccccttccctgtccttgccctttccccccatgttgtaatgctgcacttcctgttttataatgaacccatccggtttgccatgttgccagatgatcaactcttcgaagccttgcctaaatttaatgctgccttttctttaactttttttcttctacttttggcgtgtatctggtatatgtaagtgttcagaacaactgcaaagaaagtgggaggtcaggaaacttttaactgagaaatctcaattgtaagagaggatgaattcttgaatactgctactactggccagtgatgaaagccatttgcacagagctctgccttctgtggttttcccttcttcatcctacagagtaaagtgttagtcctatttatacatttttcaagatacaagtttatgagagaaatagtattataaccccagtatgtttaatcttttagctgtggactttttttttaaccgtacaaaactgaaagaaccatagaggtcaagcctcagtgacttgacaccataaagccacagacaaggtacttgggggggagggcagggaaatttcatattttatagtggattcttaagaaatactaacacttgagtattagcaataattacaggaaaataagtgcgaccacatatatcttaacattactgaattaaaactatggcttctaagtccttatccaaactcagtcatccaaactagtttatttttttctccagttgattatcttttaatttttaattttgctaaaggtggtttttttgtgttttgttttttgtaaaccaaaactatactaagtatagtaattatatatatatatatattttttcccctccccctcttctttcctaactaattctgagcagggtaatcagtgaacaaagtgttgaaaattgttcccagaaggtaattttcatagatgtttgcattagctccatagcaaaatggaatggtacgtgacatttagggtagctgatatttttattttgttaaataatttccaagaatagagtatggtgtatattataaatttctttgataagatgtattttgaatgtcttttaatcttcctcctcctctccaaaaaaatcagaaacctctttaagaaaacatgtaggttatatatgctagaattgcatttaatcactgtgaaaagactggtcagcctgcattagtatgacagtaggggggctgttagaattgctgctatactggtggtatggattatcatggcattggaattttcatagtaatgcagatccaatttctttgtggtacctgcagtttacaaaataatttgacttcagtgagcatattggtatctggatgttccaatttagaactaaaccatatttattacaaaaagatattaatccctctactcccaggttccctttatatgttaagatataatggctttgaggggggaaaaaataaacctaggggagaggggagtttcctgtagtgctgtttcattagaggatttcagtaaattaaattccacagctaattcaataaataatggtacatttaagtgttctgattttaataatatatttcacatttatccacacagtaacaatgtaatatgttaatgtaaataaaattggttttgatactcagaaataacaagaatttaattttttaaatttgtttacagtcctgggaaaagtaagaattatttgccaaaataagaggaaagaaaaccttagtattattaatgagtttaccatagaattgttggaaatactgaagacaggtgcaatttactaaacttttgtttttaaactattgtagaggctgcattagaagaaaatgtttataatgacagagcaactatgactatataaaaaagctgaaattagaactgtgtttagaaatagatcagtaacccagtgccaaggatgccaagctgccaccatggtcttggctctcccacaacccagtgtttctggggtaagtttcacagtttctaggccctggaatagcaggcagtgtaagcctttgataactttagttcgatgtttttcttgtttttgtttgttggtttggtgcatatgatagtgggtgttatgctattttgctcttcccatcaaaataaagaaacttccagaggtttactgttaaaaatactgatatttccataaacgggtttaccaagggtgtagtatttcataccgcctgaaatgatcagcattggcacaaatcaaaattcagccgcctttgaaatgcaaaaatacctttgactagtaagtacatcctaggagtttgaaaacttaactaaggtttaaaatttaccttgtttaaagaacttctgacttttgaggaaaatctagctttccaagtaactaaaatgtacatgagataaacctctcaccactatgtgtcccttgagaaatgcaacacttttttagtcttcatacttgtaatctataaaagaaattctgaagtttagaccaagttgcccatttctgcgtaattgacataagttctgttaaaaatattataagtaattcgtttcggtttgtagatgtttcccctgacttgttaaagaggaaaccaggaactcagtcatgtttttgtcctggataatctacctgttatgccagtactcccatccgaggggcatgcccttagttgcccagatggagatgcagttcagtagatttggggcaaagtggctacagctctgtcttccattcactcaacacctgttcatgactgagccaggtgcccaggacacatcctaaacagtcagcttctatcctgtgtcctagttggggagacagagtgccagccagcaaccctcccaggtttgtaggttttaggggttttcagttttgtttgggttttttgttttttgtttttgtttctacatccttccccgactcccaggcataatgaggcatgtcttactcaatgttatgcaatggatttaggcaaaaattcattcttagtgtcagccacacaattttttttaatgcagtatattcacctgtaaatagtttgtgtaaaatttgacaaaaaaagtatatttactatactgtaaatatatgtgatgatatattgtattattttgcttttttgtaaagcagttagttgctgcacatggataacaacaaaaatttgattattctcgtgttagtattgttaacttctttttgcgactgcgttacatcatttaaagaaaatgctgtgtattgtaaacttaaattgtatatgataacttactgtcctttccatccgggcctaaactttggcagttcctttgtctacaaccttgttaatactgtaaacagttgtacgccagcaggaaaaatactgcccaacagacaaaatcgatcattgtaggggaaaatcatagaaatccatttcagatctttattgttcctcaccccattttcctccttgtgtatgtacttcccccacccccctttttttaagtaaaatgtaaattcaatctgctctaaga

SEQ ID NO: 422 - DNA, 282751 bp, Homo sapiens; identical to SEQ ID NO: 421

SEQ ID NO: 423 - DNA, 127838 bp, Homo sapiens
aatctctagctcgctcgcgctccctctccccgggccgtggaaaggatcccacttccggtggggtgtcatggcggcgtctcggactgtgatggctgtggggagacggcgctagtggggagagcgaccaagaggccccctcccctccccgggtccccttcccctatccccctccccccagcctccttgccaacgccccctttccctctccccctcccgctcggcgctgaccccccatccccacccccgtgggaacactgggagcctgcactccacagaccctctccttgcctcttccctcacctcagcctccgctccccgccctcttcccggcccagggcgccggcccacccttccctccgccgccccccggccgcggggaggacatggccgcgcacaggccggtggaatgggtccaggccgtggtcagccgcttcgacgagcaggtaaccggcccgtggcgggcgggaggtgggagcggagtgggggtggggacagagtaggtgaggggaggtaggagcggccgcctcccccgcggctgcctcaggctctggaggaaaggaagggaagggaagagaagggaaggggggataagtgggggtggccaaggcgggaggtgaggggtaggaggggacagctgggagcttgggcaccctttccctcctaagtcggggggtggggccttgtccctgaccagcctccgaccctccatcccctttatcccagcccttccgcttggaaatggggatgagtgacctgggggcgcctttaggggcgcgccatctggatttaataattacccccttacttttgtttttgagcagaggtgggtaacgtttaggggttctctcttcctcttccctccgtgaccctcctaactggggacgagcgaaccctaaggcctgtcttatataccctcaataggagaacgataacattccgcccctcccccagtttcttcagcttcctctcctggagggggaagagcagaagaaagcaaggaaggcacaggttttcttactttctgctccatcgtctcatcctgccccgagagcttcaagtgcacactcactgcacatctttgtgatgccctacaacgtcgtcccccatatcctgatgacacagactgccttttttttttattgccgtttgcagtggaaaccgtggttctgaaatatcttccccttccttgataattgcagtctcttccccccccccttttttttttgccagcggtctgaggatgtgatgcattctcgagtgagaatgttggggagtaaaggggagaagggtgaaaggaaagtgagaaactgcttcagagccaccgacaacagagcaaagccagctgggatgtggtcctggagcggatcattctgctagtgtttgtggttgtttttgactctctcctggttgacaagagaactttcattgagaatatttgggatgaaaaaaaagttttgtagcttgaggaggtgactttttatcgcctgagtttcacacaataaatcctggggctgattagaataaatgcacacatagccttttgtcagtggaaattggtttaactttgtgttgctgtaggtagttggggatggtttaagggatgctttctgcagctgtgggtgcagtgggcttcctgtgatgggggaattgtttaagattgagtcaacctattttgtttactggatataatggtaaaacattatgggagctgaaggggtgggggaagagctcttctgttatttgatgcataaacatttctttacgggactcagcgtttcagacctacctggaaaatatcttggaatagacagaggaagttgagaagaagctatgtagataaaatagagttatgaagctgtcagagacttgaaggaattgttttatccattcgtatgcttccagacccaaaggcatctaaactaaactactaatccatctgaagtataatgttactgcatataaaagattacattattgatagagcgttagatttaaaacttggtagaaaagactctgtaattttaagaaaggatttaaaaggcacatagaagacttccaaagctgaaccttgtggacagcagaatctggatgtaggaaattgaaggatccacgccgcaattctccttaaattttaaaaattaaaaatttttttcagttttttcttaattttatttttttacttcttacctgttcatctctaggcttatttgccatattggaaaaagatacttaagagaggaatgattttgggctgggcgcggtggctcacgcctgtaatcccagcactttgggatgccaaggcaggtggatcacctgaggtcaggagtttgagaccagcctgaccaacatggagaaacctcgtctctactaaaaatacaaaaattagctgggcatggtggcgggcgcctgtaatcccagctactcgggaggctgaggcaggagaattgcttgaatccgggaggtggaggttgcagtgagctgagatcacaccactgcactctagcctgggcgacagagcgagactcttgtctccaaaaaaaaaaaaaaaaaaaaaggaggaatgattttgattatatacccagtaaagcaagaaagtgtttctccttctgtccctagctttaaaagaccttaaggcttcgttgtttgttatgcatattgtggaatcaaactcaccaccatctgttaaaaattaaggacattagtttttaaaacagcatttttctgcattccttatgttgtaattaagagaaagatatataggagagattattcctcactttttttttttgagacaaggtcttgctctgtcgcccacgctggagtgcagtagcttgatgtcggttcattgcaacccctgcttcccacattcacgtgattctcctgcttcagtctcccaagtagctgggattacaggtgtgcaccatcgtgcctggctaatttttgtatttttagtagagacgggggtttcaccatgttggtcaggctggtcttgaactcctgacctcaggtgatctgccccccaccccctgctcggcctcccgaagtgctgggattacaggcatgagccactgtgcctggcctattcctcacatttttctcttagaaagttaaagtctctgaccttgagatacaaaaatgtaagggttttcagtgtttaacataaggtacttatatatattatatatagtatatatataaaataaattaatatattaatttattatataagtgataaatgtttaattcaaattagagttcaccttacggttgaaaatgtcttttagtcagaaaactgaggcatgggaaggttaagtgacatagatctaataagagcttcagtatgaaaagtagtgaatgcttgaccatcagggagatacttttcctaagtatcccataaaatttgttctaatccattaaatatatttagaagactttattttattttttttatttttgagacggagtttcatgattcttgcctaggctggagtgcaatgatgcgaccttggcttactgcaacctctgcctcctgggttcaagtgattctcctgcctcagcctcccaagtggctgggattacaggcgcctgccaccactcctggataacatttgttatttttagtagagtgctgagattacaggcgtgagccatcgcttacatttttattgaggggagaaaaagccctgcatgtactgagagatagttgtataagaatcttaagagttggccgggcgcggcggctcacgcctgtgatcccagcactttgggaggccgaggcgggccgatcatgaggtcaggagatcgagaccatcctggctaacacagtgaaaccccatctctactaaaaatacaaaaattagctgggtgtggtggtgggtgcctgtagtcccagctacttgggaggctgaggcaggagaatggcctgaacctgggaggtggagcttgcggtgagccgagattgcgccactgcactccagcctgggtgacagagcgagactccatctcagaaaaaaaaaaaaaaaaaaagaatcttaatagtttcaactgtttataaaacttttgaattttggattatattatctgtactttgctttactgggcccagggggagttaagctttccttcttattacagctaagagtttgcctgttggaccacttaacgcccccagggagcatgtgcatgtctaaagatggcaactctgtttatgattgctgttttggttggatttctaatattcggtgtgattaaagcagaaatgcatttctagccactgctgattacagacatattgcactctgatgggtatcgcttagcaacttagtgcagtagactcagttaaaagaagtggatgtgtgccatattgacattttgagctcacattcttgtgggtaatataaaattccttaacctgataatattgcagctaaacctagtatttagggtctaagttgaatgagtattaccaattttagaagtaatcacctccttggttagggaaatgacagttgcacaggtggacagccagaaagctgaatgttatcagttaaatcttacatctctccttaacctgccttcgtggtgccaaatagcaagtttctaattgaaactgacaaattgtaggtgtgtagcttttttttttttttttttgagacagagtttcgctcttgtctcctaggctggagtgcaatggggagatctcagcatactgcaacctctgcctcctgggttcaagccattctcctgcctcagcctcccaagtagctgggattacaggcgcccaccaccacgcctgcctaatttttgtatttttagtagagacgggggtttcaccgtgttggccaggctggtctccaactcctggcttcaggtgatccacctgccttggcctcccaaagtgctgggattacaggcgtgagccaccacgcccggccatgtgtagcttttaattgtggttcattaacccagtttctaagcaaattagaaccttctgtgtatctcccctagttctgtatgccccactggttcctgtagagctttatttctgaagggaagtatgggaaaactatggatatttgaactaaaaaaaaaaaaaaaagaattaaaaagaactccatcccaaaatgatttgttgtaaatatgttcatttaaagcaattatattttccatatctgatcaagcaaaagtagtacataaaagccaaaaaacccaatttaaagaatatgttatggaataaactctgattttagaggttgtagtagcatatttgttgttctcatacattgagtgttcatctgaatgtacgttgaatatgcggtgagtgattcacagtataaaatgattggcaagtatcttcgaaattacaaaccacatactgattagacaaatagatttgcaaaactgaagctttttggatttaaaaaatatctcctagcctcattcttcaagcctggtgtgtaatttttataaggccttatagtagttgaaaatgagtactcttttatggtgacgaattctttatggtgagtgagaaataatgcttattcttccaattttagtatatgtggtgctgaatcgagcacaataatgcttattctttgcttcggaattttttaatttattattattgttattttaaatttttatttatttatttattttgagatggagtctcactctgtcgcccaggctggagtgcagtggcgcgatctcagctcactgcaacgtctgcctcctgggttcaagcgattctcctgcctcagcctcccaagtagctgggactacaggcgcatgccaccacgcccagctaattttgtatttttagtagagacagggtttcaccgtgctagccaggatgggtctgaatttcttgatgtcgtgatccacctgccttgacttcccaaagtgctgggattacaggcatgagccaccgtgcccggcccggaattcatcctttagaaagatttcttccagctgttcctcagttctctgcactcccttacactttccaccttatctgtctgggaactaatttagtctttatgttggctgctttcttttcacttttcaggctaagatttcctttctcttggaaatcagacgtttacttggtcctgcagctctctctctgtggaccagtcttttttgttgttgttgttgccagatactcaccgcctctactgtttatccacccatttcctttataactctgaaaagtagctcctgcctctgcttgattgctgttttcttgaaagtgattacttctggcaaaacatagtggtcattgcttagttgtaatgccactgtgatgttccactccccccggaaaccaatctcttccagttcccaagacacaatacttttctactgaattggagttccttagcgggggtcttagttttgttctgctattcagtgcctttgtccctatcctagccattagctttcctatagatccttgatttcctcatctgttgaaaaagaaatggctagaaaatcttttagattctttcaagtttaaatattcgatgattttaatattctaacagcatgtctctgtgacccagcagtctattgggagctgaccccacttgatttaccaaactctttcccattatgcctctgcatgcacctatgttccaggcaggtcacctcagtctcttctgtgtgtatcatgcttcttcccacttcttggcctttatttctgccagtctctgcctgaatgctttaattcctcctttgtgcttttctaattcctgtccatccttcaatgttcagctcagatttcattttttttttttccccatgaggttgtttcagactaaactctgctatctcacttcttggtatccttgttacctggagttttacagaaccacacagtaagttttcttcctttaggaggattgtttgaacacagcttggctttgttttctttttttcttgtctttttatcaaatggagtgcatactttctgaaaagcaaagaacgctatttgaattctcttctagtcaccccagtgcccagcacagtcttaaacacacagaacattgatggaatgtttttcatatgattcctggttgaagggtagactggctaaataaaaaaagtggtacttttggctttgttttactgaattttacttccatgtttgcaatagcctaggtctgataagtgatattttaactaggaatgagtaagaaaattagcataaagaaggaatttatacatatttatatttcctcccatagagcaaacatgttttttgaatcaggtttcagatctgatcaactacttttgtaattttggatttgtcacttactgttaggatattttgcaatggtgtgatagaatatgaatgtgaagcactttgaaaagtctaaaatttttctaatataagatttatatgttttctttatagcttattattattattattttttgtgtgtgtgacagagtcttgctctgtcactcaggctagagtgcagtgtagcttattactgattattgtgttttcattaaataagggagagtaggccaggtgcggtagctgatgcttgtaatcccagcactttgggaggcccatgtgggaggactgcttgaggccttgaattcaagaccaggctgtgcaacatagtgagatgctgtctctaaaaaaaattagttgggtgtggtggcatgtgcctgtagtcgcagctactcaggaggctgaggcaggaagatcacttgaacccaggagttcaagcatacagtgagccatgattgtgccactgtactccagcttcggtgacagagtgagaccctgtcttccaaaaaaaaaaaaagagagcgtgactagtctctggatattcctttgtatgtaccttggccaatatataccttactttagtatccattgacaagttctcttttttcttcttcttcatttttttttttttgagatagagtctcgctctattgcccaggttggagtgcagtggcacgatctcagctcactgcaagctccaccttctgggttcaagcgattctcctgcctcagcctcccaagtagctggcattacaggcacgtactaccacacctggctaatttttgtatttttaaaagagacaagggttcgccatgttagctggtctcaaactactgacctcaaacaatccacctgcctcagcctcccaaagtgctgggattataggcataagctgtggtgctggtctaatattgttacattttattttaaatgttcctgttttttgccctactctttttatttgactttttaaccattaggaaattagattcttttctcaaatctgctttattattattattattttgagacaagttctcgctttctcgcctaggctggagtgtagtggtacaattttggctcactgcaacctctgcctcccgggttcaagtgattctcctgcctcagcctcccaagtagctgggattacaggcgtgtgccaccacacccagctaatttttttgtatttttagtagaggcagggttttaccatgttggctaggctggtcttgaactcctgacctgaggtgatccgcccgcttcagcctcccaaagtgctgggatcacaggcttgaaccaccgtgcctggccctatttttgtatttttactatagacggggttttgccatgttggccaggctggcctcaaacacctgcctcagcctcccaaagtgctgggattacagatgcaagccactgcacctggccttaagtctgcttttaaaaaatgttttggctgggtgcggtggctcatgcctataattcaagctttttggggggctgaggtgggaggatcacttgggcctcagagtttgagaccagcctgggcaacagagtgagaccccatctctacaaaaagtaaaaaaaacaaataaaaaaaaaatcagccagtgtgcattggttgaaagtaaagaaaagaaaaaaaacagacaaattagccaagtgtggtagtatatgctacttgggaggctgagtcaggattgcttgagcccaggaaattaaggctgcagtgaggcatgattgcaccactgcactctggcctgggtgagaccctgtctcaaaaaaaatttttttttttaatatggagaaagtatttttgtttttcgttttttatttgggtaccggccactgcacccaaccaaacattttgtccttaaacaaaagtttaagtcatataatacagtagtaagaatgccttattttttacatctttgttctttaaattactcagattgctatggggcatttttgttgtagctttcaaatttggtattctggggttctatgtagactctatattgttgcattctaacgacatacttttaaggataagcagcgtattaattaaaaatgtgttttccacttgtgttccttaggtctgcgtatattttggaggtgtgtgtgtatataagtcaagggacaggaggtatcggaaggctctaaaggaagtttaaggaggagaatattctatagaagtggaaggggagatttgtggtcagcttaaactgttaaaaggcttgggatcaataccgaagcagaatatgagcatcttaatctgtttctttgcaaaggattgacttgtatttataaaagcattggcttgtttcatctgacatcttttaaagtaccccattttcttgggggcgggaagggagagatgagaccatttgttttgatcttgaaggacagaaaagtggttttacgttgtagtgactgtgaattaagtttaaggtctcagcaagttgtaaatttctgtatcatactatgtggtagagccttcagtaaacagagtactctcaggtgtttaatgctataggatataaactataactgctgtttatagtaccctcgctaaattctcttaaaggcaatccatttgaccacttcaaatgttatatgcctgtgatatatagttatattctctgcatataactggtttttaaaaattgtttattattcatttattttagaagtgaggtctctctttgttcctcaggctggagtgcagtggtgtgatcatagctcaccatagcctcgaactcctgggctcaagtgatctcccacctcccgaatatctaggactatgggcgtgcgccaccatacctggctattattttaatttttttcgtagagacagtgtcttgttatgttgcccaggctggtctcaaactcttggcctcaagcagtcttcccacctggcttcccaaagcactggaattacaggcgtgaactactgtgctgggtcctgagtggcttttgagccactgactatatcatcaaaaagcttctgttgagacaaagcctcaagctagtgtggagttcatcctactaaaatgaagaattggcattatgttctaaaactttacatattcttaccataaatggtactaattactttgcagtagcagtaacttgaggtgcaaacttccagattgcatattttctttaaaccatagtctggcactcacggtttggcttagggttgccactgcagtccacaagctgtcgcctgcccttattcatattttatagctttgaatgtcttattccattgaacttcagataactttttttttttgagatggagttttgctcttgttgcccaggctggagtgcaatgttgtgatctgggctcactgcaacctctgcctcccaggctcaagcgattttcctgcctcagcctcccaagtagctgggatgacaggcatgcgccaccatgcccagctgattttgtttttttagtagagacagggtttcaccatgttggtcaggctagtcttgaactcccaacctcaggtgatcctcctgccttggcctcccaaagtgctgggattacaggcatgagccaccgtgcccggctgagaacttaactttttctgatgaaattctttcctgctccacctaactcccgtgtcccacccccaccagcagagtggtatatctagcacaagaggcatgaaattaatttagtaaatagcaggactactagaaacttttaaggattatttaacttatttttaatcaaaattttatactcagataatgaccttttgggaagttatgtctcttaatgatctcaagtggtgacacttttctgttgacacggtttctcttgggtagttctcatagtagtttgggcatgagaaaacaacttttaccactttagacttgtgagggcagcctactatgtagtaaaagaaaaagcttttgattgtgcaacttgcagtgtggtcttggggaagtctcttaacctctctgaacatcagttttctatattttcatgtgtaaaatgggcatgatacttacccttctcacatcatgggcttgtttaatgacttaggtatgaatcttatatgaaaggaagctgtaaacagtcataaaaatgtattagcatctgtgcagtattttttttctatccattctttataatttggtggttattatttctactctacatgagaaaaaagttacagaggcaaaacatgttcacaatcatatgattatataattaactgagttaaactagagtatggatgtcttgacccttagatcactatctttccaataaatagttttaaaagtctaaattttactaacaggtagtacaaatatgcaaaatgagggatgtatgattgcttcttcactcgaagatggtatattatgtttttccttttaagttcatgttagagtatctgaatcttttcaagttggttagatgttagaaatagatgtaaattttaagcattatatatccttgatttcattatgtattattctcctggtcactttatcaaaacttcttcagctgttagaagttgtaacattgtttcccttttatttagttatataatacacttattgtacattcttaagtgggagaatagaatttgtgagaataccaacagaaatacacatacagctataaatatgagattatgattctttcatgttggcattgcacagtctatttttgtaaagttggtttttatattctaagaacattttacttagagtttgattacatttgaggcaaacttttcaactttggtagtatttgaatgaagattcctggatgtggtttttttaattgttacatctactttttcagtttttctttttccctataacaaccctcaaatccttcatcttgtcttttggagtatttttttctatcctcctgtctttatcggtgccttctattcctgtcccaccttgggtctgggaaaatgtgcctttatgctccatgtgagtcttcttccttttgggtaatgagtgcggagggaaaaaaagcacagtatttctttccctgttatgtttcagtttttggcctctgataagtgaatctggagtagggaatgacagtgatagtaggttttgttttagtcatatattggcgacaaagatcaacgaagacctgaagctcttgttcctctcatgacacaaactacccacaggtgcatgccaccatgccgggctagtttttaaattttttgtagagacgaggtttcgccatcttgcccaggctggtcttgaattcctggactcaagcgatcttcccacttcggcctcccagagtgctgggattacaggcatgagccaccgtgcccaaccgagattctgtctctgaaaaaataaataaataaataaaataaatacataaaaataaaataaaaacatttgaagacatcttaagtacaccctagattcccacccccaccaaaaaatttcattcattcttcaaccatttctcaaagaacatgttttcaagacacctcactatcctaattgttttccttttggtgcaatggtggtcagtactcaggcataccattttttatctttcctcccaatgttgtatgagggcattatatgaaacttaaatggatttaaaaatgctgagcttgctggacatggtggctcacacctgtaatcccagcactttgggaggtgggggagggaggattgcttgagcccaggagtttgagatcaacctggacaacacagctagtatgcacaaaaaaataaaaaaagtagctaggcgtggtggtgcatgcctgtagtcccaggtacttgggaggctgaggtgggaggatggcttgagcccaggaggttgagcctgcagtgagtggtgtttgtgctactacactccagcatgggtgacagagtgaaactctgttaaaaaaaaaaaaatgctgagcttcaggtacagtatatttttggtatgcatttgattaccagtacagtatacctatcaaaaatgttaattcacatgttttaaaataaaaagtttccaacataaaagtagagagttttttttttttttttttttttttttttctgagacagagtctcactctattacccaggctggagtgtaatggcacgatcttggctcactgcaacctctgcctcccaggctcaagccatcctctctctcagcctcccgagtagctgagatcacaggtgcacaccaccacgcctggctaaattttttgtattttttgtagagacagggttttgtcatattgtgcaggttggtctcgaactcctgacctcaagtgatccacccgcctcagtctcccaaagtgctgggattacaggcgtgagccactgcacatggcctagagagatgttataaattaatccttttgtatccattactcaatttctccctagtcttatttcatccgtattcctacccatttcctgctcactacctctttattattttaaagcaatcctatatatcatttcagcgtgatttattcttatactgactttaagagctgtgtaatataaaaacaactcaattaggaatcagaagacttgactttaagtcttaactttctactggaatgagttaacaggggggcaagccaagctgtatgagccctgaattcctaatatgttgaagagagtaacacgtggtggaggggacataatgttacctgcactttttcacagggatctatgagaatcaaagataggaggtaatatgcatgaaagtattttgtctactctaaactcaaaagcaaaagtgctttacaaaggtaagattttattagtaaatgctgcttccctgtataagtgctaacaactcatgcctaatcagtcttagaattatctggatgctgacattaaattaagtccatagtattaaaatcaccctttcacctttacccactcttggattttgacaattgcaacaacattttctcattcccaatctggctcctgttacttttcatgacttctgcaagttcactgaccacatttctcttaccatatttctaaattttcatctgtatcttggattcatgtacacttgagctcaggtaaaacagggaggtgggctcttcatgctttatgtatctaagttctgatgactctcagcaatgctttttttcagatttgaagatcattttcttttttttctttttcttttttttttcttttttgagtcactgtcacccaggctggagtgcaatggcgcgatctcggctcactgcaacctccgcctcccaggttcaaacgattcttgtgtctcagtctttcgagtagctgggattacaggcacctgtcacgatgcccggctaatttttgtatttttaatagagaaggtgtttcactgtgttgtccaggctggtctcgagctcgtaacctcaggtgatcctcttgcctcggcctcccaaagtgctaggattacaggcgtgagccaccatgccttggcctcattttattttcaactagaacaattagaaataaaaattgagttgaatagttctgcttttaatgacctattggtgctggaatcatggactctagtgattcttgttcttctttcctcatctttttgatcctaatgtattttaaaagcctttacatatttttgtctttaacatttctagttattctgaacttttgttttaactcttctgttaatttatccattgtgtgtagtgtgtattttttcttaaatgtccttataaatactgagctgtgggggaggggagaggaggagcaactggtgcaggcacgctagtttctttagaaatgtcagctctgccagatcacttaagacttgttaaaagtacagatttcctggctctactaaacatcgtgtgatttctagaggtcccaggtcatttttgacataaagctgggtttgtaaaccactgctgtgtgatatacagggagaatttaatttctgggtggtatttaataggtcacagtacagtcatatatatcactgcaacaagttagaaaaccacaattggatgaactttaaaaatcaatactaaaaaaaatattggagagctatggatgtaatgaggactagatgaattagaattccagaaatagaagagatctttataggtgagcagaggattgctgacatttgctgattctggacacacactgaaggaaaaggaaactagagaggaagtgcattttactaaaactgcaacatatccctggcccagttcaattcctgattggactgaggtgatcagcctatcttatcccttttgcctaatagaggaaatagacagctcttactgaggagatatattctggggtttctatggttctttcgtttataatactatcatactattaactattctagagatgtgaaagggtggaaaaattcaagagaaaaataaaacttatagaagcagactcagaaaattgaagttcatcagacaaagacttattttaaaataactataatatacttaagaaaataaaggaaaatacggagaaaatggatgaaaattttcatagagaattggaatccacagaaagaaaccaaatgaacattctaggaatcaaaaacacaacgttggttgcttaaggtctttatttgtagtttaattagaaactttggcgcaggactctaggacactccacctccccctcattctttactgttcttaaaaaacaaaaacaaaaacaaaaaaaacccaggtaaatttaatgtatactatttaagttccacgagagcagggcctatgtctgttttgttcgttgttgtactcccagggcttagtatagtgcatgccacattaaaaaacaaaacaagacagaacaaaatcttccttaacaccaccatcacaaacccccccattaataattaattgacattaatctgaaattaattattcattgtaccggttcagtagcagactatacacagcagaaggcaagactagagagcttgtggacagatcaatagaaaatatctagataaaagcacagaaaaaaaaaaaagaatggaaagagtagaacagagcctctgagacatgtggaacattagtaaaaagtctaatgtgtaattggagacccaaaagtagagagattagcatggaagcaaatacttgaagaggtaatgataaaatattttcccaaactgatgaaaggcatcaacctataaattcaagtagtttagcaaaccccaagcaggatgaacacaaagaaaactacacttagcatatcttaatggaactgttgaaaaccagaaacaaagagaaacgcttaaaagcagccagaagaggggaaaaaaggcactgtgttcaaaggaacgatataatacaactgatggctgactttttaatacaactgtggaaactgggaaataacagacattttttaaatgttggcaaaaaaacctgccaagctagaattctaccttcagcagaaatatccttcagacaagaaggcgaaataaagacatttttagacaatcaaaagctgacaatttatgaccagcagacctgcactgtaagattactgaaggaagttttttaggcagaatgaaaatatctcaaatggaagtacaaaactgtaggaaataatgaagagcacacactcgggtaagtgtgtgagtaaatagacaagacctattgcctcttgtttttattgctgtttttaggaactttattgctttttgctattctagaataatagaatttccacagcttttaggttaaggtaaaattgccatccaatcaataaactgcacatatttaaaatgtataatttgatgagttttgatatacatataagcctttgataccatcaccacaatcaagatgaagaacatatattaccggcaaaagttttctccagcctccttataatccattcctacctccatcccatccctagggaacccttgagctgtttttgtctcagtggatatatcataagttgtttatccattcacttgttgatggataactgaagacaactcaaattttcaccattacaaataaagttgtcttgaagattcatatacatgactgtcatttctcttgagtaaatacaaaggagtagaaatgggtggatcatatggtggatgtatataataatgttacaggatattatattctgtaatattttaagaggccaccaagctgttcctaaagtgattgtatcatcttacagcagtatatgagagtttcagttgttccacatctttgccaacacttatttaaccttttcttttaaattacagccatcctagtgggtatgaagtggtgtctcattgtggttttgatttgcatttccctaatgactcatgatattgagcatcttttcatgtgcttatttaccatctgaatattttctttggtgagctgtttatctcttttgcccatttttaaaaaattgggttttactggagttttcagaattcataatatatgctgaatacaagttcatcagataaatgatttgcaagtcttctagtttttccttgtttttttgttctcaaagtctttcaaaagcagatgttcttaatttttctgaagtccaccttatcaattaaaaaatagatcatgttattggtatatctaaggtatctttttctaatataaggtcacaaatttttctcctctgttttctgtagaaatttaggatttatactaacgtttgtggctcatttttagttaatttttgtatttgtgctatgtgcctgttatgccaataccacatagtcttaactataaaagagcttaactatataaactataataaaatatcaagtcaggtagtataagtcctccagctttcttgtttctcagaattgttttgactagtctaggtcttttgttatccttgtatggtttcggattggcttgtcaatttctattaaaaagccagttttgatagagattctgctgagtccatggatcaactttgggaagattgccatcttaacaggtattgttttttagtttcaatttttgattgttgctaatatatagaaatacatggatgtttattgatcttgtttgtttttatttaggccatagatttttttctttttctttttaaagacagggtcttgctctgtcccctaggcttcatagctcacttcagccttgaactcctgagctgaagtgattctcccaagaagctaggactacaggtacatgccaccacgctcggctcattttcttattttatagagacaggatcttgctgtgtttcccaggctggtctcgagcacctggcctcaagctgtcctctcgcctcggcttcccaaagtgcatgagtcactgaacttggccaggccgtaaattgttttgagacagggtcttgctctgttgcacaggctagagtgcagtggtgcaatcatggcttactgcagccttgacctcctgggctcaagtgatccttccacctcagcttcctcagtagctgggactgtaaacactcaccacgatgcctggctaatttttgtagagacagggtttcaccatgttggccaggctggtctcaaactcctgaccttaggtgatccatctgcctcggcctcccaaagtgtttgaccactcagcctttatacagatatttcatcttctttacaagaagaaaaacactctaagctcttgcctaaaaagatgaaaatgttctttgtaaaaatgaggatgtccttaccctcttcccaaaatgaggagcagagtctcataattgtattgatttctgggggacattcacactatctatttctaggctgtgttaattatgcctcaaattcatagttccttctgaatatcctgttacctagggactaaattgtaaagttaacctttaataaagtttgaataacatagagaagaagagggaaggaattgatttataaacttgcccgtttccctgtaataaggaagaaaatatgtatagctgctgtagaccttgcttctgtaactggttgagagattgtagttcatatttataactacttctgctgtacattccatgtttcctttgttctcattcaagatctcagctggtggggtaacctaaatcttcattaataaagaatatggctttgggaggctgaggcgggtggatcacgaggtcaggagatcgagaccatcctggctagcacagtgaaaccccgtttctactaaaaatataaaaaattagctgggcgtggtggcgggtacctgtagtcccagctactcaggaggctgaggcaggagaatcgcttcaacccaggaggcagacgtggcagtgagctgagatcacaccactgcactccagcctgggtgacagagtgagactgtctcacaaaaaagaataaaaaaaaaaaagaaaaaaagaccatgggccggacatggtggctcacgcctgtaatcccagcactctggaagctgaggtgggcaggtcacaaggtcaggagtttgagaccagcctggccaacatagtaaaaccctgtctctactaagaatacaaatattagctgggcgtggtggcaggcgcctgtaatcccagctacttgggaggctgaggcacaagaatcacttgaacccgggaggtggaagttgcagtgagccaagatcacaccactgcactccagcctgggcgacagagcaagactctgtctcaaaaaaagaaaaaaaagaatacaaatctttggtggtcctgcttcatgtgtgtgcatgcctgtggctgtggttttccattaagttttgctcttatatatataggtttagaaaaacatttcagggaatcctcagggttccagacatagtcctctttgtccccattatgtagcaacagtacagtatcacctagtaataggactgaattacatcagctaatagaataacccccttctttgactgttgatgtagtgcggtggttcttaggacagttttacctcccaggggacatttggcaatgcctggagacatttttaattgttatgactttcgtgggggtgggggaatgctactggcatctagtgggtagagttcagggatgctgtcaggcatcctgaaatgcacaggacagcccccaagagtagagactgatccagtccaaactgtcagtagtgctaagattgagaaattctgatttagtggtatggaggcagtggtcatgaggtagttgttacttccagttcagtggaactgtgtggaatcattccctgcttgggaaccaaggcctccaatccagcagatatcaaagtcgtaggtacttgaaacaaaacttctgctaatggaatttttaggaataatagaggaactacttctacttgtgccccttgattctcaggcctttgtattctagctatggggaaaacaatattgtatattgctcattgatccactgtaactgagtgagtcttcagtagtccattctgttagaccagctgcttctgggtgatggagtatgtggtaagaccagtgatttccaagttccataacccattcctgcataaccctttttctgtgaaatgagtaccttgatcaaagtcttgttgagtagtataccttgatgatgaacaaggtgtcgcccatgtccttgatggtgatgctggcagaagcactgtaggcagggaatgcatattcatattcagaatatgttggtgccagtgaggacaaattcttgtcccctccatgtatgtagagtttttgttttgttttctttttttaaggtatggtattatccactgtcattaatattttggagcattttacttccacattaaaaaagatcaaaataggtaataattatctgaccaagaaatgttttaaataaattgtagacttatgacagctatatcatctatctaaaaaccttggagtaactgtaaaatagtgacttttgaactgtagactttactcatgcagatatctcactaattttgttgaaatctaccagatagaaatccattgttatgggttgtatggttgaaaactttttaggctgtcatttgtttcaagatacagattgactcggtatactttaacatttctcatagttggccaaatttaggtaaaactatttaatttcattgaacgttttagggaaaatgcctgaatattaatagagataggatgaattaaattaaagaacttaccctttgaaaaattgccagggttagcaatttttatgctaaccctgcataaaaattgtgcgtggtggtgtgtggagtggtgtatatgtttcagagaaataatataaatgttcagataagagtatctgcgtaatctaactaggacctgtctaacctacctgcttaaggatagaggaaatcttgagagacttgaaattgaagaacttaaaattttaagtcttccctttcaaggccctatcaaaacatcatgaccacatctttgaaatagttacttttatcactcaatatagttagaaaattttatttttagaactccaaaatcattttattttattttatttatttatttttttcgagacggagtcttgccctgtcgcccaggctggagtgcagtggcgccatctccgctcactgcaagctccgcatcttggtttcacaccattctcctgcctcagcctcccgagtagctgggactacaggtgcccgcccccatgcccagctaatttttttgtattttttttttttttagtagagacagggtttcgctgtgttagccaggatggtctcgatctcctgacctcgtgattcaccttcctcggcctcccaaagtgctagggttacaggcatgagccactgtgcctggctcattttatttttattattattttttgagatggagtctcactattgcccaggctggagtgcagtggtgctattttggctcactgcaacctctgcctcctgagttcaagcaattctcctgcctcagcctttggagtagctggtactacaggcgtgccgccacgcctggctaaatttttgtatttttagtagggatggggtttcaccatattggccaggctggtcttgaactcctgacctcagttgatcctcctgcctcagcctcccagagtgctgggattataggtgtgagctaccgtgcctgacctccaaaaccgtttttattaattatattctttattaagtatatgtttgataaagacaagcatttttccttttttcactgttacattctttctgtttagaatagtgatttgcggccaggcgcggtggctcatgcctgtaatcccagcactttgggaggctgaggcaggtggatcatgaggtcaggagatcaagaccatcctggctaacaggtgaaaccctgtctctactaaaaatacaaaaaaaattagctgggcgtggtggcgggctcctgtagtcctagctactcgggaggctgagacaggagaatgacgtgaacacgggaggcggagcttgcagtgagccaagactgcgcctctgcactccagcctgggtgacagagcaaaactccatctcaaaaaaaaaaaaaaaaaaaaaaaaaaaaaaaggaatagtgatttgcacatagaagggactcaataaatatttgttgaatgaatgaatatatgaaataaaatcttccatgctcttgaagagaagtatttgtcatgtgactggtcttatatggcagaatgtcccttgtttaccattcctattcccttctaaccaaatcatgatatgtatttttaggtattctttggcatttctttttgaacacctggaaaaatgctaaaatatggtttaaaactcaatgtttgtgaattaggctgttaggtgcagcctgacttaagggataagggctgaattatagagaaattgaattatgctttcaaatatggtacgcatatgaaagtaatacatggttgttttttaaactaggttaaatgtggtaaatgcactcttttaatttagtgttttattaaattttggtatatgttgtgttataagcataaaagtttctgaaagaatttttgtgcctagaaattgtgggaattgttgctttctttaacttttgatttgaaacaatcacaaattacactggattcttaaaaatgttgtaggatctttagggagctcaactgcagtccagatgctgattttttttttttttaatactttaagttctgggatacacgtgcagaatgtgcaggtttgttacatagctatactcgtgccatggtggtttgctgcacccatcaacctgtcgtctaccttaggtatttctcctaatgctatccctcccctaaacccccaccccgcaacaggcccagtgtgtgatgttcccctctgtgtgtccatgtgttttcattgctcaactcgtacttatgaatgagaacatgcagtgtttgattttctgttcctgtgttagtttgctgagaatgatggtttccagcttcatccatgtccctgcaaaggacatgaactcatccttttttatagttgcatggtattccatggtgtgtatataccacattttctttatccagtctataattgatgggcatttgggttggttgcaagtctttgctattgtgaacagtgccgcaataaacataggtgtacatgtgtatttatagtagaatgatttataatcctttgggtatatacccagtaattggatggctgagtcaaatggtatttctagttgtagatccttgaggaatcgccacactgtcttccacaatggttgaactaatttacactcccaccaacagtgtaaaggcatttctatgtctctctctcttttttttttttcttgagatggagtctcactgtgttgccaggctggagtgtggagtgtggtggcatgatcttggctcactgcaacctccgcctgccaggttcaagtaattctcctgcctcagcctctccactagctgggattacaggtgtgtgccaccacacccagctaattttttgtatctttagtagagacagcgtttcaccatgttgggcaggatggtcttgatctcttgaccttgtaatctgcccgcctcggcctcccaaagtgctgggattacaggtgtgagccaccgcgcctggccttaagagttcctgtttctccacctcctctccagcatctgttgtttcctgactttttaatgatcgccattctgactggtgtgagatggtatctcattgtggttttgatttgcatttctctaatgaccagtgatgatgagctttttttcctgtgttttttggctgcataaatatcttcttttgagaagtgtctgtttatatccttcgtccactttttgatgggttttttttttttcttgtaaatttaagttctttgtagattctggatattagcccttggtcagatggagagattgcaaaaattttctcccattctgtaggttgcctattcactcatgatagtttcttttgctgtgcagaagctctttaatttaattagatcccatttgtcaattttggcttttgttgtcattgcttttggtgttttagtcatgaagtctttccccatgcctgtgtcctgaatggtattgcctaggttttcttctagggtttttatggttttaggtcttatgtttaagtctttaatcaatcttgagttaatttttgtataaggtataacaaaagggcccagtttcagttttctgcatatggctagccagttttgccaacatcatttattaaatagggaatcctttccccattgcttgtttttgtcaggtttgtcaaagatcagatggttatagatgtgtggtgttatttctgaggtatctgttctgttccattggtctatgtatctgttttggtttcagtaccatgctattttgtttactgtagccttgtagtatggtttgaagtcaggtagtgtgatgcctccagctttgttcttgttgcttaggattgtcttggctctacgggctcttttttggttccctatgaaatttaaagtagttttttctaattctgcaagaaagtcaatggtagcttgatggggatagtattgaatctataaattactttgtgtagtacagccattttcatgatatcgattcttcctattcatgagcatggaatgttttttcatttgtttgtatcctcttttatttccttgagcagtgatttgtagttctccttgaagaggtccttcacatcccttgtaaggtgtattcctaagtattttattctctttgtagcaattgtgaatgggaattcactcatgatttggctgtttgtctgttattggtgtataggaatgcttgtgatttttgcacattgattttgtatcctgaaactttgctgaagttgcttctcagctaaaggagattttgggctgagacgatagggttttctaaatatacagtcatgtcatctgcagacagagacagtttgacttcatcttttcctattcaaataccctttatttttttctcttgcctgattgccctggccagaacttccaatactatgttgtataggagtggtgagagaaggcatccttgtcttgtgccggttttcaaagggaatgcttccagtttttgcccattcagtatgagtatacctatgtaacaaacctgcacattctgcacatgtatcccagaacttaaagtatttaaaaaaaaaaaaaatcagcatctggactgcagttgagctccctaaagatcctacaacatttttaagaatccagtgtaatttgtgattgtttcaaatcaaaagttaaagaaagcaacaattcccacaacttctaggcccaaaaattctttcagaaacttttatgcttataacacaacatataccaaaatttaataaaacactaaattaaaagagtgcatttaccacatttaacctagttaaaaaaaaacacaacaaccatgtattagtttcatatgcataccatatttgaaagcgtaattcaatttctctataattcagcccttatcccttaagtcaggctgcacctaacagcctaattcacaaacattgagttttaaaccatattttagcatttttccaggtgttcaaaaagaaatgccaaagaatacctaaaaatacataccatgatttggttagaagggaataggaatggtaaacaagggacattctgccatataagaccagttacgtgacaaatacttctcttcaagatcatggaagattttatttcatatattcattcattcaacaaatatttattgagtcccttctatgtgcaaatcactattctttttttttttttttttttttttgagatggagtttcgctctgtcacccaggctggagtgcagaggcacaatcttggctcactgcaagctccgcctcccgtgttcacgccattctcctgtctcagcctcccgagtagctgggactataggcacccagctgtgggtttgttataaatagctcttattattttgagatgctctccatcagtacctagtttattgagagtttttatcatgaaggggtgttgaattttatcaaaggccttttcttcatctattgagataatcgtgtggtttttgtcattggttctgtttatgtgatggattacatttattgatttacatatgttgagccagccttgcatcccagtgatgaagctgacttgatcatgggggataagctttttggtgtactgctggattcggtttgccacaattttattgaggattttcacagatgctgaatttttttctgggaagaatttactttgactttttcatcctacaaaaattattctggttctgaaggatgcaggtgtttcaatggtgtcccattaatatccccaggcttagcacagttcttgcttggttataataggcaattaagtgttgaatgaatgaaagaattttaactttattctgtgggttcagggagctgttgaagagtattaagcaagtgagtggcatgctcacatgttctgaagagtgtttcctggtagtgatatagaagatggatttgaagggacagtaaaggcaagaataataattaagaaattgttataatagggatgatctgagccagggtactcattataggaaattaggggcaaccttgtcatgagatttgtttaggagatgaaattggaaggcttcagatggatgataggggtaaggaggaaaggaggagatttaagtgaataagagttgaggagagggaggagttgtaaatgacaagtttcttgtttattgttttgaataaaggggaaaattgttttcagttattcataaaggacttaaaaatgggctttgatcccaaaagttgttttgaagttatttcctgctttatctttggagacccttcttcccacccccacatcaaagcaaatgccctcaactgctttagatgcagtcttgcattgaaataggtatcacattgttttattttgcttgaatgggtgctgttggcttaaacatctaattgcatctgctttgtcttctttagttgtgtctacttatgggccaaaagagcatttctacctctgtaatttcatttgcatattggttttcagataaattgaagattaattatatgaagtatatggtttgtaatctcaattgaaggtgaattttttattttcctggttgaatataatggaatcattttggtatggagaagaaatggttaaaaatagaccagtgggtcatctcagtgtgaaagtcaagaggacttctaggcttaagcctggtagctaaatttctgttggctctaccctcttcatgatgagtccaagtttattttgatctgcatctttcttttttttaatgaatgaaattctccttcattcagcctggtaagtaacctggccattagtacgtgactaaatagctgaagcttctggcttgaattaagttataaacttagcacagtggcaggtgcttgaactgccatgttaaaactagcgcatagaatctttgccattcaaaaactgttttctcaatcccatgaaggagatgaagcctacatgggaatcttcactgattgtgctgacttttcttctacaatttttagtttataacatgtatagtttgtcaattgtgctaggatattttgttaatatgttcttaaaaattcaaatcccaggggtaaacatcaaataatttaattgtgcctatttgactttatgggagagttaacaaccatatttatatatatggttaaatgtgtataatcttcattctcaatctttcagaatccttattttccattttcatttttagcattagctgcattatttctttatacaactaggaaaagggattattcagaaatttggttgatggctttttattttgtagagacagggtctgtctctgttacccagcctagtctctaacttctagtctcaagtggtctttccacctcagccttcctagtgttgggattacaggcatgagccaccgcactggccagatggcattttaaagaataatgttaggaaaataattaatttttgcaagtgaagatagttgaaatgttagctaaaatgatgacctagaggcagcttgttttggtaaatatcttagtcagtttaggctgctataacaaaataccatagatttggtagtttataaacaacagaaacttacttctcacaattctaaagtctgggaaatccaagaataacattcctttaagcaaggttgaatgtaccagcttgggcgatagtggcaagtagcctcctattccattttgttctagaaagcattttttctcttttctattatttttgtctctttatatgtttatgtgttagggggagaaggagagagaatatttttatatttttcttttggggggatatttttatttttaaattataaatacttctaatttgcaaaggatcccagaaatagttgaagctgtctttaaacccctctctgatcccattctatcctttctgttaactactattctgaagttaatttgtactctgtccatttttatccttttattacatatgtttgtgttcataaaaaaattacagtttaacatttttacataaaaaatgttcttgtaaatattctgcaatttgcttttttaaattttattttttatttttaatttttttttgcagagccagggccttgccttgttgcctaggctgatctcaaactcctggccccaaggaatcctcttaccttggcctcccaaagtgctgggattataagtgtgaaccaccactcctggccttgcagcttgctttttaaacctattctaagacttgctccctatttatacatgagtattaagttaactcattttaactgcacgtataatattctattatcagtatgtcagtttatccatttctggtatagaggaacacttaatttgttttcagggttttttttttttttgcttgtgtttttgttttattataaacaatgcttcaggaagcatatatttgtattcttgaattttttttttttttttttttttttgagacagggtctcactcttgtcgcccaggctggagtgcagtggtgcgaactcggctcactgcaagctccgcctcccaggtttatgccattctcctgccttagcctcctgagtagctgggactacaggtgcctgccaccatgcgggctaatttttttttgtatttttagtacaggcggtgtttcactgtgttagccaggatggtctcgatctcctggcctcatgatctgtccgccttggcctcccaaagtgctgggattatatgcgtgagccaccgtgcctggccttgaatttttatttgacttaaaacatactgtgaaacttgtaagattatgtgaatcatgtttgtacagtttatacttaaaaaaaaaaaaacatggtgaactcttatcaattcacagagtaaaaaacaacattcccaatgctgtggaaacacctctatggcccaaatcacagttcttttcttaccattccccctaccactatcttgaattgtattttaaaatttcctttcttttctttatgtctccatgaacaatgtattgctttgtttacttattttgattttcatgtaatggaataatactgtaagtattctgatttcttttgtaagcatcatttttcttttgagcgttaatctatggtattgtatgcagttcattcagttttactgctatacattagttcattatttgtatatattgtatatatatatatatctgggctattgatgcacatttggattgtttctagttttttgctattactaagaatgctgcttacgaacattgttattcatgtcttttgtgcacatgcaggaatttgaagtatatgtctgggagcagaatttttcattttatggggtatgggtttgtttagctttactaagtaatgccaaatttttctaatttttaaaaatttttaattaattttttttttgagatggagtttctctcttctcccccaggctggagtgtaatggcacgatctggactcactgcaacctctgcctcctgggttcaagcgattctcctgcctcagcctcctgagtagctgggattacaggagcgagcaccatgcccagctaatttttgtatttttattagagacggggtttcgccatgttagccaggctggtctcgaactcctgacctcaagtgatctgtccacctccgtctcctgaagtgctaggattacaggcgtgagccactgcgcctggccaccaaattattttttaaagtgattgaatcagttgacactcccaactgcaatatagaagtattcctattgctctgtgtccttgccaaagcttagaattgtttctttaaaaaattttatggggccgggtgcagtggcttacacctgttcaaggccagcctggccaacgtggtaaaacccggtctctactaaaaaatacaaaaaaattagctggacgttgtggcatgcacctgtagtgctagctactcgggaggctaaggcaggggaattgcttgaacctgggaggcggaggttgcagtgagctgacatcttgccattgcactccagcctgggcaacaagagcgacacttcgtctaaaaaaaaagaaaaaaaaattatgtatctggtgggtaagaaatgttgtttcattgtaatttgaatctgtatttccttgactaccaatgaggtttagtttcttttcggatattcatagagcatttgtgttatttattctgtgaaatgtatttgtgtttcttattctgtgaagtgtctgtatatactttttgcccatttttctgtttggattgtttaatttttcctgattgattcatagcaattttttatggttttagatctaattctcttgttttttgagacagggtctggctctgtcacccaggctaaagtgcaatggtgcaatcttggctcattgcaacctttgctaggctcaagctatcctcccacctcagcctcttgagtagctgggactacaggtacgcgccactgtgcctggctaatttttgtattttttgtggagatggggttttgccatgttccccaggctggtcttgaattcgtgagctccagtgatctacccacctcagcctcccaaagtgttgagattgtagatttgagccacagtgcctagcctagatctaattctagatttgtgttgcaaatatcttttccaatttatgattggattaaaaaaaacttcggtgattgaaattcttgatcttactgcagctgaatttatcagtcttctatgatttatgttttaaaatttttttgtgtcctatcattaagataattctctattttctaaaagttgtttgcttttcacttttacattgaagtctctaatccacatggaaagactttttttgtaaggatccacttttatttttttgccatatgataacagataactgattgttccagcctatttattgagtagtgcattttttctcctgtgatctcagtgcttgcttgggtgaatattaagtgtcagtatatgcacaggctcagtttctagactctcagttcggctctctcctctagtgccagtaatccacttgattatttgtcctgattgtggttgctttataataattcttagtataaagtatggcaggtccccaaaagacttataataatgcctttccatattggttttacagtcagtttattgatttccgcaaaaaatgatactgggattttgaatggtattgcattgagtctttggatcaagttgggaagaattgattgacattgttatgatattgaggcttcctatttaagaacataatatgactttctatttattttatgttttaaaaaatcattccagttaagttttataattttctccttatataaagaacttctacataaaatgtcagtttttcctagaatatttttattatttatacatgatatttaaaaagttatattttctgattgtatatagaaatgaaattaacttatattttgtctttatactttttttttttttttatttaaagaaacggggttttgctatgttgcccaggctggtcttaaactcttggcctcaggtgatcctctagtctcagcctcccaaagtgctaggattacaggtgtgagccaccacatctggcctgtttttgtgctattactgacttatatctagattctttggggttatctatgtagacagtggatgatctacaaatagttgtagctttgtttctttatcttcaatctttttttttctctgtgcatctgttgagggcttttaatgttgaataggggagatgacattgggaagctatgtgttgtttttaattaatattttttttgtacattgacctcttctgtaccttgcacttctgttttgttttgtttggttttgtttttggaatgcagtggcgcaatcacagttcactgcagccttgatcacctgggctcaagccatcatcccacctcagcctcccgagtagctgggaccacaggcgtgtgccaccatgcctggctgatttttgtattttttttttttttttttagagatggggtttcatcctgttggccaggctggtctcaaattcctgagctcaagtgatccacctgcctcgacctcccaaagtgttaggattataggtgtgagccactgcacccagccccagggttgttgcttctttattgagcttgtcactcagtgccttttaactggggcatttagcccgtttacattcaaggttagtattgatatgtgtggatctaattgtgtcatcatgttgttagctggttattatgctgacttgttggcatggttgctttgtagtgtcactggttatgtacttaagtgtgttttttttagtgtctgataatgttctttcctttccatatttagtgctgctttcaggagctctcgtaaggtaggtctggtactaacgaattccctcagcatttgcttgcctgaaaaggatcttatttttcctttgcttatgtagcttagtttggcccaatatgaaattctgggttggaatttcttatctttaagaatgttgtggctgggtgctgtggctcacacctgtaatcccagcactttgggaggccgaggcgggcagatcatgaggtcaggagatcgagaccatcctggctaacaccgtgaaaccctgtctctactaaatatacaaaaaattagccaagcatggtagcaggcgcctgtagtcccagctactcgggagcctgaggcaggagaatggcgtaagtaaacccgggaggcggagcttgcagtgagcctagatcgcgccactgcactccagcctgggtgacaagagtgagactccgtctcaaaaaaaaaaaaaggaatgttgaatatagacctccaatctcttctgacttgtatagtttctactgagaggtccattgttagtctgatgggctttcctttataggtgacatgtcctttctctctagccacctttaacatttttttctttcatttctgccttgaagaatctgatgattctgttttttggagattatctttttgtgaaatattttgtgggagttctctttatttcctgaatttgaatgttgacttctctagctaggttggggaagttctcatgaatgatatcctgaaatatgttttccaagttgctgcctttctccccatatctttcagggataccagtgaatcatatatttagtctctttatataatttcatatttcttgggggttttgtttgttccttttcattcttttgtctttattcttgtctgtcttcttatttcagaaagccaatcttcaagcgctgagattcttttctcagcttggtctgttctactgttaatacttgcgattgcattatgaaattttttttttttttttttttgagacagagtagtgacacgatctcagctcactgcaacctctgcttcctgggttcaagcgattctcctgcctcagcctcctgagttgctgggattgcaggtgcctgccactacacccatctgattttttgtatttttcgtagagacggggtttcaccatgttgaccaggctggtcttgaacccctgacctcatgattcgcctgtcttggcctcccaaaatgttgagattacaggtgtgagccactgcgcccggccatgaaattcttatagagtgttttttagctgtatgaggtcgtttatattcttttctatactggctattttgtctgtcagctctgtatcgttttattgtgggtagcttccttacattgggtttcaacattctcctgaatctcaatgattttcattcctatccatattctgaattctgtttctgtcatttcaaccatctcagtccagttcagaacccttgccggagagctagtgcagtcgtttgttttagaggaaagaagatgctctggctttttgagtcatcagagttcttgtgttggtgctttgtcatctttgtgggctgatgttccttcagtctttgaagtcgctgtttttttttgtttttttttttttatcctatatgatgaccttggatgtttgtggtacaaggtaggttcagttaactggcttcattactggaggggccagggctcatctcaggactcccggagtacatgggtcctccaactctgggggactggcattgggccccagctttgttctctggttctttaaggttaggaacctgctgcactggaggggccgaggtgctcctggacctctggtcacaatactcccgtgggttgtgccagccaaagtgtagggggtggcagtggaatcaattcttgttcgcatgtgccagtagcagtggcagcaaggccacagggtgctggcctccatgtgggcattggcagcaacagtggcagtaaggccagggcggggggctgctggtacacatgcactggtggtggtgttagcacaggggcagggtgctggtgggtgcaggactgggtgtgccctctgtgcacgttcatgctggcttcagtggccggtaaggggtgggggtgggtcctctgttttctctgcctagtttcatgttggtgcaggggctcagtgctggtggggatggcactggtgggctctgtacctgccagtgctcccttgacaatggccatggagggataggcagggtgtactcacgctggctgcagtggcatgggagggtgcttgcacgcatgtgtgctggcggggaagggaaaacaaggtacacctgtgcacacgtgtgggcaaagcatttggagggtggccatgggcgagtgcctgcaggcaaagcagcatggagcagccttcggtgggaggagggtattggcaggctcgtgcttttccacagggatcactgtggttggagcactctgcctgtcagcaccttgtcagtgcaggagctggtatgtggccccccccggcagtactgcaagcatcctggccaggctggagccccatgagagaccagcagactgagggtactcaggtcacaccacccccaccttatgggcaagactgccctgcagagttcaggtctggcagttcctctagggctaaagtctcctatgggagcaagtcgagccttgggggatgggcactcctggccctgttgcactacagatgctccagcaccaaaacctctgagctctgccctggctggagttctgcccctaccacttctctaagcagctttccctgccagctcaagtgtccttggtggttgaggggtctccttgtggtggaggagtctccttctgcagggattccagagtcccctggtgagagtgggttgctgcttccctgttcaactcaactgcctcttcaggagtcactgggggccaggaaaaagtcccggtgcgtggtagccctgtgcagggttccttacttcttccctcgtcagttcagcatctgtgtcttccctctgtcagcactcagtgctttccctctgaagatctgctaagagtgtgccagtcatcctgatcctctgggagatgttcctactggctgcagctagttggccatcttggagccccctccctgtggcttttcatgatttctaataattacattgatgttacattctgtgggctgttcttattgaaatgtataaatttaacaaatcagttgttggtgtaaacttgctgatattttgtttaggatgtttgtatctatgagtaagattggtttgtaattttcttatatagctgttgtctggatttcatatcaaggtgattctagccttataaaatcaattggggagtttatataatctatttaatctctgtgttaactgaagttgtgtctaatatttcacccctaatgtttatttctttattttttcatgtttttttttctgtttgtgtatttcgtttttatttttttgagacagggtcttactctgtcatccagactggagtgcagtggtgtgatcactgttcactgcagccttaacctcctgggctcaagcagtcctcccaccttagcctctcaagtagctgggactacaggcacatgtcaccatccctagctaatttttaaattttttttgtagagacggggtctcaccttgttgcccaggctggtcttgaactcatgggctcaaatgatcttctttcttggcttccaaaagtgctaggattacaggcgtgagccactgtggctggcctcagtgtatttttaaagactcatttctaggccagacttggtgggtcatgcctgtaatcccagcactttgcgaggctgaggtagatggatcacttgaagtcgagagtttgagaccatcctgaccaacatagtgacaccgtttctactaaaaatacaaaaactagctgggtgtggtggcagacgcctgtaatcccagctactcaggaggccgaggcaggagaatcgcttgaacccaggaggaggaggttgcagtgagtggagatcatgccgctgcattccagcctgggccacagagcaagacttcatctcaaaaaaataaaaagactcatttcttagctttttaaactttgttttctgttttgttaattttgttgttacattttctttccttgggtttattctgctatgcatttttcccctaactttttaatgttacttatttatttattttttgagacggagtttcactgttgttgcccaggctggagtacagtggcgtgatctcagctcactgcaacatttgcctcccgagttcaagtgagtctcctgcctcagccacccaagtagctgggattacaggcgctcgccaccatgcccggctaatttttgtatttttagtagagatgggatttcaccattttggccaggctggtctcgaactcctgacctcaggtgatccacctgcttcggcctcccaaagtgctgggattacaggcatgaaccaccgtgcctggccttaatcttatgtttaaatgtggaaaaatgcacataacataaacgttaccatcttaactgttcctaagtgtatagttcagtagtattaagtacattcaccttgttgtgtaaccaatctacagaactcccttcatctcaaaaaactgaaaccctttactcattaaactagaacttcccattcctccatgttcccagccactggaaaccaccattctactttctgtttctatgaatttgactaccctggatacctcaaataagtggcgtcatacagtatttgtctttttataactggcttgtttccgttagtgtaatgtcttcaaggttaatccacattgcagcatatgtcagaatttcctaccttttaaaggctgaataatattctgttatttgtgtaaaccacattttctttatccattcaggacatttgggttactttcaccttttggttattgtaaataatgctgccatgaacatgggtgtgcagataccacttcaagaccctgctttcagttcttttgcatatgtacctagaagtagggttgctggatcatatggtaattctatttgtaatatgttgaggaactgttttactgttttccataggtatatgcactattttactttcccatcagtagtgcacaagggttccaatttctccatatcctcatttacgtttgttattttgtgtctttttttttatttttttgagacagagtctcactctgttgcccaggcttgaatgcagtagtgtgatctgggctcaccgcaacctccgcctcccgggttcaagcgattctgctgccttggcctccctagtagctgggactactggcacctgccaccatgtctggctaatttttgtatttttagtagagatggggtttcgccatgttggccaggctggtcttgaactcctgacctcaagtgatctgcctgcctcggcctcccaaaatgttgggattacaggcatgagccactgcgtctggccttatttcatgtctctttttgatagtagccatcctaatgagtgttaggtggttttatgactttttggtttttttttaatagaggtttttgctctgtcatgcagactagagtacagtatcatgagcatagctcactgcatcttcgaactcttggactcaagcaatcttcctgccttagcctccccaaagtgctgggattataagtggaagccactgtacctagcacgttttctgacttttagagttatatttaagctcatcagttttgaatatttcatttgattgtaagtattcaaagttataaatttattaaatgctgctttaattgtatcctacaagtttcaataattggctttttatttttcaatttcatatttccatataatgttttcaattatgatttctcctttcacctagagtgtttcatatgaatatgaaacatgttatggtttatatgttaccagtaatttcaaatttgaacttagctttatgaccttgaacatatttattagttatttattgttatgttataaattattcccaaatgtagccgttttgtacaacaaacatttattatcacataaagtttctgtccatctgaaatccattagtggctgaactgagtgtttctggctcagagtctttcatgaagctgcagtgacagtcttggctgggtctgtagtaatctgaaggcttgactgggggtagagcatttgcttccaagtaaattcacttacatagcttttggcaggaggcctcagttctttgctggccatttgtaagaggtctcagttcctttctacttgggcttctccatctggctgcttgtaatgtggcagctgacgtctcccagagtgagtgatctgagagaatcaaaagccacattctttcatgatccttagaagttacataccttcctgcttgccgtataatattggttatgcagaacaacccgaataccagatgagagaggatgacacacgggtgtggatatcagaatgtaggaatacttgcagaccatcttggagtctggctaccataagcatacagtccatttttataaagttttcatgtcttcttgaaaatgatatgtagtcccaagttcttgagtgtgatttttacataggagtttgatcaagtttattaagcagttcaactcttctaaattctgattcttttttgtctgctagatcttactactgagaaaggtaagttaggaaatctttcactgaattagtatgtttatgcttttttcttgcagatgtgtcagttttgtgtgtgtgttattaggtgcatagaggcttacaatatcttacagttgatttgagtcctgtatcatcatgtagtgcccctcttgatctctagtcctttttatcttagtccactccagttttctcttgtttctatttgcctgatagatctttttccatttcttaactatcaatatttctgtgcctgtatgctttatgtttgtctcttataaacagttcatgggaaaccagtctgatggtttttttttcttctgcctggagagtttagttcatttacattcattgtgatgactgacatctttggattcctttctgccattttctttttaaaatttaatctaattattattacttttttgaaacaggggtctttctctgttgccctaacttgagtccagtggtgtgatcatggctcactgcaacctctgtctcctgggctcaagtgatcctcccagctcagcctcctaagtagctggaactataggcatgtgccatcttgtctagataattaaaaaacattttttttttttgtagggacagcatcttactgtgtttcccaggggctagtcttgaactcctgagctcaagcgatccacctgcctcagcttcccaaagtgttgtgattacaggtgtgaaccaccacccccagctctgccattttcttatgtgccttttattcaactgtttcatttttttaccccttgagtctcagaatttacctctgggttcattttacttctgcttgaagcatattctttagaatttcttttgatgagggtctgttgcagtaattgctcttactttcctttctttgaaaatacagggccagcgcggtggctcacgcctgtaatccgaacactttgggaggccgaggcgggcggatcacaaggtcaggagatcaagaccatcctggctaacgcggtgaaacccccatctctactaaaaatacaaaaaatagccaggtgtggtggtgggcgtctgtagtcccagctactcagtaggttgaggcaggagaatgacgtgaacctgggaggcggaggttgcagtgagctgagattgtgccactgcactccagcctgggtgaaagagcaagactctgtctcaaaaaaaaaaaaaaaaaaaaaggaaagaaaatacagtagtctccccgctccccccacaaccacttatcagcagttttgctttctatggtttgttgcccacagtcaactgcagtctgaaaatgttaaatggaaaattccagaaataaacaattcataagtttaaaattgcatgctgttttgagtagtgtgatgaaatctcacacagtcctgcttcgtcttacttgggatgcaaatcatccctttgtccagtgtatccacactgtgtatggtacctgcctgttagtcacttagtagccatctcatttatcagattgactgtcatgatattgtagtgctgtgttcagttaacccttattttatatagtaatggccccaaggaggaggagcagtgacgctggaatattgttataattgttctttttttaaaattagttattattgtcgatctcttactgtgtcttataaattaaacttttttataggcatgtatgtgtaggaaaaaaacatagtatatatatagggttcagtactatccctggattcaggcatccactggggctcttggaacttatgccccatggataaggggagactactgtatctttatttctcccttattcttgaatgatagttttgctggatatatagaattctggacagttatgtttccctcagtatgttaaagatactatttcactatctgtctgctatcatagccattgagaattcagttgacataattgcctttattttataggtgacattttctctccagttgtttttttaggtctcctttttgttgtttgttctgtagtttcaccaaaatgtttgtaggtatatggatctctattctgctttgagtttttggacttcttgggagtgacatttgttgttgtctaacagttctaaaaagccattaccttctcaaatattgtttcttttctgtatttctattagttttcttctggaactacaattagatgtatgtaatattgtttgaggctgagccaagtagtgtactgtgattaagtttactttctggtacaactttttgtgtctcctaaatgtaatgtctcatttagcctcatttttttcatttgcttcagtttttatgtagctattgttatttctttccatcattaacacgttctcagtacagtttttcacatagggtcaaacctgttaatctgttcagtgtgaccattttccttgaggatttcctcccatgctagtgtttagaattggctgcttgctataccaggtgtgcagctatcatcctgtgttctcccttcagcatcattttggaaattcctattgcttgtctcctgtgttgattcccttgttttgtggatctcattcatttacaacacaccttccactagcttgctggaaaaaaaaaaaagtacaaaggagataaattttgagaccttgaatgtttgagaatgtctttattctaccttttttgaaaaaaaaattgataatttgtctaggtcttaagttctaatatgaaataattttttttctcagaatttggaaagaatttctccattgccttttagtttatcactgagattattgctaaccccaatgccattctggtttctgttacgttgtcatcaatctgtttattttttcttttctagaatccttggaatttttttttatttgtccttgctattctgcagttcaataataacatgttgggataccaaatgggtcttacttagtttagagactcttcaagtctggaaaacttcttgtgttattctctggcaacgtcttcctatcttatttattaatttttttctttttttcacatgttggaattgattactcatgtaatgttttacatttttttctttcatggtctttcttttgttctttttttgtagaaaatatcttgactttatcttccaactctttaatgttttctttctttctttcttttttcttgagacagggtctggctctgtcgcccaggctggagtgcaatggcacgatctcagcactctgcaacctccacctcccgggttcaagtgattctcctgcctcagcctcctgagtagctaggattacaggtgcctactaccacacctggctaatttttgtatttttagtggagacaaagtttcactatgttggccaggctggtctcgaactcctgacctcaggtgatccacccgcctgggcttctcaaagtgctgagattataggtgtgagccactgcacctggcctgctctctctattttaaaaatagcattctttagtttttttttttttttgagtcagcgtctcgctctgttgcccaggctggagtgcagtggtgcaatctcggctcactgcaagctccgcctcccaggttcacgcaattcttctgcctcagcctcctgagtagctgggactacaggctaattttttttttttttgtatttttagtagagacggggtttcaccgtgttagccaggatggtctcaatctcctgatgtcgtgatatgcccaccttggcctcccaaagtgctgggatcagaggcagcattctttaaatttttaagtattttttaagatactaataatttaccgtattttgaagttttcttctcattcttcattatcttttttctcaaaattaattgtgtgtacttggttctttttctttcatgttaataaggtttccttatacctggtgattctgagctgttttcactttaaatatctaagttttgtttgtttgttttttgagacagtctcattctctcgcccaagctagagtgcggtggcatgatctcagctcactgcaacctccacttcccaggttcaagaaattcttgtgcctcagcctctcaagtagctgggattacaggcatgtgccaccatgcgtggctaaattttgtatttttagtagagatgaggtttcaccatattggccaggctggtctgaaactcctgtcctcaagtgatcggcctgcctcggcctctcaaagtgctgggattacagcatgagtcattgcgcctggcctactcttagatcttaaatgttttacacagacacacacacacacacacacacacacacacacacacacggtaactgtgatgatggatgtgtcagttgatcgtggtaatcatttcagaatgtatacatctattaaattatcatgtagaccttaaattattatttttgtcaattatacctcaagctggaaaaaaatgcagatctactcttaaatgtgagataattggaagctcatgtgcatgggctagggtaagttggtggagaactaactttattgttggaggctttctaaatgtatgtcttttctttgaacattagtttgttccagaaaatattgcgtggttggttgcctgggaagatgtatgtctgattttcggacttggaagcaagataaaggaaagaggctgctggtttatggtatagagattttcactcgttaagaaagtaacaaagtaaggaagtaggattattgtagaaatattattttacagttcaagtttgtaaaacacaggtgaaggtaatcgttggtgggtctcttcctctgagatcaccaaattatctgtagactggttggtagacttggagagaccacttgttcttggacaacagttagaagcatactgccctaagcagtaaaaaggtgattgttgagggcagcaagaggcggtgtaacataccagttcatttttcttttcttagcaagcatgtactaattgccttttaaaactcctgaccataggggataaaacgattacaagaaagataccttccctgctcccatggaatttacattctagcacaacagtggatattaaacaacgtatcatctggttatgtaattacagtaataagaatcatgtaggagaggtcaaggaagcttactgctgtggggttcaggatggcatctccgaaagtatgaataaggaaagtggtgggagaataaaaggagagtggcagagactcagactgagagattaattgagataatgacaattgtgggattcaatgaggtgtataatgtgtttagtgcctggtacttgtgctcagtaagtgctaattagtagttgtttatagcaatactgttatcttggatgatcaaatagaagatccctagcaagtaattttataaagacaaaaatttcgtgtcaactctgtaataaaacaatatatccttagaatcagttatcacttaaaatccttattttatagaaatttttgtgtttcaaaagtatagctagggcaagtcccccttcagggtggatacttaaaggagatgaaatcacttcataaaggtgtctgcactcccatgttcattgcagtgttatttacaaggtagccaagatatggaaacaacctaaatgtctgttgatggcaaattgataaagaaaatgtgtgtgtatgtgtgtgtttatacaatggaacgttattcagcctttaaaaagaaggatattctgtcatttgccacaacttggttggaccttatgctaagtgaaatagaccacgcacaaaaagaaaaatactatataatctcacttatatgtggaatgtttttaaaaagtcaagtatacggagacagagaataaaacagtggttaccttgggcaggaggaggaaggaaatggggttatatagataataaaatagcagatatatagaatgaagaagtctggagagcttatgtataacatgaagactatagttaataaaacaaaactgtattaaggatttttattaagtaatttagctgcttgtaacacttacacacacacacatagtaactatgatagatgttttcactgtagtaaccattttgctgtctatacacatcccaagatatcagcttataaatctcatatacacagatttttttttttaaaggtattgttggggcagggatcaggcttaactttgtggttgtatctgtagtacccagcacagtgcctgacacatagaaggtgttaatcttgttttttttttttttaggtatctgaaatacttaccagaaattctattctttcagatgagagacatctatgtgattttaggtattaataaaagaaatattcttccttttttcttactacggtgttggtagtggtgctctttcttcagggacatcattgatggccttttagttagaatttaaatgttatcctttctgtagccagcagggatctgttgggataaagtcttatttttcttttcttgggagtaattggtgctttctaacttttcagcacttagactcacaatgtattagttatctattgctgcaaaacacattacttcaaaacttagcagtttaaaacaacagacatttattatcccacagtttctatgggtcaggaagataggggtaccttagctggatgcctctggagcacggtctcttgaggttgcagtcaagctgttggctggggctatatcatctgaaagctttactggggcaggggatgatgtacttccaagttcactcccatgattgttgggaggaggacttaattccgtttcttgtgggcttcttcctggtttatgtttgttacctggtgtctagagctgatgtattgggtacttcccctctagcatggttattttctttgttttttctctcatttaggtgaaaacttaggtgaattttaatgtaaaccctacccccattatggtctaaggggccttttagaaaatgagtagaatgtacacagaggcaaaaattttagcctgtgaccttttgaagaattttctaagtgaaactagaaacaaattaaccattgttcacagagtgctttgcttaatgttatgccttcttttgctaaatcctcttgtttgttgaaatcttacatcttaagttgctgatagtttgttaatagagatcataattaaaaggtgattatatttcttcatgcagtttagctttacatttcttccattatacccaaagatttctataatatagcaagaaatgtttttaaaaagtgtttttcctcaattgtgtgaaagtaatgtatctaactgaaaagaagagaaactcataaaagtaaaaattttaaaaaatcaccttattcttacctctcaaatacaatgacctcatattttaaattttgctcaaggttttttcctcctcattctaggcataattattttcttatatgtgtttcagtattactttttttgtgaaaaatatggttacaaatgtggtctaatttcattttgcactttaaaaattattaatgaggccggaaatgaggccgggcactgtggctcatgcctgtaatcccagcactttgggaggccaaggtgggcagatcacgaggtcaggagttcgagaccatcctgggtaacacagtgaaaccctgtctctactaaaaatacaaaaaattaaccgggtgtggtggcaggcgcctgtagtcccagctactcgggaggctgaggcaggagaatggcatgaacccgggaggcggagcttgcagtgaaccgagatcgcgccactgtactccagcctgggcgatagagcgagactctgtctcaaaaaaaaaaaaaaattattaatgagatggtcatatttttatgttatttactgatcacttacctttgaattgccccttgtttcttgaagtttttccaataaatattcttattaataggcaagacaacctgatctgttagttatgtaaactttttggtagctaattgtatgtgcattcttttacctcccgtttgtttctttattagcagtgtctttttgttatagaatttatacattttcttgtaagcaaatatcagtgtttttattataggtgctgtatgtttgtcttgcttaggaaaatctttattactccaatattattaaattattctttagtatttgtcctaatagctttatggctttgttttttttaaatcacacacacacactcacacacacacacggacacacacactctttgagacgggtcttgttctatcacccaagctggagtgctgtggcgcaattatggctcactgcagcctcaacctcctgggctcaagatatcctcccacctcagcctcccaagtagctgggactacaggtgcataccaccacccccagctaatttttaaatgttttttttgtagaaacagggtctcactttgttgcccaggctggtctgaaactcctgggctcaagtggtcatccttcctcagcctccccaaagtgctggttttacaggcatgagccaccacacctggcagcacccatatattttaaaatttagtatgaattagtcttttctttttgatgtggcataattgtattgactaatccattctttaccattgatttgaaataccacctttattatattaaatttgtgtgtgaatatgaatatcttttctgtgattgcaattaatttgtacttgtacagattgtgctgtaagagcttaacagtatatttcagtacttggtcatgtctcttgttcttgtttttcttttcttttcttttttttgttttgttttttgagacagagactcgctctgttgcccaggctggagtgcagtggcgcagtctcggctcactgcaagctctgcctcctgggttcatgccattctcccgcctcagcctcccaagtagctgggactacaggcgcctgccacgacgcccagctaatttttgttgtatttttagtagagacagggtttcaccgtattagtcaggatgatcttgatctcctgacctcgtgatccgcccgcctcggcctcccaaagtgctgggattacaggcttgagccactgcgcctggccttgttcttgtttttcaaaaatttctttggtattctcacaagtttattcttccaaattaacttcagaatcagcttaccattttaaataagcaccccccttctaaatctattataacatctcactactttctcttctattcatattagcttaacttaagctaccatcctctcttgagtaagactgttttctaacatacagcaacaagagggttctttttaaaacataaatcagattatgtcattcctttgcttaaattcgttcagtgcctttttcccctgtcttttggttatctattgctgtataataagctactccaaagccttgtagcctaaaaacaaccattttattgtgctcacaatttttgggggtcaggaattcatgacaggttcagctgggcagttcttctgttccatattgtgttgctgacactggagaatcccttccattatggcttcttcagtcacatgtctggctcctcagtgtttcttggcctctctctccacaatggcgtcccattcttcagaatctctgcatgtggcctcggcttctcacagcatgctgatctcagagtagtcccattttttacatgacaactggcttctaggaagagggaaataaaaactgtcagaccaattaaggactatggcctggaactacacagtgtgcctttaagccgtattttattggtcagaatagtcactggacctgctagatgaaaggaggtagaaaaataaatttcttttcctaatgagggagtggcaaaatcttattgcgggaaagcatgtgggatgagagatacttgacagttggaaaatataatccgtgacatcgtcaaattcaaaataaattcagagttcttaaaatggcctataaggcttttcatgatctgactcctgcttcttgaatctctgaccgcatcccctagattttcctcttcgttccctttgggttaaccacattggccctcttgctaggctttgaacatgccacacccaacatcagatccattttacttgcaactactgccgtgaatgctcttctttagatctttgcatgggtcttcccgttctcattcattcattcattttgagacagggtctcactctgttgcccagactggagtgcagtggcacgatctgggctcaatgcaacctccgcctcccgggttcaagcaattctcccacctcagcctcctgagtagctgggactgcacgcatgtaccaccatgcctggctaatttttgtatttttgggtttcacgaggtttccccatttggccaggctggtctcaaattcctgacctcatgtgatccgcccgcctcagcctcccaaagtgctgggattagaggtgtgaaccactaatcccatggctggtcttcccatttttttacttcatttaggtctctgctcaaatgtcacatcttcagagagcttcccctgaacaccttatctgataaattcttggttacttagaactccttaatcttgatttttttttccttttcatagaatttggtgctgttagtaggagcctggggggcctaagtaccacttttcttccttccctgcctggcttctgagcaagttgagaaatgagtaaaggtggaggccaaaatatattttaaaaattcttctgactaaagggagatgaagtaaagggaacaaaagaagtatcatgaagattctcagatgtccgacatgggaaactgggtagattgtggtactatttaccaagacaggaaacatggtaggaagattatgaattaagctttggaaatgttgagtttgaagtgcctacaagttatccatgtggagaaaccaaatggacatttggataacacatctgaagctcaggagagaagtttccattacagattcaggtttggtagttgttctagttttctattgctgtgtaacaaactaccacaaacagtagcctaaaacacacaaaattactatcttacaatttctgtgggtcggagtcaaggcattgcttagctgtgttctctgctcaggttctcatcagcctgaaatcaaggttttggttggggcctcagtcttatctgaggcttggggttctcttccaggctcattggttgttggcagacggttcaggaatctggggagacaagatttttgggagcgccaacccagatgtttccattccatgtgtcagagtcttgttctttcctagccaggcccctgatctggacgtaggagacctgctgcctttgggagttcaacctttgaagcccaacacatacagatttagatatctaatctgtctgtccatccatccatccatccatccatccatccatccatccatccatccatccaatctgtatatctctgagatatataagtgtaataaatgggcgataatcaagtgctggttttggtccttaggtttctctgccctcctgctgcaggagaggagaatctctgtgttttcagagaggttctctggctttcaaacttagttttcaattggaagttaatcagcttttttgtttttatcttttttctttgaaatcaacatctgggagtgaggagcactgggcaaatgcagtgcaggcccagcaccagctttggccaacccccacggggagcctggagcgagaatgggagcctgggacaagaatggctcttctgagttgcccagaattgcggtggctgatgtgtccaggccttcatattgccatatcaattagtcatttgatgtgggttatcttgggaaggatatgaccttgaacagggttgttccttgtaggtgaggcaatccctgaaggggctgactgacagcactcccagcatttaaggtaagtccttttttgaaggaggaactgggtagcacctcagtgtctaccacgatttctctgtatccaccaaatggccaatttgtttttgttttttattatcattattcattcatggatttaaacatatatttagcaaactttctgttaaattatgtgtatagaaaagggcacaaattgtaaatatacagctcagttaaatgttcacaaagtaaacacaccagtgtaaccagtatccagatcaagaaataaaacaatactgtgaatctaggagtcctcctcgtgtttcctttcagtcactgttttccagggatctatcctgacttctaaaatcatgggttgaatttagcatggttttgaaatttatgtaacatcatacaatatgtcttgttctgacttctgtctgtcagtattgtatttgtgaaattaagctcacaattgtaagtcattctcttgctgtatattttttcatggtatgactataccagtttttaaaaaccatttctgctattaacatttggattgttccagttgttgggaattataaaacatgctgctgtaaaacattgttgtgcatgtcttttggtgaacatatatacatttctgttgggtatatatctagtgaaattgctgaatgtgtgtgtgtgtgttcagttttagcagataatgccagtttccaaggtaagtactgagttacatgcctactagtagctcctaagatttccagttgctgtaatttgctcctgtttgtagaagacacagccttcgagggcttatcactgagaactgtatttactaaggtctccactagcagattctgaactcttttgtcctctcgaagctgcaaggctttcaaattctgctttgcttttcagaagtttttagtttagcctttttaccctcttccactcactgaggcatttgagattccctcacgtcttcagttttgccaatctagccctcagtgaacaccagaatctctgatggtttcttcttccattagaggtacattgcctgggaaaaaagccttatttctcaatctgttttcctgaccagaatctgcaaatgccccaggggaaaagcagctgcagaagatccccttacctcattatagctcactctttttggaatcttagtgttgctaatccctattccttcagtagctctctgaattcttcaaacaggtgatttttatatttcatcttttgttagaaattaagtttgtggtgggagctattgttttgcagtaaattattctatcctacatggaaacagtagtatggatttaaatatatttaatatgtttcaataaattgccatccttaagtgttcaaattattacacttttggccagtgggggcctctttaaaattcattcctaaccatttttggcttgaccgttattagtcagtgctgctatctggtatgacaagatgttccggggtcattatgtcttttttttttttttttcctccagacatagaagcagccatttcctaaaggagtccagattccttttactgggaaatggtcgttcaagattacaactgagtgaggattactatgggattggtcattagtcattactatgggattggtcattgtttctaggcattttcattggacagaaatagaaatatgttttttaaagtacaaaataaaatatcttgacttcatatagatacttctatttcaaattcaagactacatttctttactttaccattacttttatttcccatgctgaaagtcttgggtttttagaggcactaggagtcatagaattaaaataccacagaattatttagttcctctctttataccattaaataattagatacatttataccattaaagaattagatacagttttcagttgatttgtttatttttgatttctagacttcttaaaattttaattttatgtttatgtaagttacgtagttctaaaatgaaatctacaaaaacaatatgtattccatatagaatatggattctatccttttcacttctactttcttttcatttcctaaaggcaaccactaatttttttgagcatttcattcttctactgttttgttttgtttcttaatataagaaacatatatttctatctcctccctcttcttagatgaatggaacatactgtgtatattttctccatcttgttttttttttaacttaagatgtgtcctggagattattctatcatttaatgaatttggattcattttttggttttacgttacattttatacatgtcttttatttaagtgtcactgtgttcatgttatttgctctttcagcatatataaatatatacacttatatacatgtacacacacacacatacacacacacacacacacacacattttttgagacagagtcttgctctgttgcccaggctggagtgcagtggggcttagctcactgcagcctctgccccctgggttgaagcaattatcatgcctcagcctcccaagtagctgggattataggcacgcgccaccatggtcaactaatttttttgtattttagtagagatggagtttcagcatgttggccaggctggtctcgattgcctgccttggcctcagcatatatttttgtatttagaaagatttattcagaccagcgttcatactgtgtaatgataaggaatttattgtagaaattagattgtatacagttttgaggggactaagtgaggtgagtatctggaatggggaattggaggatcagaggagtccactaaccagatcgtccaaatcaatgacaatgggtagataagttggagctgttggggaaatctgagaagtcaaatatatccagccactgaagtgagattatgaaggaggagcttgaggagggcactgtgggaagctcttgccatgtaaggtttgtcttacaaagccctgtaggtttgcacccaagcatctggtggtaggtttgggctagtattggtcagcaaagtgaccactggtccaaagaaagagctggacatggagtgaaagagagagagagtaaaagctggaactttctgggtgcctctgtatctgtctctcattgtatgttactgtgaaaccttcagaataatagctgctgcttcgcttccacatttcaaacaaattttatacaggtcgagtatcccgtatctgaaatgcttgggaccagaagtgttttggatttcacatatttttgggttctagaatatttgccttttactcaccgtgatcatccctaatctgaaatgagcatttcctttgagagtcatgttgttgatcaacaagtttggattttagagtgttgtaggtttcagatttttcaattagggatagacagcctgtacaaattaccctttagaccaactctaaccagaaccatatagtgagtgggatctgggaaagtagttcccagcttaacagttaacacaccacgcaccaccagtacaatttgtgtttttgttctggtggttaccattatattaatacctttatatggtattctaatttccttctcttttggggtggaggggtattatgtgttggttttttactctgagcaatattgaaatgaactagaaacctcctttcctcatctcctttttccctagcattttactctcagttaataacaagacaatcaagaaacatattctactatttatatgctctcaccaccctccctctcctcattttgataattgtattgtatctatattatcaagtacataaagcagtcacctaatatactttctcccttattgccaccattctcagttcttttagaaaacacagtgatgctccggctgggcacggtggctcacgcctgtaatcccagcactttgggaggccgaggtgggtggattacctgaggtcaggagttcaagaccagcctgaccaacatggtgaaaccccgtctctactaaaaatacaaaaaaattagccaggcaatggtggtgcatgcctttaatcccagctactagggaggctgaggcaggggaatcgcttcaaccttggaagcagaggttatggtgagctgagattacgccactgcactccagcctgggtgacagagcaaggctctgtctcaaaaaaaaaataaataaataaataaaaatacagtgatgctccacataatgacattttggtcagtgatggactgcatatgtaatgggagtccctcagtattataatatggtatcattaccttttctatgtttagatacacaaacaccatgtgttcaagttgccaagagtattcagtacaataacatgctgtacagttttgtaccctgtataccatatagcctagaggtgtggcaggctatactatctaggattgtataagtacactctgtgatgttcacatgacagtggaatcatgtaaggacacatttctcagaacataccccatcactaaatatatttaatgattcctattaatgtggatgtctttccaattattctggtcatctgaagcatattctctagtatatcctccaggaaaaggaaaagggaacaaaatttccagggttcttgccgtttagcacagtttgtcattgctataaaattgtctctcagtatctgggacattggttccaggaacctccatggacggtgaaatctgtagatgctcaagtccctgatatgaaatggtgtggtatttgcatatagcctacacacatcctcctgtgtactttaaatcatcccttgattactgataatacttaatacaatgtaatactatataaatagttgttatacactattatttagggaataatgacgaaaagtctgtacctgttcagtacagacatactaaaatttattttttgatctgcagtttgttgaatgcatagatggagaactcatggattcagagggctgactgtatttgaattcagtttggctagatataaaatccttggtttatgttttcttctttttttaattatactttaagttctagggtacatgtgcacaatgtgcaggtttgttacatatgtatacatgtgccatgttggtgtgctgcacccattaactcgtcatttacattaggtatatctcctaatgctattcctcccccctccccctaccccacgacaggccccggtgtgtgatgttccccttcctgtgtggtttatgttttctttaaatatcttaaatttattttactttattgttttctgacataaaattttgtcaaagtctgatgagagtctaatttttgggttttttttgtataaataatgtcctctttctgcctgtaagttcaaaagattttttttttcttgttcacggaagttcaaaatatgttaaggtattggtcattctgggtcacttttccaggtgtgtggtatgcacattaaagatacagtttcaagtttttaaaaatttcaataataatttcagcaaagttttcttgaattctagtttctaatatccactttattccattggtttggtttctttctttggtgactcctgttatatgtatgttgaatcttctttttctatctttttttgtcactttattgtaaatttttattatctcgtatgtaatttcttttttatattacaactttcctccttagtccccccttttttttcaacatttgtttactcttaaagcattatcttctgtgttaatttactcttatgtatcttctggttagttttcatttctgaaatgatttatcttctaattctttcttgagttctgtcaacttatttctatctgtaattcttatttgtgttattccacatcttttgtcattttcttaatttctcttggctcactttgaaataataatttacagttttcatctgttggtggatatgtctttttggaaactttgattttctgttgtttagacccttatttttatgtttttctgtttcttactcctttttcttaataataactttacatattatttgaccatagaacttttctgttggcttatttttatgtgaaattaatttttctgaattggtaggagggatttgtaggccaggatagctttgtagctttatgtctctagagcttattctttttttactttcatgaaataaaaaaaaaatggtctcattctttcagagatctcttgttcatctctctctttttcatttttatttggacctttttccttttctccctttacccctgttttcagtttggagttcattctcagcagtttcttctcagtgtgggctagaactgtgctgtccagtcagatctaataattacatgtgtggctacttaaagctaaatttaaataaactttatttaataataacttaaataaactttaaacttttgatttcttgtctataccagctatgttacaagtggttaatagctacatgtgacgactagtggctgttgtattgggcattgcccatgtagagcactatcattaccacagcaaatcctattagacagtgatgcttttgagtgtgctccattctcttgagacttttatcataggcctttttcattcatctgcaaattgcaatgagcataactaccctctgttttggctaatattcctaaattgggctgctgtgctttttattaaggatgcagtacattgggaatctcctcttgtcagatccattagacattctccttccacctgctttctcttgcatagatgcttataccacattagtatttttgttttttgttttccagacacaggatctcgctctgttgcccaggctggagtgcagtggctagatcacagcaactttctgggctcaagcagtcctcctgcctcagcctcttgagtagctggattacaggcacacactaccaagcctagattttttttttttttttttaaagtaaagatgaggtctcactctgttgcccaggctggtcttgaactcctggactcaagcagtcctcctgcctcagcctctcaaagtgctgggattacaggcatgagccattgcgcatgtccccaaccagttttgtaactataaatggtttgtttctatttgttcacttctctgggtttgggaatgagggaccttgtcccttcattttcatgtagatattcatcagtttgtgtttttactagagaagttctagtttctttgattttttttttttttttttttttttttgagacagagtctctgttgcctaggctggagtgcagtggtgcgatctcagctcactgcagcctccacctgctgttcaagccattctcgtgcctcagcctccctagtagctgggattacaggcatgtgccaccacgctcggctaactttttgtatttttagtagagacagggtttcaccatgttggccaggctggtcttgaacttttgacctcaagtgatccacctgccttggtctcccaaagttctgggattacaaatgtgagccaccgcacctggccatttctctgatttttatgggatacttagggagattcaccagctgcattttatgaaaccctagttcaagaaacatactggaaaaggagatatggtcacaaagaataggagatgtttctaagggaaataataaattaaaatgaaagttacagtgacttgtgctcactgaatctaaaacccagctgattaaaaatttggcaaaataaaattaaaaaggttatctgtgctcgtaaacaaaagtcccatttttggcctttcaggtttttttcctccataatctttataattaacattacgaagttctgtagtttctgttctgccccctcctttacactctaaaaatgctgccccaccccgccaatttcatttagtatttccttttttttttttttttttttttatttgagatggagtctcgcccgatcgccaggctggagtgcagtggcgtaatctcggctcactgcaatctctgcctcctgggttcatgccattctcctgcctcagcctcccgagtagcttggattacaggcacgtggcactacacccagctaatttttgtatttttagtagagtctgggttcaccatgttggccaggttggtctcaatctcctgacctcgtggtctgcctgacttggcctccgaaagtgctgggatgagccaccgtgcccagcctatttagtatttctttactatcaaaataatcgtccattattaactgatttagcaaacttgggcatgcccctcggtctctttccacctttagttgtactatgttaaaaatgagaaagttatattcaggtttgtttttttcacagaggaacattgctaggtttctctgttagcattagcagggtttaatattaacagtaagtatgtccatgatgctttaaatacagaatgctatttttgagcagagtagagatgaacttctagacagtggaacttaactcattcacagagaaatgtaaatgtggtcttctcatagaatattttttctcatgggatttgtctgcttgtgttctgttatcccttcaattgtgtagctgagggtgcttatcttactgagtgagtcttactgttttttccccaggttttatagtttgttcttgcttctgaacaatcagcagttgtttgccattattgacaagaagtctagggcatagattttcttgatctgtttttcttttaatgtttgagttcaatggataagggaaacggttgtatgcattttattgcagacattctctgaaataatttttagccacaagcaaatagctctgtttctgtgagtcatcatttcttcttatatagtgctggataaagaattctattttgtagatagagatttatgacttccagaaagaaagctgcaaaaatggaagtttccaaagaatttaagatttgctataataaatgctatcatatattggtgtttgagatgcaaatgtacatatctgtgtatcatatattggaggttgattgaaaatcggagtttgagatgcaagtataggtatctgtggttgatgcagttttcctaaaacgtcatgattttcaatggcaagtaagttatttatggtcgtttttaaggataagctgttaacgtgttttttttttctttttttttcagcttccaataaaaacaggacagcagaacacacataccaaagtcagtactgagcacaacaaggaatgtctaatcaatatttccaaatacaagttttctttggttataagcggcctcactactattttaaagaatgttaacaatatggtgagtatttgggttactgtgttttggggaatttgctttcttttctttttgattaaaaagtttagaacagcatattttgaagtatggaaagtgattttctgtggactttggatataaccattaatcttattttgtttacgagcacagataaccttttaattttattttgtcaaatttttaatcagctgggttttagattcagtgagcacaagtaactgtaactttcattttaatttattatttcccttagaaacatctcctatcttttgtgaccatgtctccttttccagtatgtttcttgaattaggatttcatagagcttttgtggcctacacgaattgaccacagtaatccattacacatatttttctttagcatcttgtttgaatttacttacggttgtcccagccctaagtagatgataaaatatgatctcatagtcctaaaatgtggattgatttttttatgaagatatgtgttttttcttccttctgtaacctgtgacagattctgtagtagttaccctgttgttgaaacagtttttctcaaataccagtttcatcaaataattccactgttaaaagctcataatttctttcttcttcccattttctaaaatcgattgacgtttcctagacttcagagtactccagctgtcctccctctgtacctttgaacatataacatcttttgtctttctcaagtgatcccttcctctctctaaattcctatttaacatctccattctaagctgtttcaaactaacatactcagttcatggcaactgatctggatttttcttgattaactctgaactctctgctggtgtttagcatttatttatttatttatgaatgaataaatgaatgaatgaatgaatgacagggtctcattctgtcacccaggctggagtgcagtggcgcaatctcggcttactgtaacctcccccttcccagttcaagtgattttgctgcctcaggctccccagtagctggaattacaggcatgtgccaccatgctcggctaatttttttgtatttttagtagagacgaggtttcactattttggccaggctggtctcaaactcctgacattaggtgatccgcctgcctcggcctcccaaagtgctgagattacaggtgtgagccaccgcgcccagcctgcatttataatcccagtttgtatttgtttgtattgagttgtgaaacaacttctggttatagattgtgaagattgttcccccttccttttttttgagatggtccttaggtttattagataatattctagtatgacattgaaaagacatgaagttacctttttgccttattcccatattttagataatttttctcttgttctattttatttttaactggcatacaataattgtacatgtttatgggtacatattgatgtttcaatacatataatacatagtgatcccactagggtaattagcatatccatcatctcaatatttatcatttctttgtgttgggaatattgaatattctcttgttatttgaaactatataatgttaactgtaggccaggcatggtggctcacgcctgtaatcccagcactttgggaggccaagacgggcggatcacgaggtcaggagatcaagaccatcctgtctaacatggtgaaaccccgtctctactaaaaaaaaaaaaaaaaaaaacttagcggggtgtggcggcatgtgcctgtagtcccagctactcaggaggctgagacaggagaatggcgtgaacccgggaggcggagcttgtagtgagccaggatgcgccactgcactccagcctgggtgacagagtgagactccgtctcaaaaaaaaaaagttaactatataatgttaacatagtcattctacagtagtacagaacactaagtcttattcttcctataaagctatatttctgtatcctttaacaaatctctacccaccccgattctccctacccgacccttcttacctctagtgtcctctcttctactttttactctttttagcttccacatatgagtgagagcatgtggtgtttaactttttgttcgcatcatccttggtgtgtttccttttaagaaagttgcttacacaataccctaaacttacaaaactaataaactggaggtgtagaaaatcatttaccttctttatggaaaaaattagtattttccccccaaaagcaggaccatttataaataggtaaagagatttacggaaagacatttaacattttttgtagctcctctgttgcagtgtgtggggcacagtttagtatttgcacatatgaatatgtggctgtgttcccagttatattgaaatattttaatatttgggaccctcttttcaaaacaaaacagcattgttatattggcgttcatttagtgcttattaaataagttttcaaaaccatagtctcttgttaataaatacatatgtagtattcattttgaggatagtgagtacttaaaattcactgtggtgctatagcatgtttttgctataaaaattaagactttgatcatttcgtggcataaaagtatagttaaatccccaattcaagattctggtacaggtctatatgtgtgtctaaatcctacatatttttaaagcatgaagcaaaacagcatcttttactgttacaaggttaatggcagactctaataaatgccatttctgtttgccttagactttagtttttatgaggattaggataaaatcagaaataatatatttaagtatagtataatctgggaggtaaaatggaagactattgttgatcttttagtctttcacttttcagatgtgtgttgattggtagcagaaagtgaaactaacttttatgttctgaatatcttttctgttagagaatatttggagaagctgctgaaaaaaatttatatctctctcagttgattatattggatacactggaaaaatgtcttgctggggtaagtaaattgatcttaagtaggcaggctttgtgaatttgatcttgagaatgatcttatgtcccaaagtacagatgtggaccaagaggacagtcctatggacttttgtctgagacatataaatatgagttttgttaatatagctgacctggtgacagacaatttttcatgagaaaattttctcatcttttgtaaattaaacagatattaagtttacttataaaatgttatgtttcagccacgtatctgtctctcaggtttttaggaaaatattttatgaagagatcactatttgatttaacggatctctcagagagttgtgggagagtgcgattcagaagtccaagagtaatcttgtatttcctcctatatgaatatgattttaatattctacttttgaaatttatgtaaatgagaacttaaaaattaaacctattaaggatagatgttaccttgagaacacttgttttatgtagacacacaaatatgcgataggtatgtggaggaggagagtaccaaacaattatttctctggtttcctgtaagttgttaccacagtgtatttcaaccatgacttaatttgaactttttcaagagtatttctattgtgtaaagaaagtatttctatacatcattatccttaattcttcctggaacatggtaagagtttatataaatatataaattaaatacctctgttttaatgatctgcctaatccatgtgtattgaaattaactcatttcttatgttctctcttcctttggctcagaattcagaattttgttttgattcagaattgcttccctcttcacatatgttgcagttctctatagtgaaactagttgaaagagaccttaatatatgaggactgatagtgtggttgagaagtgttggtggaagcattggggtagggcattgaaaaaaaaattatattgacacaactgtgtatccctagggaaggctgtaagcgaaaaaatgtaagcataatatgtatatatatttttcttttgagacagagtctcactctgcggcacaggctgaagtgcagtggcaccctctcggctcattgcaacctccacttcccgggttcaagctattctcatgcctcagcctcccaagtagctgggattacaggcatgtaccaccatgctcagctattttttttgtattttcataagccatgggggttcactatgttggtcaggctagttttgaactcctatcctcaagtgatccgcccattttagcctcccaaactcctgggattacagatgtgaaccactgtgcctgccctaagcataatattttaaattttcttattgaccgttgaccatattccaaaattgtggagacagtgtttataagttttctacttaaaatcgaaggtgagctagttgttttagcatggtattttccgttaacttgtgatatgctattgttcatgtgtaaaatggagtgaaagagcaaaagagctgttacataggatgatggaactgggaagatgggcaaattttaaacttttcttgaatcagttttttccagtggtcttattactttgactgcaaattaccagtatatcagccacacccatgactgaatggtggggcgtggggtcatatattgccttgttcagtttcacagcttttctccattaacatttgtaattgagaggtaataatgaatgtattttggagaatgattaccgatattattggcctctgtttgatttaatactctttgaagatagcctaattgaaatgctaataagtgggcctagtataacttatgtaatgcataaaatgtatattatcttgccgtgctctactgttgaaaaatgtgtatgctttttcattaaatttactatttaaaaagtaatgctatttatattattgaacaattgttttatttccttcagtgattttacagatgtttcttgattcttacttttaaatcaaagtaaattgaggcagtttaagaagaacggagctcacaagtatacgtttgttatacatagttggaatatttaagtgaaagaaaaatacttaccaatatgttatgagtgcaattttgtagaatttgaggaatcttaagtatttttgttcctgtgaatatgactattatttaaaagatttaatacttcttagatttttatttgttagagttaacatctgtattgtttggttagcctataaacaagaaataggcattgtaatgtgaattcacaggtttttgtgaagtctgtttatgtactgtccctatgtttcagtgtatttgcatctgagagtgcttggattgcagttacagaattgagcgtagcatacaattgtacacatttttgttctttgccatcttgctcagtgttattaaaattcttatccgcatgtagttatcaagactgttaggtgaaatagtaatgtggaacagcatacctacaggatagcttatccattgattgtgtgttaattgtaaagtatatatttacaaagtagagatttcactgttaacaccgaagttatcaaacttggtgtcaataacaggaccacctggccttatgttctcatggtgtgatgtaatataacctatagtgaatcccctaaactgtttaacctcaatctaatcagaccattaggtttaaattttagcttacagaaaatatacaggccgggcaccatggctcacgcctggaatcccagcactttgggagatcgagacaggcggagagcttgaggtcaggaatccaagaccagcctggccaacatggcaaaaccccatatctgctaaaaatacaaaaattagccagatgtggtggcacatgtctgtagtcccagctacttgggaggctgaggcaggagaaccacttgaaaccaggaggcagaggttggagtgagccaagattgcgccactgcactccagcctgggccacagagcgagactccatctcaaaaaaaaaaaaaaaaaaaaaagaacgaaaatatacaatacagtaactagaagagcaaatcaacctatgtcactggaaaataattaaatcaaggatatggaacattctgtaaggcagctggcccacttaaagtcatgggaaataagagtggtgaatatgggccaggcgtagtggctcacgcctgtaatcccagcactttgggaggccgaggagggcggatcacttgaggtcaggagttcgagaccagcctagccaacatggcaaaaccccgtctctactaaaaatacaaaaattagctgggcatggtggcgggcgcctgtaatcccagctattagggaggctgaggcaggagaattgctttaaccctggaggtggaagttgcagtgagctgagattgcgcccttgcatagaatagtgaaactaaggaaacatcatgttgtaatcggtgaacttttttggatccttattgaataaaaatgcctatgaaagacattttgggggcagtggtgaaatttgaattcagacttggtattagatgatacaagggaattgtttatttttccttggtgtgttaattgtattgaagttacattagagaaaattcttttaagagatgccaaggcacatggggtgaagtattctatttataatttactttgaaaagatttcaaccaaaataaaattactttgagtaggtagtgtctgttttggtcagtctgcacaaaagcaagtgtgatggctcacccaggaatttacttaaatgtcaagacagatgacacaatgcactcatcaatcaatatgaattaagtcgattctgtaattgtagaactcacagcaaactggggattcccagggaagggctcgtttggtgaacaagagagcaagcaggaatgggaggactggtaaggatggcagggggattgaactttaattgtgattatggggtcagagatggaaccatcctctttattaaactatctatagacagatgtagcaaatatgatgaaacgttaacagttgttaaatctaggtggtgtgtatgtaaggtgttcattatttttgttctgtgtgtgtgtttgaaaattttcataatagaaaatgtttacaggtaaaattaaagtttagaataatgtgattatttctattttagcaaccaaaggacacaatgagattagatgaaacgatgctggtcaaacagttgctgccagaaatctgccattttcttcacacctgtcgtgaaggaaaccagcatgcagctgaacttcggaattctgcctctggggttttattttctctcagctgcaacaacttcaatgcagtctttagtcgcatttctaccaggttagtgtgtaaatccacatgggactactgaagtaatatgaatattagaagttttgttttttgtctacataaaaataaaaagttaatggaaatgaggtttttttgtttttgagacaagttcttttgcccctcacagcagctttgacctcccaggcttaggtgatcctcctacctcagcctccagagaaatgagtttgtctgggcttgcgtagaaattttatgcattaatatctttgacattttaattgcgtaatattgtgatattgatatgtgcaattaaataagagcactgttatgaatgtgaaagtctaaatttcagataaaaatatctgccgtgagcaggctttaaaaaacaatactaggtatgaacttttggtttggctttttaaacatattatccctttaaatgaaactacccaattagatggaataattaatgagagtagtcagaattcaaatactttcacaactctaccctttatcacaagattttaggttaccaaaaaacaaaacaaaaacaaaaacaaaaaaacctaagtgatgtgaaaacacaaggaggtgaataattgcaaagtagaattctccagaaagtggactacattttaaatgtatgtaaaatactgccatttattgagtatttatagcatttcctttgctgtctcatcctcacagtaaccttgatgatacttccctcattttacaggtgagcaaactaatactcaaaaaagttcaggtgatgtgccaaataatggaggacccaaaatttctaagtcaggctggcttcagaatttatattagtttcactataccagattgcttccctatctattttagccacattttgatgaaatctgttttataaaatatacttctgtttttaaagatgtatcaaaaatataatttaagcttttattgatgactcaaaatcatcctgagcattagttgtgatatgctacctacaggtggagaaattagtataggtagtgctctatgggatagaattataagtgacagtagcaagtagctgcaaattgttgttatgcacatgatttgcctttctaaggcaagtaaagtcagatgggttattaacttaattagaaactatagcacaaattatttagtgattcgtgaatcgaagactaataccgaatagagaaaaacaatcctctttgttggtgcctgcatctttggctcgtcagtgttgtacgaacagtggactttgattattcagatttactgattcctttgttgttttccagcaggtgtgaaagacaacatacatcaccatttgagaatttgtgttacggttttttgggggaattgattaacttcagagtcctgcaatctttttaatcaacaatgacatttctataattaagatcctaggcagcaatatttttcaacctcaatgcaattcttgatccaaagaaaattaaagttttatttaatggtatattattgataatcttgggtaatatttacatgatagaaaaatgttttcatgaaatcttttgagcagtaacgttttatattatgaataataatacagtggttgagtcagcaaggtaacaaacacctagagagtaggagggtggaaaattgtatttaataaaaaacgcaaacccttttcatttaggtgactgctaggccggccttactatttgaaacacctgttaaattaaaggtagaaagtggtacaaaaaaacccaaatgtcttgtagtctatcaatgcatgaactgccttatagaacacaacaaatgtgccaccttggaaaattctagaaaatttctagtcaccaaaggttttactttatgggattttgcagcattagcacatgtaaaaataagcaacttttgtttatttcctgaatctagttcactgttgccagaatagaaaccaagtgtctaaaattttattagctttcagaggacagaccactcagaaatggcatctgtgaaataacattgtttcagacaactgcattttcagttccatttagcttgtgtcagaaataggagctgatcttactgaaggatcactcacctaaaagaccattatgatggtttagtttaggttggaacatcttatgctgtcatcgtcatagtattaggtgacttaaaatatgtgtgtggcttgaatggtagttctttctaaagattgatcttatgttttatatataatagatgaatcagtatcatgaagatgtttcgtgtttgtccattctccccgtcaatgtttctcctttaagattaagatttggtttttatatttctgacctttacttttctttaggggaagataggctatagatttatttattttatgtttttgagacacagtctctctctgtcacctagtctggagtgcagtgatgtgaacatgtctcactgcagcctcgacctcctgggctcaagagatcctcccacctcagcctcttgagtagctgggactacaggcacgtgccaccatgcccggctagtttctttaatttttttgtagagacggggtcttgccatgttgcccaggcttgtcttgaacccctgggctcaagggatcctcctgccttggcctcccaaagtgttgggattacaggatgtgagctaccatgcctggctggctataaatcttaagatagctttatttttctctgggagtataccattttctgtggcttatagtatttatgtagcggagtaactgctttctccacagaattactccacaaatgcagttgatctagttgttttgtagtgagaaggtgcttcagaatatctcatttgatataccaccagaagcagaaaactcaatgactttaaaagtcatttggttctttacagtttactatttggttccatacaaatctgttcgttatggtttcttactctttttttaaaaatagttttcagtttttttatatgtctctgatcatttaaaacgtattttacgttctctttagtattgtttaatattgatttgtttgtgctgattcattcatagtgaattgtttcatctcagttttggaatccttgattgcaaagttatctttagtgtggcctgtattttctttgagaatccttgtagccttgggctgagggagtgttctagtgatggttttgcatttgcatttgccaggtgcccagttctggagctatttttttcttaatttctcagtcccagcctgtatgggcagtataaatttgaaccctaaactcttagaaggtaaacagctctaggtgacttttttcactttatccaaagtttaggcagagcagttaagcttctttgtgctggtaggtttttttctttttttctttttgtggggagtgggggcggcagggggagtgcattgttctttctagttcatgttttatgcagggcccaagttagaatcctgaattattagggtacaaggcgtttatatccagtctccatgtggatgttaagccccaagctcctaggttaaggagatcaaaaacctcactcatctttcctttgttgcagggctgggtcatgtacttgtgcacttaactctctggttttcagttttcttcttcttttctggacctatacatttaaaatatctttcagtatgcctagactttctagctgttttagtgataggttttctactgttcatttcttttgctcagactacgctttatttgatttctctgcttcggaaatgatgtttaaccttcacaaaatacctgctctctataagggtaccagactataaaagggacaaaatttttctcccatttttcacaaacaaccacaagagtcaacttttcagaagttggtattgctgatctatgatgttgtgttttctgaggagccgtactccatatttctacgctctttgcagcagctgtggaatttttagcattgaggacaacctcattcccagcttgaaatgctgagcttttcttaccctgatgataggaagagagttcatgtaagtgcttagaatagttgtactgttagctgtagtctaattaaagctaaagtgagtgaaacgagaatttgagaaggaagaataggattgattacattcttatcaactgaaggtttagtgtgatgattaataactcctttgcaaattgcactaaatgattgaaattcaagttaatacatataaattataagaccatatagtatttgtgccttttcaccatatctctattgctgcatttataaaagtttacaatttaattgtgctgcttatattttttatgtctattaatatgaataatgagtatgcctcattaggtagcatgatttaatagattagcaataccaacttttgaaaatctgagtgctgtggttgttggtgtaaaatggaagaaaagtttaatgccttttattaacatttaggctaagtgaatttcttttatcagtttaaaaatatctacatatttgttaagtgttaaatgtttctacgtttgtgataacttcatattcaacataggagaagctggggtttaaacagatattcctgtccttataagcttatgttctgtgaagtagggatattaagcaaataattacataaatacatgtacaaactgtgaaaagtgcaatgaaaaaaggcttactcggttttcaaatacaaagtaaatgtaccctgtgaatataaagtttcattcgtgtttcaaaaatctagttgataaaagtagaagttagtaaaatcaagtttacttattatagttttagtcttaattcaaattatacttttacttgtaattggaaatatgaatttttaaaactattcattgtggaaaaatggaaaaatacacatagaatagtacttcaaatccccatgcatctcttactctgctttaactgtttctggcatgctatggtttctcttcttcccttttcagtaatttaaagcaaaccccagacatcatttcacctgtaaatatttcagtatatatctctaataaatagatttttaagcatttaactataatattgtcatacctatcaagaatcataattccttaatatcatgcattgccaaatttgtgggttttttcattatctcagaaatggcttttttgttttgttcaaattaagatacaaataggatgcgtactttggaattggttgatatttctcctgagcctctgttaatcagtatcatttcttcatttcttcaccttgctctccattttttcccatgctgtttatttgttggactgcgttatttgcctttctacattctgtatttgggtttcattggattcacgttcatttggctggggggggacaagaatactttactgatgatgctatgtggttcctaatgaatcacatcaggaaacatgtcctattattgacttttaatgttatgatcagtgattggatttcgatgttatcagcattatgtattcattatacagtttcccataaatttttcctaatgtttttagtaatcactgatgatcactgcctggattccacttcattgggggctgcaaaatgaaacgttttctattctgtcattcattctttattttaaaattgtgacttctatgaaagatttttgcttcattgtgtgtttagttatcttgcaatacagtccatgtagggaatgcaggatacagacttgacttccattattcgttatcagaatgagttggtaccctaacagttgcgaaaggttacccatgaagttttttctttcaatattataacaggcttgtgtgttttaatttattgtatgtgtttccattgtagacataattcttttgatcctcagattatcccatttttgacagttgagatgcctaaagtgcatacctgtgtgatatttgacatggttctgatagttgttgatagtttcctgttttcaagcccaaggtgacctgccctcaccttgtatatctcttgcccccatcctggaattaactaattttcccaaagaaccctggccgaaagtcggcaatatttagacacctcaatcttaaggataaggatgctacgatgctacgtttactgaattatcatggtttcttttatcatatcccttgtttgttatgttcctttaggtttttataagaaatatttattgccttatttttatatatgtctttactcttatgaactcatctttgggggaagaatctgttgaattcagaatttagggatacccgaagactttttttgtttttgttttttttaagagatagggcccactctgttactcaggctgaagtacagtggtgtgatcacagctcattgcagcttcaaacttctaggctcaagagatcctcctcccttagcctcctgagtagctgggcctataggtgtgtgccatcatgcccagctaatttttgtattttttttagagatgatgtcttgctatgttgcccaggctggtcttgaactcctggcctcaagtggtcctcctgccttggcctcctgaagtgctgggattacaggtgtgagataccacacctgtcccctaatacttaatttgataagttaattttggtttttactttttaggttacaggaattaactgtttgttcagaagacaatgttgatgttcatgatatagaattgttacagtatatcaatgtggattgtgcaaaattaaaacgactcctgaagggtaagtttaaatgtataatatatctgaaaaaaatcactgggtcaaaaactagtatcatgaatgtactaattatattaattgtgctgaactagaacaccaaactggattttataatgacatttccttgtgaaataaccagtaatacaaatgggtaattatttttcaatctttgaaaataatgcagtagagaaaatgagcattttaaatcttggcaatggaaagttttgcttaactacaatttttgttttcaatacagagaatgcaagggtgctattatttcatttttctggaatttgatctctcaagggtggctataggttatagaagctatctgtttagctattgtagcactttacaaagattgtctgtagtaggatatcaaagttttattgcagaatggaacgaggagattgtgatgttatggtgagaggatgaattgagccagagatttcatttctgacatttctgttttcagctctctactgactgactttatagcattacaaagtcccttaaccttccattgccggttttgtctccttgtagaacatgtcagtagtagttccacatggggatattataacacctaatatgtgactttaaagcttgggaagtactttacatgattatgtggattgaaataaacgatcagaaggaattgagatatgttctgtagtaagcagtgatgtgttaatgtaaatcagataccaatgagtattcataaactgagtatgatctgaaggaattgagataaattctgtggtaagcagtgatgtattcatgtaaatcagatatcaatgaatattcataaactgagtatgaatatctaaatttcattttacaaaaaaatgttttttagtttttggcattattagaccctggctaatttagatatgaaaccgtatacagttcacacatatttttatttgtaacttaaggaattgtcaaacaataatatttttaatatctgacctaaaacagattgaattatattagcttcagaaacatcagttctgcaatgtagttttcaaaatacgtgtttttgttttcttaatatttcctttaaactcaataactatctcaccagagatgtaaaaaggcaatacctatataaaggaataatataaagctgtgttctattcatattacccttgttcataatttatgattttaggtcattaccattgtgaaaccaagcaacaattaattcagtaactttaataaaggaaaatataggggtgattttagctgttatgccaagatacaaacatgtggacagcaattattttagattataataaaccaccattgaattaatagttgagatttgcaagattttgatatctattattaagcgttgagcagttgagaaactgaatggtaaaatttagagatctctatgaattaaagttaagaagtattagtgggattttatgatttttcataactattcagtgatgttttggaaacaagtctagtccaggttgcctgtgaatagctgtttaaaacaatagaaatgttcaatccgtaataattaactgaaatgtctcttctgtccaaataagagaaactaattgaatgtgtggataaatgactttcttttatactgaagtaactttcccatcgaatgcggctccctcatgaacataaatttagagtatatgctgataaatatataaagtataaaaccgatattaaataggccagcaaaatatggctcttggtgacagtggtaaaaggaatgcaccctttcagtaatgagtagtaaaggtagtaatgtgttttaaatacaactcaacaagcctttgttgagaaactatgtataagaagccatgctaagtgctgggattacaaaaattaataaaatatggaatctgtccctaaggagctcatggcatggtttatgagacaagtgatgtcattatcaagttatttgcagaaaaaaactatgataaactcaaatagggtgagtgtaaagtgagagaggaagtatatatttgtttgaggggatgagagatgagcaagatgtgaaggtacaagaataggtcagatcattttaataaaaatatggccaggcctggtggctcacacatgtaatccccacactttggggaagccgaggcaggaggattgcttgagccagggcaacatagagagacccccatatatacaaaaaaaaattagctgggtgtgctgacacgcacctgtagtcccagctacttgggaggctgaggtgggaggatcacttgagcccaggaagaggttgaggttgcagtaagctgtgattgtgccactgcattccagcctgggtaacagagtgagatcctgtctctgtctgtctctctgtctctctgtctctctctctctctctctctttctctctttctctcgatatacctatctgtatatagatatatcaatcgatatgtgtatatccagatctgtctatagatatatctgtatcttgatagatatatcgagagagagagagaaacatttgttatattttcagtctgcaccgggccttgcgctatgcagtttgcatgccttttctcatcaattcttacaataaccctgtgacgcaatactagtattaatattatcatctcttgtgtagatgaggaaactgaggcctcagtaaattttcaaagtcacagagctagtaattgttcagtaaagattgagttcacatctgctcgtctctagaacctagatacttgactgctgcactgttgtgcttatgagttacgaagctttattttagtggccctgggaagtgatagaaaggctttgaggtagagaataccttaatcagtattttattttagatatacccctttgcttgaaatttgcaggatggcttggtagagggttacctgaacttctgggacttggttatgcagtaatataagtgaaaaataatgagagttgtggagatccagatgatggattggggtagggtaaggatggggaccagtttgataggtatttaaagaagtggaggctgggcgcagtggctcacacctgtaatcccagcactttgttaggctaaggtgggcggatcactgaggttaggagttcgagaccagcctggccaacatggggaaactccgtctccattaaaaatacaaaaaatgggctgggcgcggtggctcacgcctgtaatcccagcactttgggaggctgaggcaggtggatcacgaggtcaggagaccatcctggctaacacggtgaaacactgtctctactagaaatacaaaaaattagccagtcgtagtggtgggcgcctgtagtcccagcttcttgggaggctgaggcaggagaatggcatgaacccgggaggcagagcttgcagtgagccgagattgtgccactgcactccagcctgggcaacagagtgatactccgtctctaaataaataaataaaataaaataaaaatacaaaaaattagccgggtgtggtggcacgtgcccataatcccagctactcgggtggccgaggcacagcagaatcgcttgagcctgggagatggaggttgtagtgagccgagatcacgccattgcactccagcttggacaacaagaccgaaactccatctaaaaaaaaaaaaaaagaaatggaatacatagcatttgatagtcaatttagatatatgaggttagagagatatcaccaaatattacagaataagctggttagagcagaaaagggaaggaaaggttgatggcagaagagagggtttgaccaggaaaatgataaattcagttttagatcttctgagtttgaggtatcagtaggatgtccaacaagaaacttgtagaactgaaagatactttggctttgagagtagattatggtatataacacatttaagatgtcataaaggtaaagttgttgctaaagagcactgtgaagagtaatgtcattatttggaaatcagtggagggtgagagcaaagagaattcaaaggggtacttttaaaaactgatttggagagttacttatttgcaagtccagaaaaaagactcatctctctcttagacacttacatagatgtaataaaaacctttatcccttcattaaaagtcaacaggagaagttctttgccgagggaccattgccagtaaaatcgcttatagacaggtcattttttccaaacataaatctttttctagatgtggacaataaacttaaagaagaagaaattaaaatacccaatatatttatatggagaaatgtttactgttacttgcgttaaaatgcagtctactattttgaacactccaattagcaaaataaagaaaatgaacatacttttatgatgacaaagataggatgaaggcactttcgtatgctgcttggtgatagcagcatttggcccaaccctagtgaaaggcagcttggtaatctttatcaagggccctaaaaatattcatctctttgactggacacttctagagattccttatcttaaataagcagtgatgtgggaaaagatgttgatatgaaaatatttgttaatgttatttataatagtgaaataacagaaataacctcagtgttaaaactggaaaacattaaataaccagtcacttaatacagtgacttaaatattatgaggggcatcaaagcatactgaaaagaccttggttttaaagcccaattcaatcatttattagatctgtaaccttagacacacagtttgttcatctgtaatactctgaaaacattaagattcaaaaagaattaagtgtatcatactaaaaatacatgatatgttttaatagtttgtgtaatagttactattgcatatagagccatcaaaaataggccaggcacagtggctcacacctgtaatcccagcactttgggaggcctacgtgggcggatcatgaggtcaggagttcgagaccagcctgacgaacatggtgaaaccccatctctactaaaaatacaaaaattagctgggtgtagtggcgcacgcctgtaatcccagctactggggaggctgaagcaggagaatcgcttgaacctgggagacggaggttgcgtgagccaaaattgtgccattgcactccagcctgagcgacagagcaagactccatctcaaaaaaaaaaaaaaaaaaaaaaaaagagtttttactgatacagaaataattagggatactatggaaaagaacaggtttgatacagcttatatgatctcagttatgttaaatatatttgttttctacatgcataggaaaagtggtagaagtaaaaccaccagatgttaactgtgattgtctctgaatgatagaatcattgatggttttaaaaatttcccataaacacctgtgcttttgctttttttttttttttttttttttggacagagtcttgctctgtcgctcaggctggcatgcagtgacatgattatagtacactgtagccttgaaatcctgggctcaagctatcttcccactcctgctttcgaaagtgctgagattataggcgtgagccatcgggcctggccctgtatatgttttccaaattttttaattatactttaagttctggggtacatgtgtagaacatgcaggtttgttacataggtgtccatgtgccatggtggtttgctgcacccatcaacgcatcatctaccttaggtatttttcctaatgctatcccttacctcagcccccaccccccgacaggcaccgatgcgtgatggtcctctccctgtgtacatgtgttcttatggttcatctcccacttatgagtgagaacatgtggtgtttggttttctgttcttgtgtttgctgaaaatgatggtttccagcttcatccatgtccctgcaaaggacgggaacttatccttttctatgtcagcatagtattctgtggtgtatatgtgccacattttctttatccagtctatcattgatgggcatttggattggttccaagtctttgctgttgtgaacagtgctgcagtaaacatacgtgtgcatgtgtctttatagcagaatgatttgtaatcctttgggtatatacccagtaatgggatggctgggtcaaatggtatttctagttctagatccttgaggaatcgccacactgtcttccacaatggttgaactaatttacactcccaccaacagtgtaaaagtgttcctatttctccacattctctccagcatcttttctttcctgactttttaatgatcgccattcttactggcgtgagatggtatctcattgtggttttgatttgcatttctgtaatgaccagtgataatgagcttttctttatatgtttgttgtcttcttttgagaagtgtctgttcatatccttcatctactttttaatggggttgtttgtgtttttcttgtaaatttaagttctttgtaggttctggttattagccctttgtcagatgggtagattgcaaaaattttctcccattctgtaggttgcctgttcactccgatggtagtttcttttgctatgcagaagctctttagtttaattagatcccatttgtcaattttggcatttgttgtcattgcttttggtgtttcagtcatgaagtctttccccatgcctatgtcctgaatggtattgcctaggtttctttctagggtttttatggttttaggtcttatgtttaagtctttaatctatcttgagttaattattgtataaggtgtaaggaaagggtccagtttcagttttctgcatatggctagccagttttgccagtaccatttattaaatagggaatcctttccccattgcttgtttttgtcaggtttgtcaaagatcagatggttgtagatgtgtggtgttatttctgaggcctctgttctgttccattggtctatgtatctgttttggtaccagtaccatgctgttttggttactgtagccttgtatagtttgaagtcaggtagtgtgattcctccagctttgttctttttgcttaggattgtcgtggttatgcgggctcttttctggtttcatatgaaatttaaagtagttttttctaattctgtgaagaaagtcagtggtagtttgatggggatagcattgaatctataaattgctttgggcagtacggccattttcacgatattgattcttcctatcgatgagcatggaatgtttttccgtttgtttgtgtcctctctggctggcatctggcaggtgcccctctgggacaaagcttccagaggtaggaacacgcagcaatctttgttgttccgcagcctctgctggtgatactctggcaaacagggtctggagtggacctccagcaaactccagcagacctgcagcagagggttctgcctgttagaaggaaaactaagaaaggaatagtatcatcatcaacatcaaagaccaaaggtagataaatccacaaaaatgggaagaaaccagtgcaaaaaggctgaaaaaaaaacgagcacgcctcttctcctccaaaggatcacaactccttaccagcaaaggaacgaaactggacaaagaatgagtttgacaaattgacagaagtaggcttcagaagatgggtaataacaaactcctccaagctaaaagagcatgttctaacccaatgcaaggaagctaagaacctggaaaaaaggttagacgaattgctgactagaataaccatcttagagaagaacataaatgacctgatggagctgaaaaatacagcatgagaacttcgtgaagcatacacaagtatcaatagccaaatcaatcaagcagaagaaaggatatcagagattgaagatcaactcaatgaaataaagcgagaagacaagattagagaaaaaagagtgaaaagaaatgaacaaagcctccaagaaatatgggactatgtgaaaagaccaaatctacatttggttagtgtacctgaaagtgatggggaggatggaaaaagttggaaaacactcttcaggatattagcaggagaacttccccaacctagcaaggcaggccaacattcaaattcaggaaatacagagaacactacaaagataatcctcgagaagagcaaccccaagacatataatcgtcagattcaccaaggttgaaatgaaggaaaaaatattaagggcagccagagagaaaggtcgggttacccacaaagggaagcccatcagactgacagcagatctctaggcagaaaccctacaagccagaatagagtgggggccaatattcaacattcttaaagaaaagaattttcatcacagaatttcatatccaggcaaactaagcttcataagcgaaggagaaataaaatactttacagacaagcaaatgctgagagattttgtcaccaccaggcctgccttacaagagctcctgaaggaagcactaagcatggaaaggaacaactggtaccaaccactgcaaaaacataacaaattgtaaagaccatctatgctgtgaagaaactgcatcaactaatgggctaaataaccagctagcatcataataacaaattcacacataacactattaaccttaaatgtaaacgggctaaatgccccaattaaaagacacagactggcaaattggataaagagtcaagacccatcactgtgctgtattcaggagacccatctcacatgcaaagttacacataggctcaaaataaagggttggaggaagatttaccaagcaaatggaaagcaaaaaaaagtagggttgcaatcctagtctctgataaaacagactttaaaccaacaaaaaagatcaaaagagtcaaagaagggtattacataatggtaaagagatcagtgcaacaacaagagctaactaccctaaatatatatgcacccaatacaggaacacccagattcataaagcaagtccttagagacctacaaagagacttagactcccacacaataataatgggagactttaacaccccactgtcaacattagacagatcaacgagacagaaagttaacaaggatatccaggagttgaactcagccctgcaccaagtggacctaatagacatctgcagaactctccaccccaaatcaacagaatgtatattcttctcagcaccacattgcacttattccaaaattgaccacataattggaatacaacactcctcagcaaatgccaaagaatggaaatcataacaaagactctcagaccacagtgcaatcaaactagaactcaggattaaggaactcactctaaaccacacaactacatggaaactgaacaacctgctcctgaatgactactgggaagataacaaaatgaaggcagaaataaagatgttctttgaaaccaatgagaaaaatacacaacgtaccaaaacctctgggatacatttatagcagtgtgtagagggaaatttatagcactaaatgcccacaagataaagcaggaaagatctaaaattgacaccctaacatcacaattaaaagaactagagaagcaagagcaaacaaattcaaaagctagcagaggacaagaaataactaagatcagagcagaactgaaggagatagagacacgaaaaacctttcaaaaaatcaatgagtctcctgacctcgtgatccgccgccttggcctcagtgaaaccccatctctactaaaaatacaaaaaaattagccgggcatggtggcaggcacctgtagtcccagctactcgggagcctgaggcaggagaatggcgtgcacccgggaggcagagcttgcagtgagccaggatcgtgcaactgcactccaacctgggcgacagagcaagactctgtttaaaaaaaaaaaaaaatcaatgaatccaggagctggttttttgaaaagatcaacaaaataaatagaccactagccagactcataaagaagaaagagaggagaatcaaatagacgcaataaaaaatgataaaagggatatcaccaccgatcccacagaaatacaaactaccatcagagaatactataaacacctctgtgcaaataaactagaaaatctagcagtaatggataaattcctggacacatacaccctcccaagactaaaccaggaagaagtcgaatccctgaatagaccaataacaagttctgaaattgaggcaataattaatagcctaccaaccaaaaaaagtccaggaccagatggattcacagccagattcagctagaggaggagctggtaccattccttctgaaactatttcaaacaatagaaaaagagtgaatcctccctaactcattttatgaggccagcatcatggtcataccaaaacctggcagagacacaacaacaagagaaaattttaggctgatatccctgatgaacatcgatgcaaaaatcctcaataaaataatggcaaactgaatccaacaagcacatcaaaaagcttgtccaccatgatcaagttggcttcatccctgggatgcaaggctggtttcaacatatgcaaatcaatgaaagtaatccatcacgtaaacagaaccaatgacaaaaaccacatgattatctcaatagatacagaaaaggcctttgatgaaattcaacagcccttcatgccaaagactctgaataaactagggattgatcaaacatatctcaaaataataagagctatttatgacaaacccacagccaatatcatactgaatgggcaaaaactggaaggattccctttgaaaactggcacaagacaaggatgccctctctcaccactcctattcaaactaatattggaagttctggccagggcaatcaggcaagagaaagaaataaagggtattcggttaggaaaagagaaagtcaaattgcctctgtttgcagatgacatggttgtatgtttagaaaaccccatcgtctcagcccaaaatctccttaagctgataagcaacttcagcaaagtctcaggatacaaaatcaatgtgcaaaaatcacaagcattcctatacaccaataacagacaaacagagagccaaatcatgagtgaactcccattcacaactgctacaaagagaataaaatacctaggaatccaacttacaagggatgtgaaggacctcttcaaggagaactacaaaccactgctctaggaaataagagaggacacaaatggaaaacaattccatgctcatggataggaggaaccaatatcctgtatgtgttttatacttttttttgaaaaagcaagttattaaaagaaaaagctcacaatcattgatgtccaaggcatatttgctgtttatggaatttttctttcctagcagacaactatcgagttttgggtttatgttaggtgtctttacctttcattgcttacagataatattggagcaaaagtaatacgtaaatggaaagttattttgctctgagttgtatttgtgttaacttattctagagttaatttttaaaaattgtgttttttccagaaacagcatttaaatttaaagccctaaagaaggttgcgcagttagcagttataaatagcctggaaaaggtaagttacaacctctctggtattaaaattttgtttttgatgtaaaatttgctgttgttagcatcctgaatcaaaaagttatgacttgagtgatagtttcacattcattttcaggaagaatacattgtaatattattatgaaggaagttagaagtttgtgacattttatttactgtattacaaaaaatcactgtaaagacatgtggttctttatttataggcattttggaactgggtagaaaattatccagatgaatttacaaaactgtaccagatcccacagactgatatggctggtaaggatacgattgattttttttttttttttgtcttttaaatgcctacttgtgacataaaaacctatcatcgttttccaagttatttttgttataaaggtgcttttacatcttctattgtcaactggtgtcaaataggaaatactgtttttctcttacatttctaaattaggcccaaccctcttcctttccttggagcaaacaaagtagtttgaaatgaaggtcagatctttagagctgtgataggatggggtgtttggctctttgttgtagagaagcatgtgctctgaagctttattttgtatttagggagatgtgtataaagtagtaatattctcacctataatgtaagacacaactgcaaggcagagaatacagactcctggagaactttggtaattctttttgggaagctgttcagtctttgttgcttgggtacatcacactttgcataaggcccttcacagtgagactgaatacatgatcatccattctaaaatgtgagcttttccaggatagatcaagatagctcttctaacacatagacagtattacattgcttgtctacttaccagaatgcatttgtgtagttgcttaaatgaagttccatgtttatcttttaaaaatgttgcccttgggtttttacatagtgtcagcttttactttaatgccagggattttgttcctatctaataatgtcatttaatatatttttcatgcagaatgtgcagaaaagctatttgacttggtggatggttttgctgaaagcaccaaacgtaaagcagcagtttggccactacaaatcattctccttatcttgtgtccagaaataatccaggatatatccaaagacgtggttgatgaaaacaacatgaataaggtaaggagggcaaaattatttccattatatctagatgtgaagcagtttattttactcaaggtgtgtattactttaggcttattatttaagcaaagtatttcagggaaccatttaaatgatcattttaggtttctttgtttgatggacttagaagagacatactcatacataattttatttggcagagggaaaataataccaggcaatgaacaaagatttaaaataatcccttagtttcattcttttgtctgagaagactaaacgatacctctgttattattaaacgtagtttctctaatattcactacaaggattgccctacttgagttcatcacttttatagtgtgttatttgcatgtacttagggtatgtgtccatatagtgctactgaaattatctagtaactcattttaagtattttagaacagttttcaaagaattttgccaggaaggtaaggctctcgcatataccatctatagtgaaattggcaccatgacaactggtaattctaggaggctcttaaaatttttttaaatatcacctaggtgattgaaaaaaaaaagaactgagtattaatcctagggttttactgaaatttcaatatgcagtttgttttgcaaatattttttttttcattttttgctgcttttggagaaatactcttagctggctgaacatgagatggtttccttcatggtttgcctgtagatggagatgttcagaatcagctgaatgatttattactttgtagaagtattggaccgggaatttatacattaaagggtaaataaatgaaccaggtaatccttgagagtctgtgattgcgtgttactccacttaggtgtatatctcaacttttccattatgaggacaccatttttcatggtagattgttttggagcccttcaaaatagtaggtttgatgataaatactgagtgtcaacttgattggattgaaggatacaaagtattgatcctgggtgtatctgtgaagttgttgccaaaggagattaacatttgagtcagtgggctgggaaaggcagacccacccttaatctgggtggtgcaccatctaatcagctgccagcatggctggagtataagcaggcagaaaaatgtgaaaagagagacgggcctagcctcccagcctacatctttctcctgtgttggatgcttcctgccctcgaacatcagactccaagttctttagttttggaacttggactggctcttcttgcctcttagcctgcagacggcctattgtgggaccttgtgatcgtgctagttaatagttaatatcccctttatataaatattctattacttctgtccctctagagaaccctaatagagattttggtacaaggagtgtggttctagaggaacggagtattaaggatggagtttcttagtttgtttgggggtttctggagtttgctgcttaatatgattagaccctaaaatattaaggactctacttctaatattgtggagaacactgatagtcgttgctgtgaactgtttagagagtttgcaaaataaatgcatttgacactcctgattcaccgctaatgagaggcaaggagtttagtgaccctatacataataatacctttgaccatatatggagaaccaaggaacataatgaagctggttggttgctcctaaattcagtggacaaagtggtgaaagaaaatgatgggccgggcgcggtggctcacgcctgtaatcccagcactttgggaggccgaggcgggcggatcacgaggtcaggagatcgagaccatcctggctaacacggtgaaaccctgtctctactaaaaatacaaaaaattagccgggcgaggtggcgggcgcctgtagtcccagctactccggaggctgaggcaggagaatggcgtgaaccccagggggcggagcctgcagtgagccgagattgcgccactgcactccagcctgggcgacagcgagactccgtctcaaaaaaaaaaaataaaaaaaaaaaataaaaaaataaaatagaaaatgatgagctcagggattctgtctcctgtcttcagaagcagatactgagcctcaaatctgctaagattgacctgagtgagacccttatctcctgtagaaaaagagctgaaattgtgaaaaaacaaacacaaactcttatcatgcaagtggctgacctgcaacaaaaggtgcatgtacagcctaaccaggtgtctactgttaaagtgtgggcattgattggaaaagaatgggaccctgcaacttggaaagggcatgtgtgggaggaccctgatgaagctggggactctgagtttgtaaactctgatgaaccttttttgccagaagaaacagcttccccatccccagtagtggcaacatcccctccctgagccatgctgccatcagcctttccacttttgtctgaagagataaaccctgcgctgcctgaggcaacaggaatggcctcccctgaggcagttgccaggcaagataatgttgattctcctcagaagccacccccaacacccctgtttgcttctagacctataaccagactaaagtcctagcaggtccctagaggtgaggctgagagtgtgacccatgaggaggtgcgctacactcgtaaagaactgcttgagttttctaatttatataaacaaatcttacttggagagaccttggtcatgtttcacttccacaacatatgacactggtctattacattaatgatattatgctgattggattctgtgagcaagaagtagcaaacgcactggacttattggtgagacgtttgggtgccagaggatgggaaataaatccgagtaaaacttagggaccttctacctcagtaaaatttctagggcttcaggggtgtggggcctgtcaagatattctttctaaggtgaagaatattgctgcatttggcccctcctacaaaaaagaaagaggcacaatgcctagtgggcctacttggattttggaggcaccattcctcatttaggtgtgttactctggcccatttatccagtgacccaaagaactgccagttttgagtggggtccagaacaggagaaggctctgcaacaggtccaggctgctgtgcaagctgctctgccacttgggccatatgacccaacagatccaatggtgcttgaagtgtcagtggcagataaggatgctgtttcgagcctttggcaggcccccataggtaaatcacagcggaggcctctaggattttggagcaaggccctgccatcttctgcagataactactctccttttgagatacagctcttgacctgttactgggctttggtggaaacggaatgtttaactgtgggtcttcaagtcaccttgtgacctgaactgcctatctatgaactgggtgtgttctgacccatctagccgtaaagtgggtcgtgcacagcagcattccatcatcaagtggaagtggtacatacacgatcgggctcaagcaggtcctgaaggcacaagtaagttacatgaggaagtggctcaaatgcccatggtctccactcatgccaccgtaccttctctctccccacctatactgatagcctcatagggagttccctatgatcagttggcagaggaagagaagactagggcctggttcgcagatggttctgcacaatatgcaggcaccacctgaaagtggacagctgcagcactacagcccctttctaggacatccctgaagcatagtggtgaaggggaatcttcccagtgggcagaactttgagcagtgcacgtggttgtgtactttgcgtggaaggagaaatggccagatgtgcgattatatactgattcatgggctggagccagtggtttggctggatggtcagggacttggaagaagcatgattggaaaattggtgacaaagagatttgaggaagaggtatgtggatagacctctctgagtggttaaaaactgtgatgtttgtatctcatgtgagtgctcaccaacaggtgacctcagcagagaaggattttaataatcaagtggatagcgtgacctgttctgtggatgccacttagcctctttccccagctacccctctcctcgcccaatgggcccatgaacaaagtggccatggtggcagggatggaagttatgcatgggcttagcaacgtggacttcactcaccaaggctgacttggctatggccactgctgagtgtccaatttgccagcagcagagaccaacactgagcccttgatatgacatcattcctcagggtgatcagccagctaccttgttgattatattggacctcttccatcacggaaagggcagagatttgtcctcactggaatagacacttactcctgatatgggtttgcctatcctgtatgcaatgcttctgccaagattaccatgcatgggctcaccaaaggccttacccaccatcatggtattccacacagcattgcctctgaccaaggcactcactttacagctaaagaagtgtgccagtgggctcatgctcatggaattcactgtttttgtttgtttgttttttgagatggagtgttgctctgttgccaggctggagtgcagtggcgcgatctcggctcactgcaacctctgcctcccaggttcaagcgattctcctgcctcagccttccgagtacctgggactataggtgtgcgccaccacgcccagctaatttttgtatttttagtagtgatggggtttcaccatgttggccaggatggtctcaatctcttgaccttgtatctgcccccctcggcctcccaaagtctaggattacaggcatgagccaatgtgcctggccacactggtcttaaccatgttcccaaccatcctgaagcagctggattggtagaacagtggaatggccttttgaagtcacaattacaatgccaactagaagacagtactttgcagggctggagcaaagttttccagaaggctgtgtatgctctgaatcagtgtccaatatatggtactgtttctcccatagccaggattcccgggtccaggaatcactcaccatcacccctagtgatccactagaaaatttttcttcccgttcttgagacattatgttctgctggcctagaggtcttagttccagagggaggaacgctgccaccaggagacacaacaacgattccattaaactggaagttaagattgccacctggacacactttgggctcctcctacctttaagtcaacaggctaagaagggagttacagtgttggctggggtgattgaccctgactatcaagatgaaatcagtctactactccatagcggaggtaaagaagagtatgcatggagatccattagggcgtcttttagtattaccatgtattgccatgccctgtgattaaggtaaatgggaaactacaacagccccatccaggcaggactacaaatgacccagacccttcaggaatgaaggtttgggtcactctaccaggaaaaaaaccaccacctgctgaggtgcttgctgaaggcaaagggaatacagaatggctagtagaagaaggtagtcatcaataccagctacgactgcatgaccagctgcagaaacaactgtaattgtcatgagtatttcctcctccttttgttaaaaacatgtttgtgcatgtatacacctgtactaagaaaatatcttcattttatttcctttttcttttatcatatgacttaagatttattgacttcacatcagcattttaagtattgttaacttttagtatttgggttgggataggtgtgtttctggttgtacgaaggataattgtattatgttaggcataattatgactttattgtctttatttaaagattatgtatgatctcaggagatatgtatgggttcaagttgacaaggggtggacttgtgatggttaatactaagtgtcaacttgattggattgaaggatacaaagtattgatcctgggtgtgcctgtgagggtgttgccaaaggagattgacatttgagtcagtgggctgggaaaggcagacccacccttaatctggctggctaccatctaatcagctgccagtgtggctagaatataagcaggcagaaaaatgtgaaaaagagagatgggcctagcctcccagcctccatcttcctcctgtgctggttgcttcctgccctccagcgtcggtcttcaagttcttcagttttggaacttggactggctctccttgctcctcaccctgcagacagcctattgtgggacctcgtgatcgtgtaagttaatgcttaataaactcccctttgtataagtatctattcccttaattctgtccctctagagaaccctgactaatacagtagggtgttttttgttgttgttgtttattggaaaaatagaaataaataaataagctatagattcagtagtactcgagtgaatttacgttttaataatcacaactgtagctttctaagtgtttactggttatttgtgtatcttcagggaattgctgatttttccattgaattgtttgtcttttgttgatttgtaagggtatatgtgtacatttttacttggtttcatttttaaactttatgagttctttttactatatagatatttaaaatttgcatgtagtcacctcagccttgttcctttttgtctcctagcttttttggtcagatctctcttcccagaagatattattcattttattgagatataattcacatatcataaaatttacgtttttgaagtgtaaaattcagcgattttagtacattaacaaagttgtacaatcatcaccattgtttctgtgcagaacattttcatcttcccaaaaagaaacccgttagtaatcactccctgttcctctcgcctcactcgcagcccttggcaaccagtaatctagttttttgtctatagatttacttaattctaaactagacatttcatacaaatggaatcattcagcatgttatgtttttgtctggcaggtgccaagatttttgaagtatgctttttaatttttttctggtattttctagatttaaaagtttagatttttaaatctttctggattaaaaagaaaagtattttttttttttttttttttgagacggtgtttcactcttgttgcccaggctggagtgcaatggcacaatctccgcttagtgcaacccccgcctctcgggttcaagcgattctcctgcctcagcctcctgagtagctggaattacaggcatgcgccaccacgcccggctaattttgtagttttagtagagatggagtttctccatgctggtcaggctggtctcgaactcctgacctcaggtgatctgcctgcctcgggcctcccaaagtgctgggattacaggcatgagccattgcgcctggctaaaaaatgtatttttaaaaatgtattacaaaaaaaaaaaaaaaaaaaagctggccatggtggcaggctcctgtgatcccagctactctggaggctgagccggggagaattgcttgaacctgggaggtggaggttgccatgagctgagatcatgccactgcactccagcctgggcgacagagcgagattccatctcaaaaaacaaaaaaacaaaaaaaataaaatagtattctcacccttttctactcacattccttctgagctggttagtgttattggctggtatgtatccttccagtcacatctatttacccatatattcaaatgcaaaatatacatacgtagggtggtggtggttgtattttaaaatgaaattattttatgcacattactctgcatcgttgtttatctaagaaaatattttagctgttcctcaaaatagttgatagagatctgacacattcctttcagtattaggtaacattctgttacactaatgagcctcatttactcagccatttcactgaatgggtggatattcagatgttttcagttttttgacacttagctaagccttaagtaaatatcttgttcatatatccttgttaactgatgctcttaattctatagactagaatctaaaaactaggggttcctgtgtcaagaacatttgcatttaaaatttgtaatagttattactagatttacattccccaatagttgcagcaggtcagagtttcatccccactgaattgcctattttcctgcatttttgtcaggattagctgttgttaaatctttaaaattttgccacactaataaggtgagatagtatctcatctcaggtattcttaccttctctttcagaggtaaactgtgtgatgtgatggatatgttattaccttgattgtggtactcattttagaatgtataagtttatcagaacatcatgttgtacaccttaaatatatacaatttttatttttcaatcgtacctcaataaagctgaaaaaatgtcattcagaaaggaagcaaacagtagatactagcattaaaaatatgttgtaaattttcaagcatagaatgataacataaggttaggaacaagaatatgtgtatagatttaaatatttatctctgtgaatattaatccatagatacaaatgttgaaggcaagttacaatcttgaagaaaatgaaaattatgttgtgtacctataatatgaaaataaaaaatcacacaaaggcatataccttcactcaaggatgtatactcgagtatacatattatttataatagcgcaaatttgaaaacagcccaaatgtccctcagctggtgaatgaataaaccagtggtgatgccttggaactgtggaatactattcagcaataaaaaggaactactgactcggcaacatgtgtaaatctcaaaaatattatgctaagtgaaagaagccagggtcaagagatgacatactatatgatttcttaaaacttccagagaagacaaaattcaggacagaaagcagatcagtggatgccaggagtgagagttaggggaggaaatttattgcaaaggagcagtaggggattgattgtggtgatgtttgaaatgttctatgtcatgatcgtggttgtagttacatgactattctgaaagttcatatttaataagtgatataaaagaaaaaagtattaatggcttaaacattaattttccaaatgagagcactaattaaaattctcaagtgttgagaacaaagatagtatctcattgtaatttttattctttttaaggttagtgaggtttgaaaacagttcatatgtttctttgccatttgcatgttttcttttgcaggtgcctgttgacttcctttacctattattctgttatgttgcttccagttccttatgaattcgcggaactttttgtatattcagagcagtaatcctacatttttagtctgtaaatgtttttccagtcacctgtttcttttgactatagtatctttttttaaaaagaaatatttgaaatgtacaaagaatgtaacagtttcccatactgctattaacatttttatattttgctcatcttttgagaaatttatatatgtgtccacgaaaagagtcaaactctataaaatattttaagagatttattctgaaccaaatacgagtgaccatggcccgtgacacagccatcaggagttcctgagaacatgtgcccaaagtggttggggtacagcttggtttgatatattttaggaaggcatgaaacatcaatcagatacatttaagaaatacattggtttggtttagaaaggcgcgacaactcaaagtgggggcttccaggccataagtaaatttagacgttgtctggttgacggttgagtttgtctgaagacttgggattaatggaaaggaatgtccaggttaagataaaggattgtggagaccagattttgttgtgcagaggaatctctcagcagacttcagagagagagaaggttgtaaaatgtttcttattagacctaaaagagtgcctggctcttagtcgattaatctcctggatctggaaaggaaagaaggaaaacaaagggaaaaggggattctctatagaatgtggatgttttttccccacaggagactttgcacggcaaatttcaaggtatggcaaggaaatatattttggggctaaatattttttccttgtctcataatgttatgccagagtcagattgaaaagtaagtcacgatatatagcgtcaaataaaacccatctgatgagaatttatggtttgtagggcatgacttcctagaccccttaggtaggagtttgggcaagttaaaaaatcagagctaagtcctcacatggcttttaaaaattgtgaataagtaatacttccataaattctgatttaattacgaatcccactaatttcttttttttctttcccagggacagccactgcaaagggttaaatgtatattcttccagtctagcttttatatttttatgaggatggggagatagacagataggtatatagttcagtgtttctcaaagtgtggtctttagaccagcagcatcagcgtcacctggaaatttgtgagaaatgccagttcttagtttctaactaaatacttagtttctcactaaaaacagccatttttattaagtccttcaggtgattgtgatgcacattgaagtttgagaaccattgttcatctaggtcattgtctttaactgctgtatggtgttccctaaattgaatataccattttttaaaaaagagactaagtcttgctattatgttgcccaggctggtctcaaacttctgggcttatgcgatcttcttccacctcagccttcagatagctgcaactataagcatgcaccaccgcacccagcttgaatgtaccatattttaaattccatattgtcaagcatttaagttacttttctttaaaaaattaacgttattgcaaaggaaacaattggcagagtgaaaagacaacctacaggatgggagaaaatatttgcaaagtatgtatccagcagaggattaatatccagaatatacaaggaactctgatatctcaacagcaaaaaacaaaacaaaacaaaacaaaacaacaacaaaaaatttaaaaatgggcaaaggacctgaatagacatttcttaaaagaagacagacacatgaccaacagatatattttttaaaaaagctcaacatcactagtcatcagggaaatgcaaatcaaaaccacagtgagatatcatctcaccccggttagaatggctactatcaaaaagacaaaaaatagcaaatgctggcaaaggtgtggagataagtgaactcttaaatgtggctagtgggaatgtaaactagtacagccactatggagaacagtgtgaaggttcctcaaaaaactgcaaatagaactaccatgtgatccaacaattcattactggacgtttatccaaaggaagggaaatcagtatattgaagagacatctgtactcccatgtttattgcagcactattcacaatagccaagatatggaatcatcctaagtatctaacaacagatgaatgcgtaaagaaaatatggtatatatacacaatggaatagtattcagccataaaaaagaatgaaattctgtattttgaggcacgtggattgaattggaggacattatattaagtgaaataagccagggacagaacattaaacactgagtgttctcattcatatgtggaagctaaaaaaaagttgatctcagaagtaaaaagtagaacagaatactacaggctgggaaggatagggtgcggggagggtagggaacgatttgttaaaggattcaaaattacaactagataggaagagtaagttctagtgttgtataccactgtaagatggctgtaattaacaatatgttacaaagtttcaaagagctaggaggaggatgttgaatgttcccagcacaaagaaatgataagagatgatgggtatgctaattaccttgatttgatctctgtatagctatgaaaatgttactatgttcttcataaatattaatacatcaaaaaatttaaaattaataattaacaaaagataaagggccctgaactctagttttagagctgaattgtatccagtcagatagtttctatgttatttaaatgttcactttaaatttggagctgaaatatatttggaaatctttacttttagtatgttcatttgtgtgtgtgaggtaaacttggttggctattggcaaatgtattgggtagctgcttaataaaacatttccttccagtgcttcagctttctgatgcttagaaaatatgtataattaacataatatgcattatcacttttgaaagtaactaattattcgaacagttatttgtgccaaattagtaatgtgaatttgggaactatcagtcttttctatggcccggaataatttaaataatagaaattatctgattagatagaaatcattgtaaaatcatcaaggttaggatttcctttgacttttgcttatcattagttttaaagaaaaaaaataaattgacataatggaaattttcactgtacatcaggaagggaattcagtggaaaagtaagcttcctattcactcttgaccttcagtttatactttttttcctaagtcaagtactgctactggtttcttatgctctttctagaactagcctgtttattgtctatttaaaataactcattaatcaccttttatttgagctcccttatggatctgtgtagtttttctgtctctttaaaattttgtatgcggtaaaatgcacgtaacatcaaatttaccatcttagccatttttaagcatacagtttagtagcactatctttcacatcgttgtgcaatcaatctccaaaacctgttcatcttccaaaacaaattctgtatctattaaacagctctccgttcttccctaccctcaactcctggcaaccgtccttttactttctgtctctctgaatttgactacctcatataagtggactcatacagtatttgtctttttgacatgggcttattttacttagcataatgtcctccagttccattcatgttgccttgaaagacaggatttcattcttttttttttatggctgaaatagtattcatccatgttgtagcatgtcaggatttccttcctctttaaggctgagtgatatattccattgtatatatataccaacattttatttatctaaattcatctgccaatggatttttcagttgtttccaccttttggctattataaataatgctactgtgaacatgggtgtacaaataacttcaagaccctgcttttaattcttctgaatatatatccagaagtgtaatttctggatcatatggttattttatttttgattttttgaagaatttctgttgtttttaaagtcacttttgatggtttgttctttgctagaaaatatatatttcagttttatcagtgcagagttgtatataatacttacatattttgtacaattatataaaggttatattatatttccatattctcatataattatctttagtatccatgtttgtaactgtttactcatttctctttcctcattcacgtttactattttattggtctttaaaacctaggctttgattttgtttcctagcatttaaatttttctgtttcattaattttagctttcattttatttatactgttatttcttgaggcaatggcttggttcatctattttcagtttttaaaaaaactgtaaagtatttgtaaggctctaaattttattttattttttagttataggaatttttaatatattctggttattcaccccttatgagatacattatttgcaagtattttctcccactctgtggattgttgtttcatcttcttgatagtgtcgtttgatacacaaaagtttttattttgatgaaatccagtttatctgttttttcttttgttgcctgtgcttttttggtatcatatacaagaaatctttgccaaatccaatgttgaaaatatttttttttcctatattttcttataggagttttatagctttactgttaagttttggtctttgatctattttgagttaatttttgtatatgatgtaagaaaagggtccatcttcattcttttgcatgtggataatcagttttcctagcatcatttgttgaaaagaccatcctttctctattgaatggtcttagcatctttgtcaaaaattggtcatatgtgtgagggtttctttctaggctctctattccattggtctgtatgactgtgcttatgctagtaccacattgttttgattactgtagctttgtagtaagttttcaaataagaaagtgtgagttctccaactttattctttttcaagatagttttgactattatgcggctctttgagattccatatgaattttaggatgggtttttcctttttttttttgagatggagtctcgctctgttgcccaggctggagtacagtggcgcgatctcggctcactacaagctccgcctcccagggtcacgccattctactgcctcagcctcccaagtatctgggactacagggacccgccaccatgcccagctaattttttttgtatttttagtagaaacggggtttcaccatgttagccaggatggtctccatctcctgacctcgtgatctgcccgcctcgacctcccaaagtgctgggattacaggcgtgagccaccgcgcctggctttttttttttttttttttgcaaaaaataccattgggattttgatagggattgcattgaatctgtatattgctttgggtaatattgttaccttaacaatctaggaacgtgagatatctttccatttatttatgtttaatttctttcagcaatgttttgtagttttttattaagtttttcacctccctgattaattcctatgtattttattttggatgctatcgtaagtggaattgttttcttaatttcctttttgtatttttcattgctaatgtatagaaatccagctgatttttgtgtgctgattttgtattctgtgactttgaatttattagctctaacagcttgtttttggtgtgtatgtgtcatctttagggatttctacatatatatcatctgtgaatagacatagttttgcttctttctgtccaaattcaatgaattttccatctttttcttgcctacttgctctgtccggaatttctagtattatgccaaatagaagaagaaaaagtgggcatcctcatcctgttcctgatcttaggggaaaaacgttcaatctttcactattgagtatgttgttagctattggtttttaatacatggcttttacgatgttgaggaaatttccttctattcctagcttgagtgtttttttatcataacaggtgttgaactttgtcaagtggtttctctgtattgattcagatgatcatgtggagtttcttcttcattctattaatgtggtatattacattgattttttcattgttgaatcatcttgtgctcctggagtaagtttcacttggtcatggtgtgtcatccttttaataggctgctgattttgttgagtttttcatcagtattcctagggtgtattagtctgtagttttcctgtagtatttttgtctggctttggtatcggtaatgttggaccatagaactaatgaagagaagtgttcccttctctttaatattctggaagtgtttgagaagcattctttaaatgttgggtggaatcaaccagtgaaagctatctggtcctagccttttctttgggagctttgtgattactgattaatccctttactagttatagttctatttagattttctatttcctcatgagttagtttcggtagactgtgtgtttgtagaaatttgtccattttgtccaggttatccaaattgttggcatacagttttacatagtatcgtctcataattctttttatttttgcaaaatcagtagtgtcaccactttttttgttgttgttgagggggtgggggggatagagtcttgctctttcgcacaggctggagtgcagtgacaagatcttggctcactgcaacctctgcctcctgggttcaagtgattctcctgcttcagcttccctagtagctgggactacaggcatgcaccaccatgcctgtgtaatttttgtcttctttacagtagagatgggggttttaccatgttgatcaggctggtcttaaactcctgacctcaagtgattcgcctgctttggcttcccaaagtgctgggattacaggcatgagccactgcatctggccgtgtcaccactttcatatctgactttagtaatttggtgttctttctctctgtctctcttttatttatttatttttttgttaacctatctagctagagttttgttgactttttcaaagaatcagcttctggttttgtaatttttctccattgtttttctgttctctcttttcactctaatttttattattttctttcttctgctagctttggtgtagtttactctttttctagttccttgaggtatatggttaggttattgaatgagaactttcttattttttgatgtcagtgtttacaggtttacatttttcttttagctctgcattcactgcatcctataagttttagtatgttgtgttttcgttttcatttatctcacgttggtttctaatttcctttgtgattttttcctttgatctattagttaacattcacaaattttcacatatttgtgaattttttagtttttttatctgctgttggtttttcatttccattatgatcacaaaacatactttgtatgatttcagtttctttaaatgtattaagacttattttgtagcctaacataggtctgttttggagaatgttccatgtacacttgagaagaatatattgtgctggtgttgggtgagtttagtttttgacatgttacatttgagcattcatttaggagaaaagccaaaggaagacatttgttaatgaactgtaaagaggggttgacatcacaagaataggtaattttttttgagaaacaaatttagagcaacagaacagccttgaatatattcttatttagaaggctgaaggttgaatataacctggagtgttagaaaagggtggaacagtttatcatagaccagagccaagaaagtataatatttagactttaaatatcaaaaagaagatatggtcagctgaattcaaagttgaaggctaggtgtggtggctcatgcctgtaattctagcactttgggaggctgaggcagaaggatcacttgagcccaggggttcaagaccagcttggccaacatggtgaaatcctgtctctactaaaaatacaaaaattagccaggcatggtggcaggcgcctgtaaacccagctactctggaggctgaggcgggagaatcgcttgaccctgggaggcagaggttgcaatgagccaagatcgtgcctttgtactccagcctgggcaacagaggaagacaccatcttgggaaaaaaaaaaaaaagaagttcagaaaacagcttgtttgggaaggactgttttttgtattcctttaataattcaataaagaaaatagaaaaaggattttttttaaatttgagaaacatttaaatgatgaccactacttaaattatgaaattgaaaaccacaaatataaattatgcattctttatagtatgagttttagaggctgttaatttgctataatattagctacatctggaatagaagaaacttcatatattatcttatcgctatatttgaattctgtagaagttatttctggacagtctacgaaaagctcttgctggccatggaggaagtaggcagctgacagaaagtgctgcaattgcctgtgtcaaactgtgtaaagcaagtacttacatcaattgggaagataactctgtcattttcctacttgttcagtccatggtggttgatcttaaggtaacatgcttattctttctctactacaaactttaagaaaattaaatgaattttctagcataagtattatgtcaaagataattgctaacattaaagttctgactcttcgttgataagttcataggacttgcttttgttgttactgtgttcatcagcctaaatggactgagaatatgaagaaaacaccattttcttaaataagcataaatatacagacttgggtttaaaataatgtggcaattagggcctgaaatgaacctatatatggtataggaagaattgtatcagactgatgaaccacagtatgggtgctttgtgcttcttctggcagctggattttactgccatttgtgtgggtaatgtgttgatgttattacatgttagtaaagaaatactgcatgggtatttaaaggcttttgttttctgttggggtttttatagaacctgctttttaatccaagtaagccattctcaagaggcagtcagcctgcagatgtggatctaatgattgactgccttgtttcttgctttcgtataagccctcacaacaaccaacactttaaggtgagagcattggtttttatctaactatatttactgatgctgttatcctttataaacaaaaagactatagagattaataggttcacttttatcggtatttctcactattatgtattgatgttcgtttcaagaccttaaaaacttagtgttttttttttaaactttctatttgctgttctttttggcttcatttgtattactgagtatttttctcatagaaataatctgcttttttttttctttttctatagatctgcctggctcagaattcaccttctacatttcactatgtgctggtaaattcactccatcgaatcatcaccaatgtaagtccaaaaggtattgctaaattactaaaaaaatttttttctttcttttctttgcgtatttctttttaagaaatgcactcttggttttcaaaaaggttctgaatttagatgtatgaaataggaaaatttctccatggtgattctatttgataattgataaatatttgtatttttcatattaagtcttgaccgaagggaccatattaaggaagatggagttaataagatgctttggaaagattaaatctaaaacgttttattcagatcagaagcccttgagaaaaatgtcactgaaaatacagtttaaaattttcatcccgaagcttttcaaacatattatttcagcatttgatacattgacttgccaccttaccatttaagttaaaagtaatagtatttatgttgtagtctagtatagcacattgacaaaatgatgggactatatttgatggtacttttaaatcttttgatcctaaattcattcatagtgtaaaatttcatttttcttaaacaaaatgaaatattaacatactttaaagtaggtattaacaagatacaaaagcatatcagacaaagtaagtgaaatcattaaaaggtacttgcgaaaccttcaactctgtctgatgtggagacattaaatagacagcaaaactatcagatttggactgtggatttttaaaattctgttcttgtaataatgaacaaccctattttgaaagttttcaagtgttattttccattgttccacttttatcaaatgatactcacatttatgggtaaattggttgatgctttccttccttaaaggaggctgtaatcattgataacttagtatatttgacctgtttataatcaaattccattttaagactgtgcctctggtgagttgaaaataacccttcacctcatttgccctggatgttgtatttatttaaaataaatactgcccatattctatccattcctgcagtggaaaattaactattgataaagctatttggtgatacatttaatttttctcagcaggtgtttagtgagcattttgggaggacagtcctttgttgtgcaggatgccttgggcattgcaggacctttaagatcgtctggcctcatttcattaaatgccagttgtgctgcatctccccatccctagtcattatgaacaaataaacatgcctgagggaatgatacctcctcccttagttgagtatcactgagttaaattgtaggtaaaagtaacattgaatatgctttgttccaaaagggaaagtttaatgaagattgtaaataaggtatgtttgtattaaaaacttaaaaaaaatcactgtacttttgtcagcgtaatgagccagggcattgtaccttcaaggtttactttcaaggccattaaaacaaaaagatgatttctcccctcaagtttatgtgtaactcagaaataagtcattattgcttttttccgctgtggctcagaacactaaaaatattcaaagagtggatagctttgcataaatgcttaaaatttgtatacaataaacccaaatatatacttttttgatactttgtggctagttactttaattgtgaaatatttttgtctacaactgactacatagagcactttcaagcatggacttggcactgctgtaagtggctgagctgctcctttctgggttccaagcatgcctggagtggtgcttcatgcatgcctcagtgtacttggtgaaagtggctgtgcatcctcttctactctaatgagcactgcatgtgtggagggtggagtgtgtctgtatcagagatcaagttatatgaaaatctgtttttataaagaaaaaaactacattgaataatttttaaacattaagtatcagtaacttttcaatgaaatagcttgaaaaggaacataaatattagttcaaagtatctttttaaattatgctttgggtagtgatactttattattatagatagtgtgggaaattgtttctcgttaggatattttcccccttggtttgaggctaatcgctattgaatctgaagtactcttttggttgaaaaggactatttataaagtgaatatagaaatttatgagattgactattttagagtttcatttgaagacatttattatggcaatatttttgtcttgaaaaatcacatgaaattattcttagatatttggacttctgatcttaaattcattcgtagtgtaaattttttttctaatgattcttggttcaatgtacctcataagttctcttctcccatggttctttagccagtccacacattttttttaaagcatcacattctcaaataagataaaagttttagtgatgtgtattgagggtttgtgtagaagtagtaaggtgtttggagttctacttttgtgaaacatactcatactcagttcataagtactgagtttagatctaaaatattctagtgtttcttcttagaaaatctaaaatatatccactatttgattcttattataatgcaggttcctagcagttactaaaatagtagttgtactgtcatcttttttattatgatgtgccataagagatgaattaatagttgtaagatctatgttatatgcataatcttcatagacttcctttaggttaaattagatatgtaattgggaaatttaaaaagtaatatacacacttatgaaccaattatcttagccatcactggtacatgctatagctggtatattacttatttctgttttttccttacgacaatttatcgtaatttacatatggatagttcacatactgaaaatgagatgattgctttctactgagaggttgtagttgaaaggaattgtttccaaggcatttgaaaattatttaaatctcttaaggaattgccacataatttgttcatattatgtaagtgttgccatttggctataaacatggtattttcaaggaaaaaaagagtaagtctactttaattgactggtgttcaggaagggcacatttagtaactgctcaaaatactaaacttttttgccaaccacatgatgtctagtttttcatacttattttatttgaaaatgtgtattttactttaaaatgaatatattatgaaaaatgaaaactatgaaaattactaaatcttaagcctaaagttattttatgtggtgcacctggtaccacaatacggtttcaaaagctattaaaaaaagacacagtaatttgaataggatgttatatgggatgcctttcttagtttatcagtttctgacaagatcttacgagatgtgttgggtaaggaagacccttcactcaatgtactttgttattattcagctttttgttactttaggctgattaacacaagctgtataatttagtaagtataaggaaatcaagttgcattggttgctttgggcaagtcaaaattgctgagagttggaggaatccattatactatcagactaaaaattgatcatttgtagaaactagattaaataaagtaggagttgagggaaaaatgtaaacaaccatactgtcccaaaaaagcatttcttccctcccagttttgggattcctccctgaatggagttcagtattcaaaatgtgtatcataagttggttttatattttactatccggcgaacaggatttgtaatccacagtttgggttaaggtaatataactcgatgctattcaaaatattctgagaattccaagtgaagaaattaaaatgtcgagacttcaattagcttagttttgaataagaaaaaatctgggactgaaatgtgagagatgtgaggctattcaatccctcttatctacaatttgaatgtattattcttccagattttttaaataaacatctggagtattataaattagaagcctacattttaggtcatttaatgcatagtctacatatgtagtgaaaattcatccagtcagttttttattaaatgatagactttaaagatatagtgattttcacaattgtcattttttaataatatatcaagtaattcattttaaagttaaagatacacttccaaataaaataggcactaaaaactagacatcagagttaaacagggtaaattgaaatagaaaatacataaaataattgtttaaaaaatatttcactaggatcagtttgtctttgtttatggtaattgttagtctcccatatatcatgtcatcattgcatatcaatttataggtttacttaatagttttatttcatttactaatttcatgttgtaattatcattgttgtctgtaaacatataagtaatggttttccacatacacttttaatactgtgttgaaccactaatcacttttaaagctttgataatagcattcttacctgggaaaatatatgccatgtatgcacgtgtgccagaaattgtaaaacattaaacttaaaaaaaaaaaaagaagattggctacagattagctctctgaagactttatttttcaaattcactggctaatcatcgagaaaagatgtctcacatgcacatgctcataaagtgggcaatttgtctcatgctcactattatgttttataatataatatgtatgagttagtgtttgaattaaagacgttgtttgaagactttggaaatcatggtgtgtgtttgcatggtcttagaaagttcccgacaaaaggataaaacttaaaactacagtgataaacagagcatacaactcacgtaattttgtactttttcttcctattggtctttgtttttctctagtccgcattggattggtggcctaagattgatgctgtgtattgtcactcggttgaacttcgaaatatgtttggtgaaacacttcataaagcagtgcaaggttgtggagcacacccagcaatacgaatggcaccggtaagataaatcacgaattttgaatctcacctcctttctattgcattttttttagtgtctttatcctattcctgctgctttggttattttagagaattgaatgggtccttcatttcctctaaatgttgtggtatgttgtatctagaatattgttgaatactagattatgtttgttttccactgtttccatgagttgaacttaacttttcttagataaattttctcacaaaacactgaaagtcttaatgaatgtcaccttttttttctgtttttaaagttttttttctccttaaaacttttgaacaaaaatattttgattagcctctcacgttttggggatgagtaagggaagctgactcctgggttagagtgaatgttgctgccaatgcacattttagctaattgaatggtgactattaaacataggaaatgaataaaatttagagtttttgtatttaaaataaaaatattttgtatttcaacaaatatgccttgaggttttacaactgataggaactttgatactgacatttgactctaaacttaataaaaagcagacttaaaattgggtattctcacagattattactcttaatatggaattttaaaactcctatggaatcaatttaaaaagataattataagattgtggaagtcatttttttggtgtttatgtatagcaagagtattatacaagagcaactcttgacattgattggtggtgctttgtcttctgcttcttattttctattattggctgctgtcgctcacatgatcagatgccaaccagtcactgttttgcatggcagtgggcttctgtggctgtaagtatgacccattgtaactacatcagaaaagtccttggtttctttgacttttctgtgtatagttaccattatagtcacatcttgtcatttcaactgaaaatatagcatgtcttcacctgttggttttatctagtaagttagtcatttcacagttaggagataatttaaacagctttctccctggcatgcttctctttttccaagtccccttagtcagtgaaatattttggttttatacagttgtggttcactcttatccagttgtcagtaattatttctgaggattgtttatcttagatgttcaaatagagaagttttttatgtcatatattttgggattattgagcctaaaaaatatagccaaaagatcatggcaatgatgtttccttaagtaaactttaaaatgcaaggttaccttttagttgactttttgtaatgccaagtacttcacttttttttaagttgaagaaattttcagtacaggtataagttaattggaggtaagcataaataatagctgtttaaatgtcatttaataagatatttttaaaaaatcttttaaaactacttgaaataagttgtttaaaagttatttattgacctgtttattccagagatctgggaaatcagaagtttatttgacttttttgctttaagtttactaccttttctggtagaaagttaatgacctccaataataggacttgttggggggttaatattcacttcctatttaacttcaatatccactttaccagctgcccataattttctgtgaataaggactaaaaatgaaactaaatgattattttgaacagaggtaaaatttgattggtagtctaaatatgttctctacacttagaagttattttacttcttagccctagttataagctgattctcagagctacatattattttaccgaaaagccataactagagaggatttcctcttttggctcaaggacacctgtaataagaatttagtttttatttctaattattttctgaaaatatcaatatacatttaattttcaaaatcattcctaagctgtttatgtttttgaaatgttatatgtatgtatatttgtacataatgactaaaggacagcttttgggctgatattaccaggagagaaaataaatagcaaatgtaatatgaaacaatttttagaataagaaaattttaggttttgaatggctgttagggtaaaatctcacccttcataaacttggtgagttaacagtcagataaccagtatggaagtattgaccttctactctttgccaggcaaaggtgctaatgccagggaagcatggtgaactaaacatacacagcacttcccctcaccgagattccaagcaaaaggtttatagcttttgcttgaaaatgtctaatgaagaactcaacaccggacacggtggctaacgtctgtaatcccagcactttgggaggccaaggtgtgcggatcacctgaggtcaggaggtcgagaccagcctggccaacatggtgataccctatatctactaaaaatacaaaaattagccaggcgtggtggtgcatccctgtaattccagctactcaggaggctgaggcagaagaatcgcttgaacctgggaggcagaggttgcagtgaactgagatggcgccattgcaccccagtgtggacaacaagagcgagaatcggtctcaaaaaaaaaatcaaacaaaaaaactcactacaggtggcatggagtctggcaacacaggcaaatatatataataaatggtttacagataatacctaacatcagagtttcctactgttggcactattaacattttggactggataactctgttatagggggctgtactgcgcattgtgggatattcagcagcatctctggcctctacccactagatgccaatattccctttaccccccagccctccaagtcatgaaaaccaaacatgtctccaaacatttccagatgccccttgggggacaaaatcacccccagttgagaactactgtattacagagtatgttcagtgggttgtccctcatttgtattgcctcaaatgatttgggactgataaacctgagccattagcttgcttcagaagtagcaatctaggagttctgttgcaaaacagtaaaagtaaaataatatctgcttcaaggctttactaacactttgtattttggagagacaagttacttgttggaaggagctaattatttgaaaattttctcttcgaccaagatagaatcatgtctctgtcacttacagccatcactgatcctctttctgttggagctctatagaatacttctgattcttccacaaggtggccctgcagatatttgaataaggttattctgtactcctagaattcgttttatttttatatcgttttggcattggaagggattttattcttttagctctctctctttttttttcttcttgagacagagtcccactccgagtcccactctgtcacccaggctggagtgagtgcagtgatgcaatcttggctcactccaacctctaccttccaggttcaagtgatctcctgctttagcctcccgactagctggggttacaggtgcccaccatcatgccagctaattttgtgtttttagtagaccatttagcaccattttgggcaggctactcttgaactgtgacctcaggtgatccacctgcctcagtctcccaaaatgcagggcttataggcatgagccactgtgcctggcctcttttagctctctttaaaactgtatgtgtgtttgttgggtctgtttttatagctaaagaaactgaagcttaaataaagttatattaataacaaatgcatggttaatgaacagtcaaccagagttagttctgaggtttcttgacattcagttcagtgtctttatcaggttctttagttgtccttcttcactagcaagttagcttgatgaaagcagtagctttgtctggcttaatcaacactgaatccctaacgtttgaacaacatctgatacatattgggcatttagtacatgtttgcagaatgaatgaaggaatgaatttcttacttgatgtggtttcaaaatcctcgtacaggccgggcacagtggctcatgcctataataccagcacttagggaggccggggcgggcaggtcacttgagaccaggagtttgagaccaactgggccaacatggtgaaaccttgtctctactaaaaatgcaaaaaaattaggcaggcgtggtggcaggcacttgtagttatagctactcaggaggctgaggcaggagaattgcttgaacccgggaggcggaggttgcagtgagccaagattgtgtcactgcactgtcagcctgggcaacggagcgagactctgtctcaaagaaacaaaaacaaaaaacaaaaaaccctcctgtttctgatttgcttctcttctggaaagaccaacctgacaaaaatttttaaaattaaaatgccatattaagatctgatgttagtgatacagatataatactatgatgtaataattgataaaagctattaaactgctgtgtttgtataccctgtttctattaatacaatctaagatagtattattattttatgttgactttttagttatttaaactctttggccctttttatatgaatgttgagccataacttctcctttgtacctttgtagtatttttttaatatttgaaatgtttgtcttagcactgattttactatttgcaaactaacatctcctgctttcataaaattcaaaactgccaataacagatatatgaattttcacaagtatttgttatttctcaacattttttatcttaagtggcatgctggctcaccagatctttcttacatgcctgttattcagtcacatggtctaaattaacaagtggtttgggcctttaatagatatctgaagactctggttcatgaatttcttcccagacatgattgcctctcatctttggccagatcacatgtaccagcttctattcctactaatacctgcaatatagaagatcaactaatgaatgaatgaatttttttcttacatttctaattaagaaacacattgcttctttagcatgtttttcctcactttctgtaacccactaaaattaaaaggtatttgagatgaattaaatttattggaatttctgaagtcatacatttcatattaggcaaccatgttggaacagaatttacatgttgatatttgggattaagaggtgacataattaaactaatatagtcatacatcacttaatgacagggacatgtcttgagaaatgagtgcatccttagtgattcagtcattgtgcaaacatcatagagtctgcttacatgaacctagatggttatatagcctgctacatacctaggatatatggtctagcctactgctcctaggctgcaaacctagactaaacagcatgttactgtactgaataccttaggcagttgtagcacaatggtaagtatttgtttattcaaacagaaaaggtgcagtaacaatacagtataaaagaaaaaaatgtataggacacttaacacaaatggagtttgcaggactggaagttgctgtgggtgagtcattgagtgagtgttgagtgcatgtgaagcctaggacattacactactgtagacttaaaatttttttaaatttattttacttttaatacttttgcatttttctcatactcaggatctatactgtagactttataaacactacacttaagctatatcaaatttataaaaaatatttttatatgataactttacagtagcttttaaaatataaacttttaaattttttaattttttgacttgtaataacacttagcttaaaacactttgtatagctagctgtataaaatatttttctttatatcctgtaagttttttctatttgaaaatgttctattttaatttttattttgaaaactgttttaagatctgggacacaaacatacacgttagcctaggcctacatggggtcaagatcatcaatcagtgttactgtcttccacctccacatctgctcccattggaaggtttttaggggaaataacgtgtggagctgtcatctcttgtggtaacaatgccttcttctggaatacctactgaaggaccttctgaggctgtgtttcatagttaactttttatctttaagtaggagtataacaatacaaagtatactatagtaggctgggcctggtggctcacgcctgtagtcccagcactttgggaggccaaggcaagtggatcacctgagatcaggagtcgagaccagcctggccaacatggcaaaacctcttctctactaaaaatagaaaaaaattagctgggcgtggtggtgcatgcctgtagtcccagctacttgggaggctgaggcaggagaattgcctgaacccgggaggcagaggttgcagttagccgagatcgcgccactgcactccagcctgggcaacaaagtgagacttggtctcaaaatatatatattataataaatacataaaccagtaacagttatttattctcatcaagtattgtatactgtacataattgtatgtgctatactttttttttatatgactagaagtgaagatttgtttacaccagcatcactacaaacaataacgcattgtgcttggacatcacgatggctatgatactaagtgataggaatttttcagctatgttacatattgtctatcattgactgaaatgttgttttgtggcatatgactctatttacgttttttggaaatgattcttaaggaaaaattctgatacctgctcattgttctctgatcttgtgttcctgtgcaatggctgcatcagggaagagccatttgatagttacacttagttacatcaaagtaaataaattcgtttaatcaaagtttcagcttgatctgaggtgaaacacctcaacttagagtgaggaaaaaaatacagttgaaagagagcaaacagtaaaaccagaatttattaaatcatttagtaaaacatttgctttggggtcagggggcagttataaaaagcaaactatttggaagttttgctatttctcttctgtagtgacattcttgagtataaatgtgtgcattaaatagctattcttccccgcaaggactaaaacccttcggtgttcttgggtataataacaaatgcatatttcacttaaacattgaggatagttcatttgtgttgtagatatgcatgtctgcttcttaactttgaaagacagcctgtttacctggacatttgtattatgggtccacagttggtacacagtcttgttatttctgtattatatatatgtttacataaagacattcattcagaatcagatagttttgtgttcttttcaaggaaaaaaggaaggagatgttttataataataggtgatgttagctctggaatataattgttggatttttggttgaaaaacatttataattattttaattcatcatatgtctctataattgaaacatattttctgtaagtttacctttctgagttctttctgttttacaaatgttcttcaggcaaaatgcatgcattctgtaacttaaaagaggtggagtgccgtcgaaggaaaaagcaaattttacaattaaactagtaaatacaaagattgcctacatgtttcattaattctaagaagcacttatttttactcttctctaaaattgggaatgtatcttattttaaatggtgtcttacaattgacagcagtttttcattccttttgggacatcaaataatgatgcatcttacaattgataatgttgtagagtctatgaaatacttgtatgtatgtctggggaatgtttgttaaataaattacccagtgtgtatatttgtgagaactataggccaaatcttttttcccttatgtttttacattttagaaaatagttttttacatagatgttttacaacctgatactaagcttttagtattgtaatagattttcattgttttattagattgataaaaaaaaatataaatggtgcaaaaacgattttcattgttttgttaagcttaataatactgaccttatgcttactattgagtgtttctactaataccacacatttggtagtataaaaaatagcttttttcaaaggtttttaataataaatttcttttaaaaggttggatagctattatcctgagtcttatgtctgataccatgtttttgttttgtttttagagtcttacatttaaagaaaaagtaacaagccttaaatttaaagaaaaacctacagacctggagacaagaagctataagtatcttctcttgtccatggtgaaactaattcatgcagatccaaagctcttgctttgtgtaagtatttttttatgaaatgtctcaaaattatcacactaagttaattgggtttagctgaaacgccaagaccttgaggataatttttagctcaagagcacttactgatcctttctgatcatacctgaaaactaagacgtctctaagaaaactaatgtataatgaatactaatataattagatcagattcttaattgcccttatcatttcctaacatttctctttcttcttaatttccctatcattaaactaacatactttgatgagatctctgttctcatcctattactaagttatatattattcaggtataatcctggtatgggggatagaagtgaccatcgatcacagtgtctacatctatactgttggtttaaaaaatctccagattgcttttgccagtttagcttttctatccccctttctttgtgttatcagctttctgttatcattggctctgcctacaaatactgtattggaaaaagaatgaggtgaaaatgggtgtggttagtacttgagttagtgtgattatcattattattattattttgagacagggtcttgctctgcttcccaagctagagagcagtggagcagtgatggctcactgccttcgaactcctgacctcaagccatcctccagcctcggcctccccaagtgctgtgattacaggcatgagcccccatgcctggctagtagtcagttattgtcataactactcttactgcctcagatgatattaaatttctgagaacatcactctggtacacagagtaattaggaacaacgcaaataataaaaatgagtcataatgaagtgattaacagcatggacgctggagactacctactagctatgtgatttggatgactatttaatctttctatgccttagttttctcatctgatatattgggatcataatagttcctatctcagagatactgttaggaaaattgaaatagtacatacaatgctttaggaacaatgcctggtgcataataagcactaaataaatgttagctattattgctattaataagatacaatttaacactaattaatgcaccaaatgtaatagttctatattgtgtctttcataggatgacatgtttaacctttgttgagcttcttcagtccctggagagcagcatcaagcaaggtttcttatcgttttgctcagtaactggctttttaaaaagtgttaaggtgctttcgattttggtggcatattttttaaattactgtaatacagggagtttgtaactacatgcctatgattccaagagttctatgaaacttcgtgaattttttaaaaatgtgtatttatgagtaatttttcttggagagtggagaggagagaagaaggaacattcccaaaggatcagtgaccccaaaagaaggcctgtgatactttaagcctgaaaaacccattcaagtttgaaagtctaattagaataaacagatctttggcatgaaaaaattccataaaacctgtcagtgaaactctataaaaaaatgaagttccctttctcttcattcctttgttatgtgttacaagctatttgtggcattatttcatcatgaaggtcacataatactagcagtactctgtttacgtggtgataattcacattcaaagcaggcaccaaactcaccaatgccgtttctactaaatgttgcttcaagaagaatttaagcaaaacttgccattttccaaggatcatttaaaatggaaattatttgctttgctgccatctagtggttaataagttttctcaaggtaaccataagtacattaaaatagaagattcgttgtaaatatttgaccattttgtcttttacataaaaaatctgagtcttagtaatttaggaggaatgtaggaataattattaaatggtctcaatcatggtatttttaaagtaatatgattttgtcttccattttagtactctcaatttctcaagcctcctaattactcagcttgcatcgtttcttagatccccctgatcatttctccacactgaagttatggcagtctctttaaaaagcaaatcttattatgccccctctcagcttgaacccttttagttgaaattgctcttgcttatgaagaccaaactccaaatagatctacagggtcgtgcaaaatctttctcccatctaccatttcttccacatgtagcattacattttttgtcttcctttactctattcatgatggtcttcctttcagtctttctaaccacatgccttcatacctcccttgcagttgcttttccctctgcctagaatctgcttactcttaacatagtaattcctactcattctaagctattgtcactgcactaaggaagcctccctgagtcggacacttttccatgttataggctgtcatagcagcatgtaccttaataatagctcttatgtgatttgcatttttatacttgttgatctgattatttcattgatgatatcttcccccatgagactacatgctcatggaggatgggaaacacatcttctctttttcattgttgtgtctttggcattcaataaaaatgatttggttttggatgaatttatatgaatgtcagaaaataagctaacggttttgaattacagatatattgcagtgagggcttaccttagtcattataatggggaaaaatctatagttagcaaaataaaatatgggacacaagttgcattggcttcatatattcttcttttttttttttctgagacagagtctcactatattgcccaggctagagtgcagtggtgtgatctcagctctctgcaacctccgcctcctgggttgaagtgattctcctgcctcagcctcccaggtagctgagattacaagcacccgccaccaaaccggcttgtacttttaggagagatggggtttcttcatgttggccaggctagtctcgaactcctgacctcaagcactccgcctgccttggcctcccaaagtgctgggattacaggcatgagccaccatgcctggccaaaccatatattcttgaagtgcaaatatatgcttccaagttaagagaaacattttagtctctaaataggtaggcattcggcagggcgtggtcgctcacatctgtaatcccagcatgttgggaagccgaggcaggtggatcacctgaggtcaggagttcgagaccagcctggccaacatggtgaaaccccatctctaataataatgcaaaaattagctagacgtggtggcgcatgcctgtaatcccagctactcgggaggctgaggcaggagaatcggttgaacccaggaggcagaggttgcagtgagccgagatcacgccattgcactccgtttcaaaaaaaaaaaaaaaaaaggtaggcattcacatttttacataacgttaattttctttgcttagtacactatatttttccacgatgaaaaggaccgaagtatgggtatctgccgatgcaaattctagcctttgctttgttaccagctgtgtggatttgggcaggacctttgtatgggtcaagagggctgtacaggataatcatgcaatccttatccaacatgtatgtcctttacctttgatcacaatcatgtataagctcaaaaccagtaagttccaaaccagagatacgttctttagccagtttactattgttggaaaaaaaattattcctcatattgttgatgtaatttttaatgggaattcgtggtttttgttttcattaggattttccctggacattattcacattaatgaacaagtatagatgtggattaaaagaatccctaacaaaagaagttttgatttaataaaatttttattttattgagataaaaatactatacccacataccataaaattcaccatcttaaagtttacaattcagttgttttcagtatatttacaaggttctgcaaccattaccactatgtaattctagaacttttttttctttctttcttttttttcttttttctttttttcttttttccagatggagtctcgctctgccacccaggctggagtgcagcggtgcaatcttggctcactgcaaccaccgcctcccagcttcaagcgattctcctgcctcagcctcccaagtggctgggaccacaggcgcatgccaccacgcctggctaatttttatatttttagtagagatagaatttcaccatattggtcaggctggtctcaaactcctgacttcaggtgatccacccgccactacctcccaaagtcctgggcttacaggcgtgaaccaccgcgtccagcctagttctagaacattgttatcacccctaaaagaaacttggtaccctttagcagtcactgtctatttcttcctccttctaatctctctcgatttatttatttttttaattgaagtttcctttttttccttgcagaatccaagaaaacaggggcccgaaacccaaggcagtacagcagaattaattacagggctcgtccaactggtccctcagtcacacatgccagagattgctcaggaagcaatggaggtaaggggaaaatgaattccatgttcttgaaggaaagattgtaactatgtacattcatgatgttcctttggtgtgtggtttctgtgagtaacaggtagatgtcatttctggaaatggtatgtttatgtctatacattgttttataaaactccatggagaaagaaggggtttacttgctttgtatcacatagcaataacattgtacaaattctgatgcttaataaaatagttcgagattttctaattgcagttgactttaaaatttttaaaaatattattattaaatattaaaaatactaatttttaaattgagacataattcacataccctcaatttggccattttaagtagttcttttttttaaattttattattattgtacttttaagttttaggttacatgcgcacaatgtgcaggtttgttacatatgtatacatgtgccatgttggtgtgctgcacccattaacttgtcatttagcattaggtatatctcctaatggtatccctcccccctcccccctaagtagttcttattcacacagttgtgcaactatagctactctctaatccataacatttttatcaccccagaaagaaacttgactccccattccctcatccctaccaactactaatctattttctgtctctatggatttgcttgttttagatatttcatataaatagaatcatagaatatgtggccttttatgtctggctaccttgacttaatgctttcaaggttcatttatgttgtggtatgaatcactattttcttcctttttattgccaaatatttcattgtatggatctgttttgttcatctagttatcagttggtggacgtttggtgttgtttctactttttagctattacaaataatgctgctatgaacatttgtgtaaaagtctatatgtggacatatctcttaagtatataggagtggaactgctaagtcgtgtggtaactctgtcgaacttttgaggaactgtcaaactctttttctgaagcagctgtatcattttatattcccagtaacaacatatgaaggttttaatagttctgtatgcttgctaacacttcttataatgtgtctttttgattgtagccatcctaatgtacatactgtacaaatgtttatacatacccagtaaaaatgtttataaaaatattttagcacttactacgtaatcattgcttccatttgtgtacattgctattggtcccgtaaattgatacatttcttgtagtctttttggaaggctatttggcaggagctatacaaacatttcatttttttatgcaaataattcaatttctatcactttaaaaatcttatgaatataactcaaaaggaaaaagctgcacacataggtacttattgctcttaattataatagaatattaagagagctttatttactgggaggagaatgggttaatattcaatagtgagaatgctattttaacttggtgagctgttaaacatttattaaaacttatatagatcacacagcaatatggaaaaatatgaaatgtcaagtgagtatactgcatttatggctttgttaaaacatggaaaatacaaaaaaaagaaggcaatatgaaaagaaaattaaagcctggaaaaggctaacacattttctttcaatatgtatttttaaagttttatcaaacaaaaatatagagaatttgtcacttaaaaaaactagtgccagtaaattgtaccacgtttttgtacaatagtagcaaaattgaattttaatttgtgttgtttttccttgatatgagagctataaattatatagctttttaagattctcaacaattaattgcaattttcattaaatatctcaaagtaattacaataaaaatgtttgaaataagataatatgggtctggcctttaaatgttgatatgttgaccaaggactgaaagaaatgtccagagcttcacagtttctgctgggttgggggtggagggatggtgggaggaatgtgaattgggattgtagaattggagttgagataagatcagttcgaaggaagagtttgtgttttttttatatctttgatggttttaatttatataataatctatttatatgttatatattgtaaatgaattatttaattcccgttagtgttctctgagccagattccaacttcagttctgtggtcaattgaaatactttagaatggataatctgctatgaaatactgaatccattttgcttcctctctcttgattttgaaaaataattgctcttttctgttacaagagactttgtggcaagtgagacagtttaagtaaaaacttaaaagataagtaaatcttttgctgtgtgtattaattttggcaagccttcttacttggggattagctttttgtttcatagagttctttaatatctattgaaattattttgtttgtttcttaaagcagtttttacagttatatattgttccgaattcatcatttagctttatatgtacatgccagttagagtcagaatgatgggaataaaatgatttcattctgtctgtattattccctagaggtttgtgttcaccagagtttctctctttttaccttttactatatattgaaactacaaatgaaagagctcaatttcttagcatttataaaataagtactccagtgttatgtttaccaaaaatgtttgagtgagtcttctctttgtctttctcttttttaaaaaattcaggctctgctggttcttcatcagttagatagcattgatttgtggaatcctgatgctcctgtagaaacattttgggagattaggtatatgtacttttattttttaaattcaacttttaaattttattttgtatttttgtcttgaaatattaactctgtagtacttagtacattgtaaaacttacacttccaaaggttttatggttttgtattttatttgacttcaaattattagaatttcttgttttaactgtaagaaaagtatcacagcaatttagaaaataaattttaagaatagtgctaaattttgtcaccctaacataagtactgttgtttggtatattacttttttcagatttcaatgtggttactactgtatttttaatagattttcatagttataagcctagaatgataaaattttgtaacaatactgttttttcagttttttgaactatgatctttcataaactttctgtaataccaatgctttcgatgaatgaattaataatggacacctgcttagaagaaaaaaatgtatgcagaattttgtggtctgcttcctagattatacaaatcattacattttaatgagcatgaagtcaccacacggaggaaaatgtaaatgtgtaaacctcaagtttgccattatcttataagaatgggtgtgctaagttacttggcagctgaattaaaccttactctagagtagtgctgtccactagtaatataatgagaaccccatatgttaaaaacttttttacttactacattaaagagtaaaaagaagcaggtaaaattaattgtaattatgttttgtttaacccggtgtatattatctataatttcaacatgtaatcaatataaaagttattaatgacatttcattctcttttttttaataaagtcttcaaacttt

SEQ ID NO: 424 - DNA, 1249864 bp, Homo sapiens
ttagaatacccaaatcataattttatttgtacacactgttaggggctcatctcatgtaggcagagtataaagtattaccttttggaattaaaagccactgactgttataaagtataacaacacacatcaggttttaaaaagccttgaatggcccttgtcttaaaaagaaattaggagccaggtgcggtggcacgtgcctgtaatcccagctccttgggaggctaagacaggaggattccttgagccctggagtttgagtccagcctgggtgacatagcaagaccctgtcttaaaagaaaaatgggaagaaagacaaggtaacatgaagaaagaagagatacctagtatgatggagctgcaaatttcatggcagttcatgcagtcggtcaagaggaggattttgttttgtagtttgcagatgagcatttctaaagcattttcccttgctgtatttttttgtattataaattacattggacttcatatatataatttttttttacattatatgtctcttgtatgttttgaaactcttgtatttatgatatagcttatatgatttttttgccttggtatacattttaaaatatgaatttaaaaaatttttgtaaaaataaaattcacaaaattgttttgaaaaacatttttggattgtttcattctttgcttgtcatttatctgttgattagaccactaaagtgaaggattcaagctaaatacatcaacctttctatttaggctttatcagctatatgtaaattcaattctatcaaaattttctgagtgcctcctcagtgtgtctctctgatggttcctgcccggtatggctggcatgaagaagatcctgtaaaaaagagaattcatttatttattcacttagtttgttcatgcatttgtttaataaatattgagatgtaccatgtgcctggcattgtggtaggtattgggaacacaggagtgagcaaaacaaaagtcttgctctactgcagttaagggccagggagaggcagaaaaagtaaataagtaaaatctatagtgaatttggtggtatgtacaagcggaggggaaggggttacggttttagatggactggctctttcagaagctgacacttgtacagacctgaaagatgtgaggaagtgagctatgcatctgtcgggaaaccattctgaaggatacagcaggtgcagactccagtgggatggttggtgtattctgggagcagccagacggcccatgtggctggagaagggtgagtgtgaggagtctaacaggagaggcagagaggaattggggtagcaccggaggctgcctcttaggccacagtaaggacttcacttttgactctgggagccagtgtaggagttttgagcagtggtctgatttaagctttaacgaatcacccaggcagtgggaatcaactgaaaggggaaccagtgagaagcttttgtaatcatccggacaaaatgaaggtgggccagactagggtggcagcagcagagcttgtgacaagttggattctggacatattttgaagataagagttaataggatttgctgatggattggataaaggttgtgagagagacaagaaaagaatgatgcaaggttttagcctgagcaactggaagaagagagttgccgtcagctgagatgaagacaatgaaagcagctttgcggacgcggtaagtttgagatgcccgttaacgagacatccaggtggggatgctgagtaggcgggatgcaaggctctggagttcatgggaaagctccaccaggaggtagaaatctgagagtcatcagtgaattgatggtatttaaaatcagaggagtagatgaaatcagcagtgaagtgggtgtagatagaaaagacagggggccccaagactgagtccagggcagtctggagatcagtgggatgagggataagcccaggagactaaaaaggaccagcagagactaagagttgcaaattagtgtggtaagtacagtgaatgcagcaggcatgggccccttaacgtcttcttgtctgtagtccttgatcagtctgctcattcacccacctatctatcctgtactccttgagcatctgcatgccaagcactgttttaagcagcagaggaagcaataagtaaatacatttgagttgttgagagatcatggggacaacagatgataagaaaacaggacagtatcagcagttgtcttatctgaaaaatgaggatccgttcctccctccagattgttgtaggatttaatgagataaagctcctgaagcacttatctcattgcctgcactaagagaccgctcaggggacattctgcaatgccatttgagctccctcctctttgcctggcaacagccccagctgccatctctgcctccagttgtgcccttctgcatgatctttccagagcactcatctgaatcacattaaacttctctgtttaaactttgtgtttacacttctgtttaaaccctggacctgctccaagttctcttctgtagctttgtgtacactgttttctctatgctgtcctctcaccgattttcttttccccgctaactccctatgtttcacaaattctttaagatgaccctcaagagctgaagggctgccctgccctctcctagcattctcttttctctgtcatggcttttgttgttttggaattgcttgcttattgaggtccccagtaaatcgtaagctccttgaaagccaggactgtatagagtctaacatgagcctagcattgcaatgagggcctcagtaaacacttgttggatgactggaattcatctcctgagttccatgggatgaatttgcccacgtgttcataacacagtctatgttcttcctttccataaggatatcatgaggctgtcaaatgaagatgtagcatatcaccagcattttatcttgccgttttagtttggcctttttctgtgaaacatcattaggggaaagtaaaactttacttggacaaaagaggtttgctaccaaattatataaaatgaataaacatatccctggagtgtttaagtcagcaagtatggccatctattattccacagacattttatattataatttactcactgaactttaacgaaggagaaaatgattttctaataattcttagtctttgaagattgtcactggaatacattccttgctcataaccactccccttgggaccgtggatatactatacagttattaaaatgcctgaattagaaaatctgctgctcttgggctatgagtttaactatagaagaattactgtatatgctcacacgagaggggcagaagaagggggtcacatttgagacgtagcagagaccaggcctttgaagtcctctggcatcaacaatgacttgctcctgagtcaaatgatgtgagaaaaccagaatttgggaaattttcatttcaattaagattcaggaaaatgagtcactggtgttctttgtaaattcatttatgaggtcaggcccccagaactgggaatgctccttatcacatagaaatgaatagaaaaatctgcctctgtaatttccatcacccagggctagaatatgtaactagagagggtggtcgaggcctgagtttgggtctgggggttcagagcaaccgatcaaactggaaaactgagcaggtgagtggagactcctgctgttctgaggagcacacgttcgcattcattcaaatgtttatcgccgctccactcgaggcactgcccaactctcatttatcttcacagaagttgagtggatctgcagactgcagcttcagtttttagatagaggaagaactaaaccccagcagctaatcggtgacaaagccagggctagaatccaaatctgctattctttatagatagaaaggccaagactcttaggcttgtaagtcacctgtcagtcacaactggaagtagaatactcctgggttcagtggcagatgacatcagcctaggggtcataaggcttggtttcactagctggggaaagtcatccaatagcttacgtgatggttttggagatgttcttatattcaccttcaattagcagtgagcccttcactaagcccttcatcttgggcttattgccctacttgctgtcaattaacctctggagacacaccaagtcttttagaaggaaggaagggagctactattttttgagggccttttatgtgccaagcccacaggctgggcattttccatacgttatttaactgaatcataacagtgctgcaaggtgttatctctttcataggtgtgcaaacagatgcagagaggttaggtttccagggccccacagccaagtggtggagctgggtttctggtccacggccttctgtctccactgggtgacactccctgtaccttctcattgaagcccctgggctagagggtccaagagcatcacttcagttctgcatttcattcgttactcacttgcatcaggacagatgcatcactactaagctctcggagaaggcatcagatgctgtctgctcccaaggagcttctacttttggtagtctgcttaacttgtatctgtgcctgtagagattgctctttgaaaaaagcagcaggaacattctgatagaagccaatggatgggacaggtggggggaatgcgttggatttgccagcacctggccactgcccaacctgctctcaattctcagatgattcaggtattgagcaaggaaggtagcagagctactgttgccttccctttggggaagcctgtttctactttgaaactcttaagggattcatttcaaattagtggcaggccttggttagtggatctgtgtgctgtcttctgccatcttgattgcatctccccccttctccttttcctttcatttgaaaaaagatgcagcccctcagagcctcactttcctgatttgtcaaatagggaacctaatgtacaaggcttttgtggggcttagaaaaaacatgtcaagaatctgatatagatctcaataaacagcataatacttatctttcgtcccagttacaaacccccattcctgtactgcccaaatctccatgattcacaaattgcgaccctgctgcttctgctccatggcagacacctagctccaggcaccctcctctaccacctccttctccttatggccattggcttttaggagacagacattgcttacttagcaggaaagctgtcacctgctttcttttgaactatcccgaacttgattctctttgggcgacgcatacacccatcaagtggtaaagaagactgggaatgaggggagaaaagaccctgggcttgttgctggggccagtagcttgggagtgtggtggtatgtgtgtggctttggctgtcaagtggatctaagttcaaccctggctacactgactttccagctgtgtgacttcagcaaatgggttaatctcctcaaggattcacttcctagggaggctttaaatgtccccgggtgattccagtgtgcagtggaggttgagagccagcgccctctactctcacccttgatgcccaaccaactcattgccagtctcctcctttagcacagcccatgatgctgcgatgtctgccaatgcagcatgcccctttgtgcctgctctgcccataacattctcaggagcttgctggacagcacagatgtttggtgtgcatattaacccagctgtggggatctttcctgctcaggtttggtggctaatttatagagcagctctgtcaggatgatcaccaatccctcttacaggcactgctttctctgttcaagtgtctcacatgtgtgtgcttgtgtttgccttttagctattactgtgatgattcccaatgtagtagacactgccagtgaccaccgcaatatccaatctcccccttttcctcactaacaacccctgcattgttgggggctgcagtgtgctcagctaaaactaacaattgcagccacattttccatcctcctacataggggtggccaataagctgtatgcagaagttgtggggtggagcttccaggaaagctcttaaaagtctgccttattcagctggacaatgcttccatcctatggtccttaccatcttttctaatgcctggaatatgtgtgtgctggaggatgctccagcagccattttgtgacaatgaggcaatcttgaggctaaaagccacttccaaaggatggcagagtagaaatatagaaggatcttgagatttcaatgatatcataaagctacaattccagctctgtactgcctatctctgaagttcatgttacatgagggaaaattcaacccctgcctcgtttaagacattgttattgctggtctttgctactagttctttagttcaattcctaactgatacttcccaaaacaaacctggtgaataacagcaattcaacaaatgtcaccgacccctgaatctctgcctcctccacccactcaccccagctacaaacactctttctttctcctgatgagtaaccgggcatctagctgtaaggttgctgaagctttgtggaatctcagaaagtcataaagctactgaacaagttcacaaacaagtgatgcatagaccacacccagcccacagatgagttctgtgtggctcacacttattttttaaaactgggtttgctgccaacacttcaaaacccaacgattttgcgtgaaaatccagatttcttagaaaatctgtggacccagggtcttcctttctgcctggcaacaatcagctggaactcagcagtggttgcccctgagatgaggcacagccccatccccctcactcatgtcacctgtatggcttggaaggcatgtgagtttgcaacctgctcaaacccacaccccagaaacggcccgctaaaatgggatttcagaatccacttgtacctttcttctttctcagtctcccctgactcaacacagcacactggcattgtttttttcctctcagacaactcagcatgcacttttgagaatcagagagaaatccgcctctcaaatgtcagaaaacagctgatgctgcctcttacttgggggccttttgacttcccacgtgtcttactgccacttgagagggagggctgcaggcaggcaggctccctggggagcagctgttgggatgcttgattgaggccctgagacagccagaggacaattaaattgggtattgaatatgaattgctttgaatggtttttattaccacattgtgagctgactttggttgtaaaatctgactccatctcttgctcttactgtggtgatgagacagaacttcaagatgtcttaaatagcagggcttggaacatgcatattagctcatctgtactcgtgaagtctgtcatctgatacccgcgctcctccactgtctgaaccaagttaggagccctgattaaacctccgcggctgcagtcgccaccttccgccggggtgaccccattggagatgacaaatgaaggatgtcttatttcagcctgatgtgtaagtcttcacagcactggtcgttaactactcttggaaagttaaatgcccatgcagctttttttttttttttccccaaacaaacataggtctctgaggttttggagagaaaaacaaaaactgttttaataataatttgtagctatgctttttgatgagttgcacactgagtgcaatatgttggctgcagaatgaccatctttgcagaagcaactctaaggaaagtgatgccacgctaagcacagagtgagttctcaataagtagaccgacttgagcggaagacagaaacagttaagtggagttggcatttccctggttggcaccaaggtctcagggttatttcgaccacaaaattaagttccagctcctagctactaacagagtcacaatatgcagcatggtgatggtcaaaaggcctgagcaagttcaaagcgccgtctctgccggctttggaaccggtttctgtgggaagcaggactctgttgctggggcaggcagatgcttgtgtccatttgcctagaggcagtaaatgtggggctggctggctggctgttggggagctaggactggaatatggggtgggccagtgggccttgctgcatgtagactctgtgctggctgtgttggctagttagttacccaactttatttcaaaaaatgtgtttcgaaccttcagatcgactagcctatctaaaaagagaacttagaaagttattttttttaaaaaaagtcttcttcctacggatttcctgaacatggccattatattctaattctcttgaggctagatcacttatcaaattttcatttcttttcagaagtaattaggagtgatgctaccttgaatccaggtgtgaatttttattgatttttgaggatttggccacgtgttcctttatccaagcctgtcttctgctccatcttatccaaacaaacattgaaccagcaatattcccaagtattccaacttgagaaaaatcttgtgtgtcttgagaaaaatcatttccatgacttattaatgaactaactagggataattttcatagggttcgttaactcagatttatcatagaatacaatttaataagaaacaattaaatggagtaattgaattcaagtccttttttgagtaatgatgttagcattcaatgaccccccctgcccatggttattgaagttatcaatgtatcaattttccccttgaagaaaatcagctgcaaatctcttcgtcaatgcatgggccgcctctcatctgccccctgcaggcctagcccttccttttcccgtccctgctctggtctatggggctgctgtgtgtatagaaaaaaatgaaaggactgatgaccatgtagataatgtttttccaaacataccatcgaggctgtgctacaaaagtgatccagtttggtggtcctttctcttttagagatgcctgttttgacaattcctccttacagtctgctttaatatttaaaagaaggcagtgggggctttaggttaaaattaaagtttcagaggcctgtgtatctttctcagactggttgaacttggaactgtgcaacttttctcaacaattttgccaattaaaaaagtccctttagctgtagatgctgagaaggctgggcctttggttctgctcctaaatgggagtggggaaggtgctcacagaacgatgccaagcaccactgctgtacaacttctgttttatttttgtgtgctttttttataggatataaataatgacaaaaattacaaaatttataactggaagcccaagcttatttacacatatgcttctgtttcagcaaagctcctattaactttgctcctatacaattgcctcctggtaccatattttagtgttatttaactctcattttgctacatacatatcaacagtgaataggcaaaatatatacaaggaactgttcagttcaagtaatttaatattgtattaaaattcttcaacactgaactaaaaccgtatacatttgttagtttgaaataaaatgtagttattcttcaaaactcaccaactgatgaatgtaactgatcatctcagttaggtttaaaataatgtcagttaataaaaaaacattaagacaattccacaatttatcaatatcgctataatgaacttcaaaatgattcacaatatgattgttagaacaatatacattaaaatgttatttttttctataatgatattggtactgtttatataatttgattctacataaatatacattatggtatcatacaaatactccacagagacattaaaaaattaaaataccttaaagaaatgtaagtaaattttatttaatcaaatagtaagcaaactttttttttgtttgtctcaagaaaagttttattactttggaatttcttcttttttttttttgtatttattttttctagaaaaagaaatttttgcaatagaattttattaacacctttctcaaacaaggtttccatgacagaaatcttgacagcaggagcactagatttttttttttttaacatgttctttaaaacactgtgaagattaaaaaacaatcttggcaggctgatggctgcgtcagcacttccgggcctcctgctctagggagcatcaccagtattttgccaccactgagccagtcctcttggtagtagcagtagaaatttaattatttgaaatgaaaccagaaacatccctcgcaactaacctagttttcttatcaatgcattaatgaaacattcttttaataaaaatatttaatacaagacacattttgctgtgcataataaattcctctgctttgaatcattctttccttttgaaccaatcatttggttgaaaggttttctttctctgacataggtgattacatataaaatccacaaatatagaaatggggaaacagaatctcctggcaatcatatcacgggagttgtttttgtccttttgcattaaacgatactcaatgatagaatgattttacagatgctttggaggtgggaggggtagtgctgctctgatttcacctttaaaactgctgacagtgaaagcatacttttaggcagtattagagatcccctttacttttttttttttttttttttttttaaagaaaaggtattattttccccaaatgaagcaaagcaagtactggggcggagtcatcagaaataccttgggaggtggtggggaggggagtcgggagcatcagggaaaacccatctcaactcacgcctctcaggggttgcgactggaaagtcttgcgttttccatcactggtgcagaaagaacttccccaggaatggccagtggcctttcgcccgtaacaaggccgcacgctcagagcagtcttcctcctgggctgggtggacgcggaggcgcgaaggaaagcctgctccgggaccgcttggcgagcaaggcaccgcgaggacaggaggacggcgagtatcagaaaatcgtggtttcatacttggtattaatgcccctcttggcttcttggcccggctccacaatccacggtagattggccagagtcttttgctcagatgggtcgatctgctttaaaacagaaaggctgatgcctgttatacggtcgccgcgcgggtgcgcgcatgcacgcggacgccgctggcgaacccacgcgaggcccctcgccccaggcgcggggcggcgatgctggtctaggcggctcgcgggctcgctctttggacacacatttaccgcataccgactctctgcagggcaccctgagggtgacggtgaataaggcacagcccttgcccttgtgagcacacagacggggagcagacagaggcggatttcagtgctgagaggtgagatacgaggggaagagagggcaccatgtgggcacacacaccttgggagccaggggggcttcctggaggaggtgaatcaggcatgccactccccggctctcactctccagtggtttccatcacagtcagtcagaacaaaacccgaactcctcaccgtgacctccagtacccctgcccacctgatttttctgctgcagccacacagcttccttgctcttcctgcccgccaagcccacgcccagggcctctgcgctcatcatctgctctgcccgagttcccttctccagacacctgcatgcctcatgctctaatgccattcaggtctctgctcaaatgccacttccactggcacctgtattcctagaagcctttcctgtttactcctacaaaaagcaccccaacttttctgctctcctcttctgccttattcctgacaatacttattgccgctatgcgtcatcacatatttatttgttcatcctccactgccacgtatgctcatggaggcaggattttgtctgttttcatcactgccattttctccaaaacgcagaaaagctcctggcaaccccgtaaataataggcacacaataaatacttgttgaataaatggtatcaaaagaatgaggtaatatttaaatggacagccgaaggaccagcaagtatttgcctgaagacaggaggagggggcatttgaagtagatgaaacagcacatgcagcagtcccagaataatctatacaacagaatgaaacacagcctcatcttccactatatacagaaatcaactcaaaatggattaaagacttagagggaagacctgagacgatgaaagaactggaagaaaacattggggaaacactacaggacattggtctggataaagattttttgggtaaaatctcaaaagcacaggcaacgaaagcagaaagagacaaatggaattacatcaagtgaaaaagcttctgcacagcgaaggaaacaatcaacaaagcgaaaagacaacctacagaatgggagaaaatatttgcaaagtatccatctgacaagggattaacaaccagaataaataagggactcaaataactcaatagcaaaaaacaaaaataaaaaacaaaaacaaaaacaaaaccaactcaatctgattaagtaacaggcaatagaactgaacaggcatttctaaaaagacgacatacaaacggccaacaggtataggtaaaaatgctcaacatcactaatcatcagggacatgcaaatgacaatcacaatgtgatacgatctcacccccgctactattgaatggctagtatcaaaaagacaaaaactaatggatgctgatgaggctacagagaaagggaaacacttctacactgttggtaggaatctaaattaggaaaggcactatggagaatagcatggagggtcctcaaaaaactaaaaattgagctaccatatgttccagcaaccccactactgcgtatatatacaaaagaaaagaaatcagtatatcaaagagatatctgcactcccatgtttattgcagaattattcacagcagccaagacatggaatcaaactaagtgtccatcaatggacgaatgggtaaagaaaatgtggtatatatacacaacggaatactattcagccataaaaagaatgagatcctgtcatttgcagcaacatgaatgaactgaaggtcattatgttgagtgaaataagccagacacagaaagacaaatattgtatgttctcatatgtggaggctataaaaagtggatctcatggagattgagtagaatggtggttaccagaggctggaaagtgaagaagggagagtagggatgaagagagattggttaataggtacaaaaatatggttaaatagaaggagtaagttctagtatttgatagcacagtagggtgactgtagttaacaacaatttattgtatatttcaaaataactagaagaattgtaatttctcaatacaaaagaaaaatatttgaggagatggatatctcaattactgatatgatcattacatattgtatacatgtgtcaaaatatcacatagcaataaaaaacagtcccagaggtaagggaaaatggtcgttgaggggttggggtcagtttgcagggtggggagcgggaaggcagacagctaagggtgaggaggtgagcagggacccagtcaggctaagccttgagacaaatcctaaaatggtttcgtccctgtgcgtacaaatacaacgggacactcctggggcggggccgggctgtccgctctcaggaacggccctcaggtggatctacaccatggctgcctcttcctttggtgtttccaggtctgcctgccctgtcctagctgcctgctcttctcagagcctgaggttgtgggaaggcctctcccatttctctggcaccatgagctttgcagctgccttctaccgtgccttgactgtatctccataaagctgtggggaggacctcacgtgttcttagggatcactgaatatttcttaccaagaaatgcctggggctgaaggaactagaatactaatgcctgtcgagggggactgatcttgaagcacataaataacatcagtattattcactgtatattttcctatttcccttgaaggcatctggatgaatattctatgagctcttatgccacccaaccctttgtgctcttctggaagaagcctgtggggaccagggtaaggtcagatagaggcacctgctgtgaacagatttattcagcccacatgagaatgaatacaatagtctaagagataatctctaaaacattctgcaaattcctggacacttagcagcctaatcaatctcaaagatatgcttgtgaaatccatccacaggccctcattttgtcatccacagatattcactgaacacctgctatgggcctggttccggtggtgacaacacaggtggggtccctgtgtgcatgaaacttacatttttttttttgagacggagtcctgctctgtcgcccaggctggagtgcagtggctcaatctctgctcgctgcaagctccgcctcccgggtgcaagccattctcctgcctcagcctccctagtagctgggactacaggcacccaccaccacgcccagctaacttttttttttttttgtatttttagtagagacggggtttcaccgtgttagccaggagaatctcgatctcctgacctcgtgatctgcccgcttcggactcccaaagtgctgggattacaggcgtgagccaccgtgcccggcccaaaacttagatttttgtggaggaagatagacaataagccatcagtaaaaaaccctcaattaataaatgctacacagaattaaaagcagatgacatgcttgaaggtgactgggtatctatgtcagattgggtggttaggacatccgcctcttcaagtagccgagacctgaatgacaagatgaagtcagccatgcagaaaccgggggaggatattccaggtgtggggagcaggtggcataaaggcctcaggtaggagtgagcattacatagtcaaggaatgggaagagctgagcatcacagaggactgtggtgggaaactgcattctgggtacttggggcagagggtgccatgactgatctctgctgtgtggggaggggagtctcaaggagctatactgcataggcctggggcgaggtggcagtggccccgactggaagagagatggaggaagtggggaagagtggacaggattgagatatattttaggggtagggtggatgggatttgctcatgggctggatacagaggtaaggggaagacagggatccaggctgacttgtagactttgggcttgagttgcatggtgagtggctgtggggtggggaagttggtgagagaagagctttgaggggaaaatcaggaattgtgtcctggacatgctaagtttcagatgtctgtgaagcatcaaggtggaaatgtgaaagaagctggccacgtgagtctggaattggggggtgcccagggctggagatacagaactgggagccagtgtgttgggttgggtcagtgctgaatgggaggaccaggggctcagagcgtggcatcggaagaaagacttcagaggagatacagctcctggggatggctggtaatgagtgatggacacaggagcgaatggccggggctggagggaaagatcccgaaagtaaactgtcagggaactgtgagaccagatgctggaggggtcaatcctgtggatgttgatggtgccaagaagggtgacaggggtaggcccccaaaagaagactgaaaacaagaactgcatgttcacaaagggaggtgcctccctgcaaatgttaaaaatgcctgctgctgttccccatgacagtggaggtgggggctggtgagaaggaggagagacagttccagatggaaggattcgggggcgtgagagcaatgcattctgggggagtcccagggtttctaggatgcaatacggcagccggggcagaaaccagatgggaggctggttgggaatcttccagcttttgaatattgctactaccagaggaggccgctttgaagtcatgcaagcctgttgggacaggatgtctgcagagcctgtgggagggaaggggaagaaattcctggaggaaggcagatgctgagaaggaggggctgcaccttctgaacaggcaccatgccgcaggaagcctcagctgcgggagacaaagcacgcaggccatggcgcaggccttgcatatagcagggcagcctgtgcatccagcttcctctagctggggaccgaggacatcatcactgtgtacctctgcaaacctctctggaggccaggggcttgtaggaggctttgccctctgatgggatggcagctgaagccccagggaacactgctcccaagctttcctgaatctttaggtaagattcaccaagaacagcagtacctgctgctgagacccttcatagggttgctgcaggtgactgagaaagtggatttctctggaggctccaggttgagggagatggtgcccaagacttggtgggaaccaggcagaggtgatgatggacacatgccaggaggaggccaagggaaaggatgaagaagaggccctgggttctaatggcacccacaccacacaagggcctggttagcagccccttttcctcctgttcaaggttttttagaacatctgtatcgtttctacttaccacggacttgcgaatgctaacgcggggcttggggatgggtttggagggtttgttttcaaagctttctggaagtgtggaggagtgtcccccttttcttgcttgtagtgctagctggtaagcgacttcgaatgcctgtcccagggttaggatgatttcataggctaaattctgcaagaaaaatgagaaagcatttgctactggcacactgcaaattagaatgggtcgaatggctgaggaacactgagggaggtgaactagggaggaacttgaactacttcaccagaggcagcagcgattcggtggaaatctacaaagaacaggacactccgggtccaacttagggtttacaccaggctttagtcatttgtgaaaagaaaaatcttgggacctcaaatcactaagacaaacgaaaaagtcagctgggaactgtgttgggcaaacctgccttgcattctattcctaaataagatagctacaaagataaaaaagctacatacctccctcacaatttgcccaaaaggaaatttcctgtggacaaaagacagagctcaaagtcatgcctctgctcatgtgagataaatgcatatcagattgcttcccctgtcctgttgtttccctaagccagactaaggcataagtgactattcctgtaaattgtgtattcagtgaaaggctgatcttcagaaactcaaaataattcaactgtttgtctcttatctacctatggcctggaagcccccttcccatttctagttgtcctgcctttccagaccaaaccaacgtacttcttacacatactgattgatgtctcatgcctccctaaaatgtataaagccaagctgtgccctgaccaccttgggcacatggtctcaggacctcccaaggctgtgtcacgggtgcattttttttcttttttttttttagatggagtctcactcttgtcacccaggctggagtgcagtggcacaatcttggctcactgcaacctccacctcccgggttcaagcgattctcttgcctcagcctcccgagtagctgggactacaggcacgtgccaccacgcccagctgatttttgtatttttagtagagacggggtttcactatgttggccaggctggtctcatattcctgacctcatgatccacccgcctcagcctcccaaagtgctgggattgcaggagtgagccaccacgcctggtccacgggtgcatctttaagcttggcaaaataaattgactgagacttgtctcagatatttttggtttacacactgatagggcactcttgcttacagatccccagttagccccaggaggagcaggccccacagcccagtggccccaggagcccacaccattcaaagctctccctgtgggcagttggtttgtccccaaggccttggaaggtaaggggttactactggtatttctgctgagtcctgggagcacttcaaccttgcctgtgaggatgatcccacacactccacaggaggtgttcctgagaagtttgggtctttttacctcaaacatctgtgattcagtgaacatctacgaaacacaatcaaaatctaatttaggcctagaggagaggcattagtcatgctggtgtggcggctcacagtcgcagcagtgagcacgcaaacagtgctccaacagagccaattccccagctatttcttgaggcttttgctctccctgtgggtccactctatattttatcatgaaatcagcaagagacaggtgattctgtcaggctagatgccacgccaagcagcgcctgggagaaaagttcttttcttccgaccttcaatcagtccttttctcaagatgatttctagctttcttctcttctccaaatgtgtatctttgatttctgccttttcttccaagcacagcttccccttgtcttctctcactgagaaaccatcacattgtctgacccaaaagaggcagggtggccaccacaccctgaggtcacagagcatcagagaagcagatgcatactggtcacagagagtgttctgaaggtcactgtagcagctgagagcaggcatggtctgccccaagctttcttttttcttttttttttgagacagagttttgctctttttgcccaggctggagtgcaatggcacaatctcggctcactgccacctccacctcttgggttcaagtaattctcctgcctcagcctcccaagtagctgagattacaggcatgcaccaccatgcccagctaattttgtatttttagtagagatggggtttctccatgttggtcaggctgagcttgaactccccacatcaggggatccacccacctcggcctccaaagtgctgggattataggtgtaagccaccgtgcctgaccatccaagttttcattctgatgaatgtccctagaatgtccactcacggtttctcaaaaatcacagaaatgtcattctgctgatgctgatattgcaactaagctggccctctctgttcctgcccatctccaccctcatcaagcgctctgggagcccgattcccacactgctgctggggagatgtgtttgcgattgttcgcatttgaagatgatggagaggaagatgcaggatggtgccttctgaggccatgggaaagaggcccaagggttctagaccaaccagattccagatccatgccagatcaattgtgatggtctcagaaccaagtggggaaaatgcctctgagcttgagagtcggtttgagagaggatgtgtctgtctcctttaagtgagttgctaggaaatactgaccctacaagacagacatctgcctgctggagatactgcaccttgcacagcaagctgagcacttccttgcaacgaacactgagcccatgtttgcctccagagatgagtcagcctagtaaattagtaacgcaccagcaaatgatagtggaggaggtctgggagacagctctgaccatcactgcacaaagagggctgagctctttccactgcctacacttggcactcacgtcactgtcagctttgcctcttagtgtttgcgtgggtcccctctgaaaggcaggcagggcttccgacttctgtagtctcacaatgaagacacaggctcttggtcttgttcatgctactgtggaagatggctgattcccatctgttggggacatgtaccagatattcctgttctgggtgggaaactagactaagatgaaggtgtgagattcagtgattctgtaacatgtggtctttatctgctgtaacagtggaacttaatgagtgtgaattcctttaccattaacctaaaaacaagttactgaaagcgagatctacttaaagctccaggatcttcaaaggaaagtaaaaagaccttcatttgagcaagtgaggtttttcacatgattatgggaagcctaaaggttttgggagagaatgtgttagaagtcctgccctttcatttttaattagttcctggtattaggaaactgctcaaataagacacacagaccagactgttggattaagttttcctgcctaatggcttcttctggttccgcttacattttccttgacttcttgctttggttttattttagaatgctttgtcaagtttcttttgtgattatgtatagtacaggattggacactgttacctttcctctcttgtctgcagccctcctgtttgtggtactgatgctggatgccaggagggcccatgggcaccgagacacaccttccaagtgctgtgttgcccatcccgacacaccagggccctttcggggaaacagatgctcatcccatgggacctcaggacacatgtgtgaatggggaaagaacccccatttttttgtaggttcaattctcctgcctctcctattaacatccctaccatctgaaacgggaggagagttgctatcatgtacgaggagactctaccgggatgaggttgaaaattatattgtaacatcagaaggcttaggtgagaagcccatcttgcaaacctcaatgatgctggctggctctgaagagcccatggtgacacccagaaaatctgaaagcccaactgtctctgccttcaacatattatccctgcaactgtggggaggccaacgcctggtactgggtctggcacattccaggtgcagaagaaatgcttgcttgcttgctgaatgaatgaatgaatatccacaggactaactggagtaatcgtaacatttctagttaatactcagtctagctaccattaagggagaacttaataggtgtgagagatgtgccaagcattatctttgtttcatttaagtcttaccaaatcacatgcagtagcatattatcctcattttatagatgaggcagtggaggctcagaggggtgaaataactttccagacatcacagagacagaaagttacagaacttgacatgacccaatatctgtgctcaaaatcccccactcttggcccaacccatgtgtctacccagcttgtctctaagatgactgccatcaactctcccctcccgtgcacaccatggtgttcccctgttgagaagtcgaatctgctctttgaatctggactggttttactgacttgcttgacccataggatatagcagaagcaacatgctgaatttgtgaggttgaatcatgaggagtcttgcagtttcctcctgggcctctaggaacattactctgggggaattagtcatgtaaaaagtctcaccatcctggctggatgcggtgactcacgcctgtaattccagcactttgggaggctgatattgtttagctgtgtccccacccaaatctcatcttgaattctagctcccataattcccacgtgttgtgagagggacctggtgggaggtaattgaatcatgggggtgggtctttcccatgctgttcttgtgatagtgaataagtctcacaagatctgatagttttataaatgggagttcccctgtacatgctctcttgcctactgccacataagatgtgcctttgcttcttctttgtcttctgccataggcctccccagccatgtggaactgtgagtccattaaacctctttcctttataaattacccagtctcgggtatgtctttattagcagtattagaacagactaatatagaggctgaggtgggtggatcacttgaggtcaggagttcaagaccagtctggccattagtgaaaccccatccctactaaaaatacaaaaaaaaaaaaaaaaaaaattagccaggctttgtggcaggcacctgtaatcccagctacttgggaggctgaggcaggagaattgcttgaacctgggaggcagaggttgcagtgaaccgaggttgtgtgactgcactccagcctgggtgacagagcgagactccatctatctttttttttttttttttgagatggagtcttgcccttgttgcccaggctggagtacaatggcgcgatcttggctcactgcaacctgtgcctcctggcttcaagggattctcctgcctcagcctcccgagtggctgggattacaggcgcccaccaccacgcctggctacttttttgtatttttagtaaagacaagatttcaccatgttggccaggctggtcttgaactcctgtcctcaggtgatccatccgcctcggcctcccaaagtgctgggattacaggcatgagccaccgcacccagctgagactcaatcttaaaaaaaaaaggaaaaaaaaaaaagttcttgctatcctgagatcatcatgctatgagaatgcctgagctagccacaaggagaggctgcctggacaggaacaacggtttcagccaggccagcccaggctcaagatttgggagtgaaggggtctcaaagacattggagctccagcagacatcgcttggagaagactcaagacccagacagatggctccagtcgggctgccccagcatctccagccattgcaggcactctggctgaggccccagatgttgttgagcaggactgccacgcccagcccagatccctgacttacagaattgtgaacataataaatggatgttgttttatattttggggtggtttattacgcagcaagagataactggaacaccatgcgatgctgcagaaggctggttggaccctcattcagacaacaggaagatgacccatgagcccaggagctgtgatgaatgctgcttagccaggaggccaatcctggagccacccggtcccctggctgccctggctgtggggaagctcactgatcacagtgagcactaaggtgtcccatcccatctgctggctcaaaccactgtgctgcagtgaagtcagcaaaatcatgctctcatctccagttactacctcccttgggcataaattcaaactcatttagttttacttttattacctcacgtctctcgaatgctgtaacctggcctgtctccgaccttggctcttcctgtctcatataagctcattggaagatacttgctttggtctttctagcataagtcttttgagacacatttattacggcgattggtctggagtattgtctaccttacagagaccaccagtgaaagagagctgcatgtgtgtgcatgtgtgcacgtgtgtgtgtgtgtgtgtgtgcacacggggtgcaggtgtgagggttgattactgaaaacagcatactctgagccttggttttctcatcttaaaatggggataataccatacgcagtaccccctaactggattgttctgataatggctaataatattatttaaccaaatggcaataccggctagcatttattatttactatgtggccatgcaccatgctaagtgcttcaacatgggctctttaattcaatcctaaccgtatctgtatgccgtaggtctattacttccattttgcacatgagataattacgctcagaaaggttaaataacttgctcatgaagtcagcacccagacaaactgggatttgaatccagttgttctttctgagaggctatactcttcttgaccattacaccttaaaactatacataagataaaataaaaaaaattctgtaatctgttttaaaaagtttaaaaaacatgtgagccaattgagcttccaagtgactgacccatcttggctgtggtgaggtcacctactggcccattgcctgggtctcatgcccagtctggctgagaggcagcctccaggccgggggtgtacttcgtgactccacagagaccatcaacacaggaattcttcatctttggcttccccaagggtgaggtaaaagatacgaggcaactcccatcctcagtagtggctatttaggaagaagggtagggagtcccagtccaatggggaaaaacctcctggaaagcacaggaattcccctcttcccttcccttctcttctcttcttccccagggatttttcttttttcttttcttttcttttccttccttttttttttttttttttgagatagggtctcactctcttacctaggctggagtgcagtggtgtgatctcagcttactgccatctccacctcccgggttcaagtgattctcctgcctcagcctcctgagtggctgggattataggcgtgcacgcctggctaatttttttttttttttttatggcagagatggggtttcactgtgttggccaggctggtctcgagctcctggcctcaagtgatcctcctgcctgggcctcccaaagtgctagaattataggcatgaaccactgtgcccggcctgggattttgatctgcgaattaagaactgctacattagaggagcttaaggaaccactgtatcataaagataaatcctaaggcaatcaagggatgcaaactcacttttcttgtgcaagctgaagatatgcaggtcagcttatatttactgtggtttcttcaaggcaatcatggatattgaacatcaccacagatatttaccaagctccttccaagtgttaagggctgtgtccctggtgccagtcccatgcctagcctatagacaatgtccaggaagtgatcactgaatgacatgggggagtaaaagtgtccatcaagactctcattacatccagaggaggctcatggagagacaaagagatcttcctcgctgtcctcccgcatccttgtccccgaggctatacgcagcatattcatcggtctagtatgagaaaaattgcatcatagatggtgggcaatctgtcccctagaaaaagctctagccaccaaggtaattaatttattttaactggtacatcactaagatttttgtttcttagtttgaaaatctcttaggcacaagggttcactgatacatgtgcaaaaatattcattaaagtgtttaaatttttcattattagaggactgattaagtagaatactaggtagccatttaacatgaaaactggaggcgggtggattgcctgagctcaggagttcaagaccaccccgggcaacatggtgaaacgctgtctctactaaaatacaaaaaattagctgggcgtggtggtgcacatctgtaatcccagctactcggggggctgaggcaggagactcgcttgagcccaggaggtgaagattgcaatgagccgaggtcgcaccactgcattccagcctgggtgacagagtgagactccgtctaaaaataaataaataaaataaataaatcaataatgggttaaaagactacgtaaaaatatatgtatacatatacacatagataggatctgtatatatgcatagaaaatagcaatatggatcaaatgtgaatagtagttatcactgcgtattgagactggatgatttctatttttgtattttggaactttatttaaatgaggattaatgatgtttacagtcataaaataatctttccattttgataattaaaaacaagagaaagtcttttgcgtttaaaatagtcttattcttgctttttttttttgagacagggtcttgctctgttgtccaggctggagtgcagtggcacagtcatggctcacagaaagcttgacctcccaggctcacatgatcctctcacctcagcctctggagtagctgggaccacaggtaatgtgtcatcacacctggctgatttttgtatgttttttagagacagggtttcaacatgttgcccaggatggatcttattctttctgcatcaccttggggttctgagggtctcttcattctctggctgagagggctgggaactactttccagcaaaatctggaacctctctgcaggtgctgtcatggctcacctctatgtgccaggaagctgcccattcatttggcaaagaatcttgtttaggctcttcagttttcatactggatgccaattctaacatcttctcagtgagactttgaagtatcaagctcttcctttaagctgcaaccctaatacttctactccaagtgcggaattgaccctttaatggtccaacttctgccaagcccaagtgaaaaatgttgttacgtggatattaacttatagacatgcagtcaatccgctcttgtagctgtgcaaagtttgatctctgcacgaagtcaaactgcctatgaacttgaactgtattttatttcctttcataatgatgataaagcagtggcagcagcaactacacatgatattgcctactacatcctagggacgaggctaagtgccttctgtggattgtctaccccttacaacaccttacagaggaggaatgaccatcctcattttacgtgtgagaaactaaggatcagcgaaattgacaacttggccaagttcatacagcagagccaggattcaagtgcagatctgacttcagattagccagtgtttcatgccactgggctatcctaccttcattgctctcatgaatgtgctggtcttctgtgcctatttcattgaggcaccctctagaacaccatcttgtgttttggagattcactgtacaaatgttggtgaagacattattacacagtatcccctcatgggggcctaggacagaaagttccttcatacttaagtcttattaaaatactattttcggaagggaaggggtatacttttctttcaaagaaatatgcagcataaaattactgcatttccctttttgccttgacctccaggaagctcagagctaaaagctcagagctagagagagcccagctcccatacctttccacaactccatggtctgtatattgatgctacaacttttcccttgatatggagcttccttttagcctatattttccctaattcagatttgtgtgtatgtatatatatattttcagactactatacctattcatgtaggctgtcttcaatccgttatggaatgaggcatggtagaaacactgtccatttgttcacttagatatttattccaggacttactttgttgaatgcattgctgcccaaatggctgacaaggtatgtcaggcataaagcttcatctcatctggcgaatatgacgaaggagtaaggaatctgaggaggaggccatccagggaggaaaggccctcctgacccaggctgggaggctgctctttctgagtggaccattttgacctgccttgcagtgctttgcattaccattagaaacacaatggccacattttcatgactggaatggaatgaacaaatgtattcattccatagcatcagagagctgcaggcccagacaggggtcagcagaagctcacccacaccatgaagagggcacagatgcagacacgttcaagggaagggctgtgtctgtatgtgggagtccagggcagaaaagcttgggtgtcataaagtaccttgagatgtctgattgaaaagtgtctatcagtgaatagaggccataaacagagtccctggatcacctgcataggccagctccaccatgggctacctacctacagcacctattgccactgagaagtgggtgtggtccaggtgacctattggtccctttccaccctgggagtttcaggattctctgattagaaggggctatcttttacccagtcaactacagattcagtttagagatgcacgcacagttgatgctgtgctaaacagtggcatgttacccagaggccagactgcagggctccataacccaccagctagagctcagagaggcagtcaccaccaacgggctgcccttcatctcagaaaacaccttcattccagcaatcacccctaaatgctattccaaatggccaagcatttcatctattacaaaatggatttgttcttggcaatacatgcgtttgccatctcccacctttgcctggtgagttactgcttatccttgaagactcacctcgggcatcatatctccagaagccttctttgaatctcctttcctgtcctcccaaccctggctaagttaggtgcccctcctctgcggtgccacaataccttgggcacagccctacttaccacgtggtatttattatgattttctccttatagggctgattcccccagttgactgagctccttgagggctctggtctcactgggctttgcatctctagggcttagaataggtcaggtgctcaagaaatgtttgttggctaaacacaaaaaggaagttgcctggtaggtccctaagataagggaacttgcaccttaaggttaagaaaagggggaatatggatggccagagccaattccttccttctgtcttctctcccacaggcagacctgaagaacaaaagctagacaagtgcagataatgccacagggggcctgaagacacaagaaggtttttttcaatctgggttctcagtggggtctccagaaagaagcgacatttctttttaggctatattttgcttgtacttgtttttttaagacctggggtaagcctggtctacaacttgcttcacccacgtccggaggcaaaaataacttcgagaatattctgggcatattcacagacttcattgacatctctttagctctacctatagttagttctctcaagtaccagccagaaattagtcttcatagattgtacagaaataaatagtgcccaatcatagccttcagcatttagaaacaaatattagcaattctgctaagatgtctatctggggcaagatgacaaatcaactggccaaaatgcaggtagcttctttagggctaattttggctaactaaaagagccacgagattcctttatctccctaattataacaggggcagatgtagaaaattttgaaaatactaagaataaaggaaaaaataaaattcagctgtgaaattccactgttgggatatggctactgctaacatcttggtgcattttctttttatatttgtatatacacccaaatactttcatttcctatatgaatatttaaatatgaatttaaaaactagaatactttatgagtctaaaatcataacatattttatgtgcagtctcataagttccttttttgcgcaacattatctcatagttggtcttcgcatgccattacacgttcttcaaaaaccagatttttaaagggggtgagcgttccactgtatctgctgaggtttaactttatgcctcaccccaagtataggaggttgggccttactttgttaaaccacaacttgctttcttatattaatagcattccaggttccctgtggatgtcatgcactgcagcccaacacactggtcacctgtcttcatggaaccacagcctaaggtggctggccagcagccctgtcacacccatccagagggactggcctgcctgggaggaagaaacatgcaatctttatcctgtaacttggccagggtttgtgcaaaggtggtacaggaggaagaaatgccagatttcaacctctcccctgctcctcaaaagaaaaagctccagtggaagctgtagggaactcttcactaactttttgtttttttcaagacagggtctcactgtgttacccaggctggagtgcagtggcacgatctcagctcactgcaaccttcgcctcctgggttcaagcaattctccagcctcagtctcctgagtagctgggattacaggtgcctgccaccgtgcctggctaattttttgcatttttagtagagatagggtttcaccatgttggccaggctggtcacaaactcccaacctcaagtgatccgcccgcctcagcctcctaaagtgctgggattacaggcgtgagccaccgcgcctggcttcttcactaacttgtgaggcattggacatgggtcactcaccagattcaaaccttttaaatttgaacccttgttgtttaaatctttctcaaatggatatgcctgtttccttggtttagtcagcacagcaaatataaatggcttttcctttacttattgcagatgcctacctgataccctgagttcactattctaaattgaattaatgagttgccgtgcctccaaaccgaccacgtgttcactcacacagactaagtgttcagcttccaacctgcgcgtccctcctcttggagagcccaccctgctggctgctggtgcagtgcccgggtggcatggatctgattctgttgtaactatttgcttgtgtcccttcatctcctgctggaccatgagctcctggagagcagggatgtgtgtctaatgcatggcaggcactctatcaatacaggaatgcattttatgtggaatctgacttttttcctcagatgtggaagcacgcagcaacaaacatatgtcgtgaatcaaaaaccgggacataaagcctcacacagggtctgacaagaatataagcatcactattaactgcttctgctattctctgtgtcctcggcagctaagagttattgaataccatgtgctggaaatgcgtatgtgtcaccttgtttaatccttgcaatcaccataggaggtgtcctattataatctctattttacagattaggaaactgaagactagaggcattcttttttattttttgagtcagagtcttgctcagtcacccaggctggagtgcagtggcaccatcttggctcactgcaacctctgcctcctggttcaagtgattctcatgcctcagcctcccaagtagctgggattacaggtgtgtaccaccacgcctggctaatttttgtatttttagtagagatggggtttcaccatgctggtctggccagtcttgaactcctgagctcaggagatccacctgcctcagcatcccaaagtgctgagattacaggtgtaagccactgcacctggcctttatttttctgagacagagtctcatcctgtcacccaggctagagtgcagtggtgcgatctctgctcactgtactcactgtaacctccgcctcccaggttcgagtgattctcctgtctcagccttaggttcaagcagttctcctgcctcagcctcccaagtagctgggattacaggtgtgcaccaccatgccaggctaatttttgtatctttagtagagacagggttttaccatgttggccaggctagtctgggactcttgaccttaggtgatccgcctgccttggtttcccaaatgctgggattacaggcatgagccatcgtgcctggcccatggcattctcgcccaaactatgaagctaagagtgcagatctgggattcaaaaccagactgattctaaaggccaccccctgatcatgacacttgactgccagttatttagaagtggggggtgcaacaaatacatgcataaatgctgcaaagcaatctgtgaaaacaatttcagaatgtctggtttctaacttcacaaaaaatgggattaatttaaggcactgaaaactttgtctccccacccccaaaatagggatgagaagatctctgaatatccaaccacctttgtctttgtggcctggttagttctcagtgatttatgccaatggagaggagatctggataaatgaaacccagcactgttaatttatctattcttttttgggaggtggtggtgttagtgtagaaggaccattggaatgcgatgctgtcttttttattccatcagggccatttgctcctcttaggagctgcgtccttcctgcagctgacttgctggtgagtttcagctggctggacagggccagggaacggcttctcttttacctgtaggttgccactttgtatgcagaagagtaaccagggaaagtgttcgagttcaatttttaagggctctatgcattgtgacattttcttatattgccatttcttttcacagtatcacagtcaaataggttgaagtctattttcaggtggagaaaatgagaaacagaatgagagagatcacccgcctccatgatattaattcaattgtcagaggtgaactaacatcaataatagcaagagttcttttgcatctttaagttctcactttgtgggacaatctctgcaacataagccataaatatttttcttcagggacctcaaactactccatggaagtaatctcggcatttaaaaaagcactcaagaatttaaatttttctttcctttttttttgagacagagtcttgttctgttgcctaggctggagtgcagtggtgcaatcacagctcagtgtctcctaggcccaagagatcctcccacctcagcctcccgagtagctggcactacatgtgtgtgccaccatgcctggctattatttattaatttttttttttttttttgcagacatggggttgccctatgttgcccaggctggtcttgaactcctggagtcaagtgatcctcctgcctcagcctcccaaagtgctggggattacaggcatgagctactgtgcccagccaggaatttaaattttattaaactgatgagaaaaccaacaagcaaactcatagcagagccaaagttggaagtggtgtaggtatcactgatcacgaccacgtggttgatgctagtgtttttcttgccccacactttggctggctttgtgcatatggatgggagagtactacagaaggtgatcacacagtcggatgaccatgttttcctgcgttttgtcacttctgtttctccagcttagatcctcacatggcccacattcagccaagaaagcacagggaagagggagctccgtctcccacacgtcccacccaccctgcaccacgtcttcaacattctctacgcactcctgagaccgtctcagcctcgccatgtgctgcacaccgaggagcacaggatttgggagttgcaagtgaaaaatgagcatggttaaaaatatcaaagactgcaaacatattcttttcagaggagtgagaattagcaagggtctggcagcaaagccatggcttttaatgctattaaaaaggaagaacaccttttaacatttaaaactattgaatgaggctcttctcagatatttgatacaaatctgatactcccatggagaatgcatcaaaatctttctatgttgacttacatcaactctctattactgagaaatctagagtaactaagcaaataaaatacagaagacaacagttttgaaattaccttggttgtctctctctctcacctatagtggccttttgaggacgatcacttcagcctcgggatctggtggccactgaaatacccattccctctctggcagtcccatttgtgtagaattctctccactcatttaagagcagaggagagaaaagctgagtccatttttaactctcacaactcctagtctcataacacatccttcttttctgctcaccctacagttccctcttccccaagttctcactgcccagaaggtggagtttggggaagcttttgttctacagtgggtgagatgtgtttcaggcctagcaagttagggatatgattagaaatcagctatgacaacaacgagagcatagactccagaatacagagcaggcttggtgcttgcttgtgtgtatatattggcttttttcttgacaaccctaattctgttttgctctagtctttttattttcatctccccatcatttaaaactgaaaatatcacaagctgaatttatggtagattccaagcaacaaaagcaggcttagagatcatcaaatgtaacattttccaaaatgtgttctgcagaaggccacccctgtggggtgctctctaaaaaaaaaaaaaaaaaaaaaaaaaaggccgggcacggtggctcatgcctgtaatcccagcactttgggaggccgaggcgggcggatcacaaggtcgggagatcgggaccatcttggctaacatggtgaaacccggtctctactaaaaatacaaaaaattagccgggcgtgctggcgggtgcctgtagtcccagctgctcaggaggctgaggcaggagaatggcgtgaacccgggaggcggagcttgcagtgagcagagatcgtgccactgcactccagcttgggcgacagagcgagactccatctcaaaaaaaaaaaaaaaaaaatggctaccatggccaaataagcttaagaagccccgcacactccacccccgcctcacatctgagcacattcagggccctgcagagtcccatagtacgtaaactatgttaagctcacatcctagcttctgtagggggggctccaggcctcctttctcggactacaatttctatgagaaaatgctctgaacttcaaatctaactgtccataaactggaaacttcctagacatcactgaattttcttgatgatatcagataaaaacatgggatatgtgataacagtacataaaaacatgtgacccataaaaggtctttaaggtccaaaaagcagtaacttcacaattaaaaatgtatacatacttatttagctaaaaggttaaatgtgtatttgaggtattatagggtcttctttactttttttttttttttttttttttttttttgccatttggggcagcccaggggactgattcatatcaaaagaattttaagccttcaagactggactggtattgaactgccctacataaggatacaaaatccatgctcaaagaagctttttttagtgcaagtgaagcttgttgcatctcagaattgctcaaagtcccaggtcaagggtggtggcctttgttactaattttgaggtttgacaaactgttcacctggagaagattaaaatggaggatctgtgtaagatgaaagtcctttggagctggtatgagaatcctaagctagtaatgtttacattaaatcaaacatctggatgaaaagataaatgttaaggcaattctctacatgtttttctaagtgtatcagggatataacgttcatcataaaactaaacagttgactatttcttcccccaacatttcacctcagtattctggtgatatatatatatcacacacacgtatagctaataaactcaagggggcagatagtccacagaaaccagttttagtttcatgtggaaaaatactttagatactctgatgaaggcaaattatatattaccttaaaaaccaattttattgaaagaaatgctgcaatacttaggaaaaaggtggcgttcatcctgaaaagtatcagaatattcatgttgatgttcaatgcaaacacggtctagaggcagcaagctctgtggagtcaatgttttctttctgctatttctattttaatgtttatttattgctttcactttttcaatcctttcgtaatggcagtaggaaaactttggaagataaatacacatctgacaaacctatcttatgtcttttagcagaaaaagggtcaggctgttaactgacgtcagcaggcagggagagggaggaggtgaaggaacaaatgctgaacacctgttatttatgaagcactctacatatgttctttcatttcactcctggtgaaaacctgcaaggtagaaactcttgtctctgttctctagctatgaaaattaggactgggaaaagtccagcaacttctctaagaccagagagtagagagatagctgatttgggatgtgaactttggtattccgttctttctatgacatcaatccaacccctatagagaaaggtatttcacataaaccaaaatagatgtgaacaggatgaaatttgactgtataaagaaacaatcaaattttacaagaattgcaagttatgtttaaggcaccagaaacctaacactgcacatccttgtaaaccctgaatgaaatggctttaatcaacactttaatcccgtgcaaacaaacgcttcctgagatatttagagcagtctcgcagggctttgctttgcagtctttactgttaccacagactacttttatatcactctcctcaagcctccccaaatggaagggtttgtttttttttttaaaggcccatgatcattctttcccattttcaatctttctttaaaaaccaaaaggggtgaggaacatgtagcatgatacaaatgctctgagcatgaactgcctgactcacggaccttaagctggtatagattttggattacagttggccttggcctataggtgttcatcagaactggaaaacattgcttcaggcagtcttctacccatgacattgaactgggggctggcctctcacgaatatatgaatacgtgattcctgattctttaaatatgtatatttcaaacccagtgagcagagcagaatcatcaaacttaagtggcattttcaaattcttctgattataaattattaatatactatatcagagatatcctcaagcaatttgtaccaccttgagggcatatcaatcttaaagaaacatttgttatttcctttaattgtttccattttccaagtttgtaatatatgagctagtcttttaggtttaatgacaagtatggctataaatggaagtggtgtaatcccataaggatgtcattacaagaccaactttttttttgagtgacggtttcactctgtagtccaggctggaatgcagtggcacgatcatagctcagtgaagcctcagtgtcctgggctcaagggattctctcatcagcctcctgagcaactgggactacaggtgtacaccaccatgtctggctaatttttttttttttttttaatagggacaaagtctcactatgttgcacaggctggtcttgaactcctgaactcaagtggtcctctcaacttggcatcccaaagtactgggattataggtatgagctgtgcctggccaagagtaactttttttaaaaattgagacagggtctcactctgtcacctgggctagatggcagtggtgtgatcacagcttactgcagcctcgacctcccaggctcaggtaatcctcccacctcaccctctcaggtagctgggactacaggcatgtgctatcacacccagctaatttttgtttgtttgtttttgtagagatggggtttcatcatgtttctcaggctcatcttcaactcctgagctcaagtgatctgcccacctcggcctccaaaagtgctgggatttcaggtgtgagccactgagcccagccaagactaatttctgaatgagcatatgggccaaatcttggagttcccaattaccacctgtaggtatctgatctgactcctattcaatatagaagactgcagatttgtatgaggcaaacacacctattatgccctagtacttagaaatggctactagagaaactgacagacatagtgagggacaaggaggctgtaagacctttactatgttttggtgccagagaaacaaagggatttctcaagtctgaaagtgaaattagtaaatgagtaatggcagttgagatactaggtagggctggcattctaagttgaatggaagaatgaaaatatcgaaaaatctccaaacagcctagtctgccaaaatgtacttggtgttatgagtggaactgtgacccacccaaaattcatatgttgaaggcttaacatgcagtaccttaaaatgtggctgtatttgaagatagtgccctgaaagtggtgattcagttaaaatgaggtcattggggtgggccctgatgcaatctgactggtgtccttacaagaagaggaaatttggacccagacatctaagcacagaggaaaggcgatgtgaggacacagcaagtacgcagctgtattagtcagttctcacgctgctaataaagacgtacccaagactaggtaatttataaaggaaaggggtttaattggctcacagttccacatggctggggaggcctcacaatcatagcaaaaggtgaatgaagagcaaagccatgtcttacatggcggcaggcaagagagagcttgtgcaggggaactcccatttataaaaccatcagatcttgcgacacttactcactatcatgagaatagcacaggaaagacccacccccacgattcaattacctcccactgggttcctcccatgacacatgggaattatgggagctacaattcaaggtgagatttgggtagggacacagccaaaccatatcagccgccatctacaaggcagggagagaggcctcagaagaaaccaaacctgccgacacattggtcttacacttctggcccccagaagctgtgagaaaatgaatttctgccatttaagcctctcggtctgtggtactttgttatggcagccctagcaaacaaatacacttggtatgtatcttaataccgggtaaacaagccaagctagtgtgttaattataagttgggctttcaatacagtccaggcccattctgcaaagtctttaatctgttgaaagggggtgggtactcaccacatcaaaggcagtaaacacatgacagtagtggtgattagacttcaaatcttttgtgatataggcaaatgttgagaggtcttctgggtcctgggcagcacaggagatattacgaatttcatgctcagcaattatgttctggaagaaatgacataaatgatcattgttttcctctgcgaaccagcatatatgacaaccaagacaagtaacccaggaagcagttgctttccttctttctggagtgttctagactagcaacactcaaagtggtccactatattatttgtgggtaaatgaataccagatatggaagaaatattttcatttaattaaaaacaacctaacacagtcatatcctggagctgcagttctcaccagttgctgtgcatagaagcagtctgggtggcggccactttttttttgtttgtttgagacaagagtctcactctgttgctcaggctgaagtgcagtggtgcaatctcggctcactgcagcctcccgctcccaggttcaagcaattctcctgcctcagcctcccgaatagctgggactacaggtgcatgccaccaggcctggctaatttttgtatttttagtagagacggggtttacaccatgttggccaggctggtcttgaactcctgacctcaggtgatctgcccacctcggcctcccaaagtgctgggattacaggcgtgagtcaccgcgtccggcctccactttaaaaaataatagtaattactaagcatttgactgtttccattccccatgtccacctgtagctgtgcagcactgctttctgctaattctgtatggaggggagcatctgtcgctttctctgtatgagaagagatctgacccaatgaggctcttcaaatccctcgccatcatgcttgcacgttgttcttgtgtcctgctcctcctccctcagagcaagggcaggtactgaaggaagcaggcaggtggaagcctcaaggtgctttctccgtggaaactaaggtgcaggggcctgataagagaaacaccatactgcaagattcaggccttggatgccttgcttgatctgggccctgtggctatattaacaacactttcctaactacatccactgtgtataattaggaggtggtgctgttgctaccattatttacaggtgaagcaactggtactcaaagaatttaagtgccttatgcagagcaggtgctggggtggaactgaaatttggggttgtctgactgtggagctcaggctctttgaaatgcattgcaatgcccttcaacgtctccacctccctcttactggcttaacaagaattgagttatttcttctctagcatctctttgtgccttcttccctggtgggagaaaggtttaagtaccattgtcctgaagcacaaaataaccacgaagcagcttggctgcaaaccctgctagaaacttcttttgatacatagatgtgtttaaaaagaaaaaaagaaaaaaattcacataatcttgcaatcattttcttatcttataatatcccatttatgtttttttgcagttgtcacagatctaaaaccctcgatgctttagttactctaattactttttaattgcgctgtcttaaataacctgttggcaatacagtgttccgtgtacagccatcaatgcctaaaaatgcttacaaaatgtccttccctgccagcacccccagcaagtacttcatgtccctcactttaccaagctgagtggttcggaggcaattacagaattaactcacaaaagaaaattaaattaagacatttttcaccgtggccttttgtgttgacattaatgcagtgctctgtcaaaaaataactcaaattgcaattggaatcccataaacaagtaacattctattgcaagataagtttcagactagaaggtgatgatcctcttctggcatccagatagcattccttcaagtagaaaaccaaattagggatgggtgagtcttaaaataatgttaaaatgagaaaaaggtgcaatgtgagatggtgtgggaacctctgccattatcttgattgggggcagccaatgccctgggaagcctgggtggatttggtctcacttgtccaggaggcactgtcacaggaaataggtgcttcaacttttactaagttggcattttgtgttcttgagatcttttgcaagatctcaaggtagatgcacttcttgggaaatgaaaagtgctctgtgatttttattgcactgaactctctgaatcttgccaactcatgggatgccactcttgacaatttccaatggtgcacggcagcactgtggcctgggggaaagttgcaaaggaggaaaagtatatctttggtactctctcctcctgtgtctttgctgacccctgaattttctggagccctcttcttctctttctctctctctctcttttttttgagatagggtcttgctctgttgcccaggctggagtgcagtggcaccatctcagctcactgcaacttctcaggctcaagcaatcctcccacctcagcctcctgagtagctgggactacaggcatgcaccaccagcctggcttattttctgtattttttttttttggtagagaaggggctttgccatgtttcccaggttggtctccaactcttgggctcaagcaatccacttgcttcagcctcccagagtgctgggattacaggtgtgagccactgtgcctggcccagccctcctgttctctattccccaggagcccaggactgtcttttagctgcccagggaggcctgacctctgtgatactccatgttccaaaatcagccttctccccgactgtggaaacttctactactctgttcccattgtctaagctataaggaaagctcatgctagttaaaatattctatattcaggtaggaataactcatcattgtggtcatcctaactggcgcttaaaagatgctcttgaatttgtattgatagcctgcggaggcaggtatttttgaacagacctttgtgatatattgccaatgctagaatggggtaaggtcctgggatgtcactactgaaatactgccatcactctgcattgtctacctgtgcagaatggtgaagccagttctctatgtgcaggacgaatcaaaggtcaaggatactacagttgtagactgtatggagactagatggtagacttcctccttggagaagaagccaaagaggaacacattctttccaccttgtgtcatgcatttatgagtggcttttccacaaattaaaaagtgatgtcatgaagaggtacaggtgatgcacctcagttgaaaactggactcctcacatgttgatcagtctccatttctaagcacattttaagaaggccagagctttaaaaggctcaagagaagaactggggaggggctcctcctgcctcttcttggggatagaaattctggcagcatagcacccttcaatagggagagatggttttgcctgtctgttgtttgccatcatggtgagaaacagctgaagaggtgtcttgctggtaggggtaggacaggattctcgggtccagctaactcatatggtggttctgagaagggcgcgtggtgatgaagtgatgcagcttagaaatctgcctctcgccactgcattcaatctgagccccgacaggtgggacctttctcttgcatctcctcatcagccgggcttttcctgagtgaggagactgcagtgttccctccagggcggggccaacagtatagacctagagctaactggtgatgccctgtggggcacgtgatgctgagaacagcacatgtgcttaacatggccttaatttgtctccaagcttcttaggagtatttgctataaaaaaaaacaatgggaggcccactgcagtgactcatgtctgtaattccagtgctttgggaagctgaggcagaaatattgcttgaagcaaggagtttaagaccagcctaggcaatatagcgagatcccatcactccaaaaaaacttaaataattagccaggcttggtggtgcatacctgtagtctcagctgctctggaggctgaggttgggggatcacttgagcccaggagtttgaggttacagtgagccgtggtggcgccactacactccagcctgggcaacagagtgagaccctgtctcttaaaaacaaaacaaaacaaaaaaacccccaaacaacaggcacttgtttaggcaaatgttccaaagtattttgtgcccctaaaatagcataggccttgtttaaaattggcattccaaaaaaatttttaaaaactcaaaaaacaaaacaacaatgaaagcaaaaaacaaaccctggcactgcatcatttttaatttagccagatgggaaggctgaggagggagtcagcacaggaaggcaaaatgcaacctgctcctcagctgagcactgaatgtagaaaccgtgtctcctctcggaagacctccctccccgactcccccaacctgaagaagggtccgttactaaacagttgcagtcccccaggccgaattccctgctagagcaacctttgggctattgatcaacagaaggctgaggtgatttatctaaaacactttagtgctaaatctattgcaagttccacttttaattcaagatcgctttctgcttcctccttcttaaatcaggattagtgattcaattcatttcctaagttgctaggcaatacatttatgagtttataactaggcctctaaccctttcccatgaattcagccaaacccatttatttattataatcaaaggaaagaaatgcttcacggagggttaatctttcacaaagtctaatgggggctaataggaagggaagagtaattaacacacaatgaattatcacacaatgaattagtttgcacttcaaactaatttgtggaaggtagctgtggagtaacagaaaaagcattaggttagggaggttgaaaatcaagttttagtcgttcttcacgaccaacaggctgtgtgactgcagggcagcactgagccaagggactgaggccttcaggtctccagctgcccagggcagattaaacaatcacctctctgaccaaggcaggggtacgagatgcaaggttaggagagtactgttgaagaataaagtacgatgaaaacataaaatatgaacagtaggctgggcgtggtggctcatgcctgtaatcccagcactttgggaggctgaggcggatgattacctgaggtcaggagttcgagaccagcctggccaacatggcgaaatcccatctctactaaaaatacaaaaattagccgggcatggtggcacacacctgtaatcccagctactcgggaggctgaggcatgagaatcgcttgaattccaggcctagtggcctctagtacctgaaatggtgagatctttaaatatgcttgcatattaaaagttctttgcttcaaatcaaagtggcccactgacacagcactgcccagtgggggaaatccctggtgaaaacagaaagcaggactctggagtttatcaatctgctccttttctgctgtgctctttgctctagaacaaagtagcatacacaggtgtcctcgcacacactgctagaatctaggtatctgggcatggttcctttcacaccacaacttgaggatgatccttcaactgtggatcctccgtcccttctgaagccagtcctcccaccctggctgatggtagtatttctcagtcttacccagtcaaactccaccaatacggccttccactattttctttcttctaacctgctaaacacaatctctctacttgggctccctacacagcaactactagactattgccctgagtcacccacactctccctacccactgtcatactgggggagatcagctaccttgcaggtcactgggatgtggaccctgtatagccagttgaaattaacatccttcagttccttaaaaagccaggcacatgttgtcatacattcacagactggctccacttgccaccaacataggcactttgcctttgctctagattctgaaaatatgttgaggaccacactgcaaagacttgaaaaaatatgctgaccttctttatttagcatctttatttacatagaattatcttttgcatatctttctgtgcttttgcttccaagagtagtcatcagtgagcagaggtttatggttaactcatctaattattggcaattgaagtagaagtatctccttgaggcacaggagcatcaacttctgtgtctcttgccgtgtcagtaagcaacatacaatggaaccggcagagctctctttcattcctctgattgtggagagtgggttagagaaaatgctattaatacagctgcatccagccatacccccaaaatcatgaaatgattgccttaggactgtaggaacttctcagggcaaataccacttgtttagaaattgtcagaatccaagtctgctaaagttgttcatctaagagagtgtcaaattcatccactgaaaatatactgctattcaagctttccaagcataaatgggatagagggagttgtttcaatttagggaaaaaaaaatccaggtgccaaagtctttcttaagatttagatacagcaatagcaatggtatctttgccattctataatgtgttccataaagtgttagaacttttaaaaccaactgactataatttaaggataaagtaattttatataccaggaactaaagatgcttccaagaaataaaaaagcaaatcaatcagcattgttcttatttgagtctccacaattattatctgtcaacaaccatcaacaatattttgcacagttggaatcaccattatgctgatattattggtcagcatgatgctgggttatatgctttttgcctgggtttcagaactttttctataaccgggaggttgttttcccaagcagatttggggaacttgggtttacctaactactgaaacaacaatctctttcgtcacagaaaaccaattggaaaaacttccgattcagatgctggggtttaatagagacaccaaagagtcactgcccgtgagacttttccctggaacctaaatccagttgccttggccctaagttgctgtttcttaagttcacctgtttcatgacttctgttccctttctccaaaacggagggggtccaggtgggaggtctgggtgagaggtccagagaaagaccagcattcaccaatggtgatcacctcttttaccctccttctgtacttgattagttgaaaggatgcaggaataaaacacatgaacgtttggggttttgtgaggaggagtcagtcagctttgagtttatggagagggacaatggtcacacccaagctttctacttcagcaccacgatgctgttgtctttgtcaagaaaggaatgctttttcagtaaaatgcaaccccactgaccacgcttgacatcacagcccacaaactattcccactgtgaggaagaagtcacagcggagccacagcatggcctgggctcttttctgattgtgtctcttaagaaaacagtacagctgaaactctctcccatctcagaggctgggaattaaatgtagttataaaattaaaaagtcagaaaattatcaacagaaaagacacatatatatctctagataaacagaaagacaaatgttctagccctttatctagtaacatctcctctgatggaggagtgatgacattgttgacttttcaatctacaagtgatttttgttttctgtttcaatgttctccagatccaaagggacatgctggataataagtggccacagtctattagagaaagcatcatgacaaagtgaaagcacaatatttatagaaaccccagatcaagcccttcccccaaatggttcctttctgtatgtatgaaggtgtgtatgtgtgtgtgtacatgagcgtgtatctataggtatatgtaggaagcatgaaggttgggggaaagggatgattacagtggggagtgctgggtattataggaagcaaaggattttagatcatacactcaggactgcatctggtgtctaaaccagagagaggagtggtacttaccttatttgttgcatcaataaatttgactcctttatatgagacagaaagaataatagtagggaccttcttcatttgctctgtagacttctgaaattaaaattagaaagctgttagagcagtttgtgttgcgtggcaactgaagcacacaatttttcctcctgaaagataaagatgagctcaaattaaaaacaacaacaacacacacacacacacacacacacacacatcagatacacaccacgcacactctaattttaatgtctgcctctcctctcttgggcttagctatacttcgggcttataaagttatccgtcttgcccttgaggatctaaaaagagtttgttccgctactttgtgtggatgaaggagtacttcttttccctgacactaaagggtgaatgaagaggtctgtctcctactgcaatttcaagtgactgttcctttcacaagagttaaaccacatcggacttaactccaagggtgcatttgacattaacaaaatatatgcacccccccttttcctagttaccttcattcttccaggcacagataatgcttggatgtatacttaaaatagggatgtaaaagatatcactatgtattgttcttgaactggaccaaatccataaatgctgatattatatttacagcagaatcacttgtgaccacaagggatgtaatgatgctctagaacaatgaagccctccaggagcagtctgggttttgagccacagcaaaatgctggacagcccaggtaacctactttatcatttagagctgctacattcccttaggccaagttcttgtgatagatgttcacactggctgaatgtgcttagagtttgcagcttgtacagttttatgcatctgcaaaaagtttctctataatttagtatgtgcctttcctgtttagctttatcattcatcaccagtcaccagcagtcagtttacttcattgccctctatatatactagtaataatcacactaaacatcaagaagaacctacctgacagttagcctggtggattttccagttaagacagatgggaacataataggagagaaaacatataaaaggtgagagagaggaaaccatttcaataattcaccaacagtgtaaattcattaaaaaacaaaagatgccacaaaagaacaggcttcagagtcatcaaagatgcagtgccactgttattttagaaatgctgcaggctttcaccggcccctttctttctctgtttctcatcattctgtttactgcaccgcacagtcttaggactgacacacaagaaccttccactttgagctttcaacaactagttgtcttatgtctattaagggaatcaggaaaaaatagaaactttcttgatttattcatttatatttcccaattttctagttttaaattctggaatgcagccagaattcaggaaggcttttaattggatagtgtgagtgaaactcattgaactcaatgatgagacttcaattgcatcttttagttgagctgtgaaaaggggtgtttcacattttcctgattgttttggcacaacatctttttgagagttactacgcctgtttcaaaaacaatggcttactaaaagtattgttatttaatatctgttgttgtatacaggatgtgaaaaagcagctctcttgctttttaaccagttttgaaattccctggatgcatcagtgttcctttgtgattgccaaaaagagagattatgaaaataaaatataaggttagaaactcgttttaatgcttcttccaaccacttcttaaaaatgtgcaagacacatcaaaggcaggctagaagaaatcatgtgcaatgtgttgattttaaggcaacgcggtggctgaactctgtaaagagggagggctggggcagcccaggcgatagttggaataactgaatgcatatgtgaaaaattttctgcaaagcgtcacagtggatttcggtaaatcacctcacttatcttttgccatgaatccattctcctggacagatctatctgtaatgcaaagcaatatacagctaatattcagatgaaaatctattcgttatttgttcagcaatcgagttgttactttaggcaacccactgtgcttgtcactggaaaagctcgagtctagttcagggatggcagacagacctcaaactgtgtgcaaacaccagtctgctgaaagcactgtgttgagaaagattctgagctgtgtctgagctcagtagaaaagagggctggaaatgatgtctgccatgggagaagaagaggacgaggcggcccaggggctacacatgaacatgcctgctaggtctgataggaagaacagctacaattacaatgttgacaaatgtgacaggagcaatatgaacaacatgcctccaggatagtgaataaaaacagccttattttgcttgacagagtggggccagtcttcattcattcattcaaaagacaatgacggcctattaggggtgattgagctgactcttgatgaataagcattttccaagtagcaaagaggccaaaagaggctgttttagcaacagaactaatacatgcacagaggcctagaaatgagaatgtggtgggtttgggtaactggtggagatgagagtggtagagtaggtttggaaggttgtgacttactctgccaagttagggtccgttggaagcttttcactagagagtgacacaatcagacctgtgttgcagaaagattcttctggtggttgtttatgaaggagggactggaagagctagaggctggatgcagggagtcaggaagttattgtgcaaatccaaaggagagagagaccctaagcacctgagttgaagtagaggcattggagaacaggaggaggcaccacaatgtcgatgaggaagaactgagaggttctgttgattgatctgctatggaagatgaatgggtgggaggattccacagatgaagaagccactgagataaggaatactggaggggaaagtgtttttgcgtaagcataatggaaatgcttttgcacatgctcagtttgataagcaggtggagatatccagtaggaaatgagaatcagatctggaaatccacctacatacatggatggccaaggaggtgggagtggacaaggtggtttaaggagtgaacaagaaaagagggaaggacacacttcaggggaagatgaaatcccaaggggtggggcagaaacaagagctaatgaaggaactggaattgaagttggaagatgcctacaacacagtatcacagaagccaaagaggagagggcttagaaggtaggagcaatgccccatgccatgaggactaacaaggcctaaaatggtgtgcctaccacagtggctggctcacacaggagctgctactttcattgggcttactgggtggaattcctggcttttgcaacaagaaaaaattgttgctgatttcattaagagtagcttcaagaaaatggtggcagcagctggagaggagaacacagtgagctgtgcaatggatgccagttaaaggaagcagaaagctggaacaacaggcaggtcaggacacagctcttgagctgacatgaaggcatcagcggtggttcctgtgatggtacaaagatcccacatcagatgctcggccaagttgaacaaaaaaaagaaaagatgaaggatagtcatttctttttcttccatgggtcccaggaatctctgctctcctaactggaggcagcactatggtgtcagtgatgcaggctgtgcacaggcctctatgaatggcagtgttgggggtggccatgctttccaatctggagcccaaactgtactgctctctccactgagtcatttgacaagaagctgatggatcctgaccagccagagagttcaaagggagggtgggaaatcttctgggtagagcccctccttgaaggcatttatacaccctacaaaagataaggatccatcgtcttttaaaggggttttctgatggtgtactttgacaagagtttccaaagaggtcttttcatacataatcttagcaaaagatgaaaatgcatagaaagaaggcaaagaggctaggcatggtggctcatgcctgtattcccagcactttgggaggctgaggtgagcagatcaccagaggtcaggagtttgagacaagcctggccaacatggcaaaaccccgtctctactaaaaataaataaattaaccaggcatggtggtgggtggctgtaatcccagctattcaggaggccgaggcagtagaatcacttgaacccaggaggcagagattctagtgagccaagatcgcgccactgcactccagcctgggcaacagagtgagactccgtctcaaaaaaaagaaaaagaaaaaggaaaaaaaaggcaaagatcaaagttattgagtcttcagggagtctaatctgggaggcaagaaatctagtaagtgcccacttcatttcatgaaggctttacaggcatcaaaatgtgagcacggggcttcagtccaatcacaggcagtcaaagtccctccttccccattttctcttcggtgttatgatcatcattcttttctccttcccagggacgaaggcgcctactctgaacatcaagttactgagcacgtgctctcaggcaacactggtttctatgacctatctatctgcatgctctgctgggtgtctgtataattaatactcccatatgtttctgttaaaaattcaagctttattgatttgtataaacagaactctgtacttcaggcccatttccccagtgaaagatgctcaaggcgaaccttctgttatcgttttctttcgtttctagttgcttttccctatgccatgctctttgtggcatttttcaggtttcccaatgttctcaaatttaccccccttcagagccagctttacagaagagactaatttgtaatggagacctctgagtacataagcagataaatactcctgggtaaggctccaaattattttaatttttacagcatcttggtcacctgcaaaaagcattatagtgatattcaaatgtattttgttcacaatttcccaaattaagaggatcatacttttatttttccaagagaaatgatatttagttatatagagatgttacgtttctgaaatctaaaatacaatgcaacatttgaatcctaaattcaaaggcagtcttctctttaagcacttgagtttatattgtctataaccattaaacagaaacaggaatcagaatttcatatctggaggtggccacctgaaatattgttcttagtaagtcactgaatgcttttagagcatttttaaaaagaagagattttgaaatcaccaagagaaagaaataaccatctttcttcttctcctttttaattttaaattatgaacggcttggtatcaggtcagaaattatcattggtgcttttattactgccttaaagcatgttctgaaaataagtaggttttctattttgaatgcagaatcagtagtatggagataccctttccagagtgcacgaactctaatctcagagcaagacttttccgagcacgaatgaaagcagaggggtttatgatggggagcacttcagttgtgagctgtaatgctctttgagtctggagtggtgttaatgttccgagtaagaatcattagtgccccatcatcagcacagacagggaaaacagtgaggctaatgtggggaggacgccaccaacccttcattcttacaatgccccgattgctcccagtgtatctgaagcacaggctggggaagggatttccggttggtctgttgccatccaacttacagtatatttttaacctacacatggctatcctgagaatgctttctagttagatattcagtcctgagtcgtaactattaattttggcatataatatcttccttagttagattcaaagcttaattattatattccatttcagcaagtaaattaaaataggatcaagcaattatgtttggtagccctaagtgactttcaaatgattaaaaaacatacacaaaataagcattattgtggtgattttgtaggcagtgaaactagctaggttgtgggattacaagagataaaaagcagaacaccaatcagcaatttgaaatgaactctcaccatttgaaactgagcttaaaggccactttctggggaaaggcttccgcggtctcccaggctgacaggatggcttttctcttgttcccctctctgccacttttcccgtgcactgccctgggtctcagcgtggtctgcttgcttccctatagggagctccttgaggactgcccacacctttcttgatttgtcttcactgtaatgactagcacatggtcttacattgagccctatgaagtagccatttttcaagtcaagaatggctaagtaccagcagtttcataggattcgatctaatggttgctgaactccatgactgttaaaggaacaggccagtgaattaatgtatcgtaacaagcacgtagccagcgttataaggaaccacaggctgggcgtggtggttctcgcctgtaatcccagcacgtagggaggctgaggtgggcggattgcctgagctcaggagttcgagaccagcctgggcaacacagtgaaaccccatctatactaaaatacaaataattagccgggcatggtggtgggaacctgtagtcccagctactcaggaggctgaggcaggagaattgcttgaacccaggaggtagaggttgcagtgagctgagtcggcaccactacactccagcctgggtgacagagcgagactctgggtgacggagcaagactccatctccaaaaaaaaaaaaaaggaagcacagtgccagcctctcaacacgctgagagctcagcaaactttcagagagctctggtacccagagccagcaaagaggccttgcaaagcttgcaggaggaccacaaatgtgattagagggttaccaagacattcctatggggtggagaaaacttcaaagattttggctgggtgtggtggctcacgcctgtaatcccagcactttggaaggccgaggtgggtggatcacctgaggtcaggagttcaagaccagccggaccaacatggtgaaaccccccatctctagaaaagagaagaaaacagacaaaaaaaaaaaaaaagatcatgagagttttcagtctcaaggaggcaaggcttaggtcttcgtttctgcaaagcaaactggctcaaattgcaagcattaagaagaaaagccttcttgacagggtagaaggattcctaagggcagctgggaagtttccccctctagacatctttaaaaatagtttgggttctcatctgtcattaatgaggctaaatgaccttgcaaggacttttctggtcataggaggtctggcacaaaggctgagggaatacagaacctaagaccaggtgacaagaacagacagtgggcaagcagccattgaaaccacacctcctgcatatgacatggccattgtactgcctgtgtaactcacatgctctggagcacaagtctggcacagcacaaagcggtgccctccgtttctatatgctgctgatgctgcacgtctgagaccatactttgagaactactgctctaaaaatgcggtcgatcagtttgattgaaagttactgtcagaactgttctctgctgctgtgcatgtaaactcgctgtactgcatcctacattaattcagaaagaatctagtttatcaaaacacactgttctccacttgacaagtgatttccaaaaatccttagttagcatttagctacagctcttggtcttgagagcaattaacaagaattatttaattcttcatggtttctcagggactgtgaatggataaaacattcttcacataaaacaaagagttcagttcataatgacagattcaagagttgtacccagaatagatgttggccgggtgtagtggctcatgcctataatctcagcactctgagaggccgagacgggcagatcactgaagatcaggagttcaagattagcctggccaacatggtgaaaccccgtctctactaaaaatttaaaaattagctggacgtggtgacgggcgcctgtaatcccagctactcgggaggctgaggcaggagaattgcttgaacctggaaggcagtgattgtagtgagccaagattgcaccaccacactccagcctgggcgacagagagactcaaaacaaaaacaaaaacaaaaaacctgaaaaaacaacgatagagttaataagatcaggggtcttgctgaagatgaagatgtatagtttttttttttttattaaagttcccctattctccctcaaattaagcacatgctcttgagagatgtgacaggcaaacatgaacatgggcttgtgtactgcccctgggagtgtaatctggaagaagttttctagaaggcaatttgggaatagttatccaaagtttcacagtgtgtataccctttgatccagccattctatatctagtggctcattctaaggaaataatcaaaccaactgcaaaagatttaggtaaagggtgttacccatagtactggctatcatttgaaaagaattggaaatgacagaatgaccaacaaggagaactggttaaataaatttggttcaactatggattggaatattgtaaccaaccaccacaaatgatattggggatgaatatgtataggaataaaaatatttcaaaatatattattgtgtttaaaatacacggtaaaacagtggatatgcaatatttccacttcttactagaaaaatagtacctacaaatgcataaataattggtctggaggattacacaagcataagatgttaacagggaggaatttaccacttctaggtggtaaaatcacagttgtttttatttctccttcctgtttttctattttagaagtgaacagtaatgaacgtgtattgcttttgtaataaaattttaaaaatgtatgattttaattaaaaatgccaattgcaaatgtgtgaaaaaacacactgtttgaatctatcacttataagtgcaacttctgtgttttttgggggtgtgtgtagccatcttgagcttatgaagggacccactgaggagctccttcctctgagaagaaaggggtagttgtcagcaaatgagagtacagggtatgtttggattcctggcttagttccattccttccttgcggcgtggttaggtactcaacctccctgtgtcttagttacttcatctgtaaacgggtatgttaatatagcatctacattttagagttgtgaggattgtacaggataattcagtgcctagcatgtagtgaacatcaacagattttagctattactgcttaaaaacagtattttttttggtagagatgggggtcttattgtgttgaacaagctggtctcaaactcctggccccaagagatcctcttgcctcagtctcctaaagtgctgggattacaggtgtgagccaccttgctcggccagctgttattgttattctgaggatagatgctttcacttagaaagtccctctccaaagcaaagcactggcaaaagagagcagaaacaaaattgaaatctgtgtgcataactgaacactctccaggctacttgctatgatggcagggaaatggtggttgcaacaatgaactttcagtggatcaatatacctgggccaatgagaagagactcaatcaatcaacatgtttagaaagagcttgagacaagtgggaattaaagacagaagcagcccaggaaatctttcagtgatgtgaagtagtaagggtgttatatgggagaaaagctagcaacaagggctataaaaaataacaaagagaactggggtttgaagacaatatggaataagatggttggtgctctttagccttctagagtaggcccgtaagaaaacattcacaatgagaggctgggcgtggtggctcacgcctgtaatcccagcactttgggaggccgaggtgggcagatcacaaggtcaggagttcgagaccagcctggtcaatatggtgaaaccctgtctctactaaaaatacaaaaattagccggacgtggtggcggatgcctgtagtcccagctactcaggaggctgaggcaggagaattgcttgaacccaggaggcagaggttgcagtgagccaagattgggccactgcactccagcctgggagacagtcaaaaaaaaaaaaaaagaaaacattcacaatgggaaaggcacatgtgagcaaggatcagcaataaggagttacctatgtggctgtttctttgtgggcattgcgattcaatagacacacaacacacatttatgggcttagaagctgtattcactatgactcacgcagtatttgggagagagtgaaagaaaataattgatgcttccatgaaattgggcaacagagaatttttttttaaagatgggatctggctatgttgccccggctagaatgcagtggctgttcacaggtgtgatcacagtacactacagtctcaaattcctgggttgaagtgatcctcctgactcagcttcccaagtagctgggagtacaagtgcatgttactgtgcccagctcaacagagacttttaaaaaaatagttgtttaaaagttttttttcccagtctgattcctaagaagtaattcttgaagttatatctgaaaatgacaacttgtcacagaaggaatttgtatgaggacagaggaacaaaacatgattttagtttgagtctcttctaagaggaaagaggcttttacatttagtatttccatctaattttaagatctaactttttcaaagttttccaacccattccctctattgtttcctaaaacacataaaaaagagaaaagtcttaatacttcaactagggcatggattattatttggaaatttgtatatttgaaaattcacgctttagaagtgcttctggattgaaagtttaaaaatcatacaaattaagaggaacagattcaatgagaactatggggaaactatccaaatcctttgggaaataaaagttccaagacctaaatacactagatttgcttatttctgacttaaaaataatcttaaaatatttcctttcttatatcaggaaggcagatttctacctcatcttagttgaaaacagatatttcttttttggggaggattattttttaaaaatatcaattgacacataataactgtacatattcatggggcacaatgtgatgtttcaatatatgtatacattgtgtaatgacaaataggggtaattatcatacctggaaccttaaacagttatgatttctttgttttcagaaattcaaaatcctcttctagctattttcaagtatacagtacagcattgttagctacagtcaccctactgtgcaattgggcaccagaacttatttttcctacctaattgtaagtttgttaccattgagcaacgtctccctattcccctcctcctcatctaccctttcctggctttgataaccactgttctattctctacttgtatgagatcaactttttagattccatgtatgagtgaaatcatgtggtatttgtctttctgtgtctggcctatttcacttaacataatgtcttccaggctcatctatgttgtcacaaataacagaatttcattctttttctttccctgaatagtattttattgtgtacatataccacattttctttacgcattcatctgttgatggacacaattttaaataaacacttagcttggatccacatcttggccattgtgaatagtgctagagtaaacatggaggtgcagatatcaacatactgatttcatttcctttggatatatacccaatagtgggattgctggataatatagtaattctctttctaattttttgagaagccgccatactgtttccatcattgctctactaatttatattcccaccaacaatgtacaagggttctcttttctccacattctcaccaacatttgttatcttttgtctttttgataatagccattctaaatggagtaagatgtggtttttgctttgcatttccctagtgattcactttgggtttgctttgcatttccctactgattaatgatattgagcattttttcatatactttttggccatttgtaagtcttcttttgataaatgtctattctggtcatttgcccattttaaagttgattatttgtcaactcaaaatggattaaagacttaaatataagacctgaaaccactagaagaaaacgctggagaaacacgtcatgacattggactgggaaagaattttttggatatgactccaaaagcacaggcaacaaaagcaaaaatagacacatgggattacatcaaactaaaagccttctgcacagcaaaggaaacaacagcaaaggagacatcttagagaatgggagaaaatatttgcaagctatacatctgacaaggattaatatccagaatttataagggacccaaacattgcaatagcaaaacaacaaataatcctatttttattactttttaagagaaatttccttgagaacaaacacctgtgaatgatactaaccatcaactatgggattagagaacgtaagactgcagagagtattaaattgaatataatggcttacctcttacagtaacagatgcttcctaattgtatatttaattagggaagtgatgcattactgtatattagtgaaaattaagccccagggcaaaattcagggttcgggatggggtatgggtaagcctagggaggcaaaattgaagagcagaacctcatctggccagagcaaatccttcacttcaccaaaaactgtatgtcttggaatctttgaagtgggagttattcataccaacataacaacaacaacaaacccactgaaaagtcaaagcaatatacttatggctttgtaaaatccagtcctgtggacacattatttaaaagtggtaattcttggccaggcgcggtggctcacgcctgtaatcccagcactttgggaggccaaggcgggtggattacttgaggccaggagttcgagaccagcctggccaacatggtgaaaccccgtctctactaaaaatacaaaagttagccaggcatggtggcaggcgcctgtaaccccagctactggggaggctgaggcaggagaatcacttgaacccaggaggtggaggttgcagtgagccaagattgcaccattgcactccagcctgggtgacaagagcgaaactctgtctcaaaaaaaaaaaaaaaaaaaaaaaaaaaaaaagacttcctctcaagcttggcaagcttggcgtttggtcgatggggacccatgggggttcaacatgtgtatcaagaagtgttatttctgtctggggcccatccaccctggccatggcaagatgttcatccgcaatgattgcaaggtgttcagattttgtaaatctaaatgtcattaaaaactttaaaaagaagtgcgatcctcacaaagttaggtggaccaaagcattctggaaagcagctggtaaagagcttacagtggataattcatttgaatttgaaaaccgtagaaatgaacctatcaaataccagtgagagctatggaataaaactactgatgcaatgaagagaattgaagagatcaaacagaaacacgaagcttaatgaacagattgaagaaaaataaagagctacagaaagttcaggatatcaaagaagtcaagcaaaacatccatcttatccgagcccctcttgcaggcaaagggaagcagttggaagagaaaatggcacagcagctacaagaggatgtggacatggaagatgcttcttaaaaatctctgtaaccatttcttttatgaacatttgaaaatgccctttggagacttgaaactgctaaattattagcttattttttacataaggccacttaaatgaaaaatgattaaaatatatttttcctaccttgccatctaatggcactaggcagcatttgtataataactaatggcaaaaattcatggctagtgatgtataaaataaaatattctttgcagtaaaatattccctttattaatgttatagaagggaggatacaacaaggaactaacaatttgtatgacagtgtcaaatattatttagattttagaatttcctgttttgcttcatttgcatcttagaagagcataatgacattgtttgatgaagcctaattatgctggactgttttgagctggtttaacccttctgataggtagttgtggatgtcgaggatgagaactgaataatctttgcctgaaatcacactacactctagaatttccactctggagaatactcagttctaacttgtgattcctggtagaacaaactttatttttctagcctagcaatgatctagaagcagaggaatcccagtgccttttaaaagttattatgtggttttcttttaaaaagctcctgtttttggaaagtagaatttctgggtacaacatctgtttattatttgcacataaaataagccatttaaaaagtgaaaaaaacaaaacaaaacaaaacaaaaaacaaaacccagggcaatgaatgttcctggcacattggagaggcagtccagtctctggattcacagtgtgggtagtggagtggactgcctggtttcaaatcctggctctgccacctgctgtctgtgtgaccttgggcaagtgacttaacttctcttggactttgttttcccatatgtaaagtgggagcaatggcaatacctactgtgtggactgagtgaactaatgcacataattcagttgtgcagggcagggtgtacagctctcaactgctacctgttattagccctaataaactgattttaggagggcatgagtatatgtcatttttaagatcgtctattatgatcccttaggctgatggcaacttgaaagtgcctctatggtaatacttctaccactttggggtaattaaatgttcacatgttggtttcctccactggattgtgaactcggtggattttagtcatctttgttaacaaagtacatttaaggaaacattgatcagaattgggaaccacagtgatttacttattactgggagagacattttcattttggctaaaatgcatactttgaacagaaaacatctttttttcaattaaaagaataaacaggtaactcttaatctacaatactttggcctaataatattaccatgaatcaactttttagaccgtctgtgtcctaaagtatttttcatggggagttttgattgaactgggacttttggctgaaatgccaccatgctgagaacagagaaaacagcaacttggggttcaaactgaaaattagctgcaagttgagatctacatcatttatagttggtgaaagttctaattcacaatagaatagttccagatagcagatcaaccctatgcttctggttttgaaagactctggtgaaatgtagtgaatgcaaccttagctactttatcaagaactgagacttacttaatcaagattggaaataagggtttatgatagtccgagaagtaatgaagtttctattttcatgtaaactacataagcaccaagagcagcaaaccagaaaaatgccccccaaaacagaagaatggcttctaaatatatgtttttttctaagtttcattttaagcaacagacaaggatttaactaaattattctctacttaggctactaaaatggcttttctattgctatcaggatgtaatttcagatccactcaatttcatgaaattgactgagattcaaatcatacatctggtatattttaaatgatgctgcatgcactaggcaatactgatgctgattatcacaccggagtagctggtctcaggtaatttagttaagagtattaaatcagagatgcccaattaatttattagacatgttcatgaatatttctaaaattattatgaggcttgatgaatgaaaactttccctttttcttattgttcattggtgacacaaattaggccagataaatatttagaatacaagatttccagaattataaaaccagggagaactctaaagtgtatctagtctaatgttctcattttatatgtaagaaaacagaggatcggggaaacaggagaatgtagtggttaaaagcctgggctctggagtcagacagacccgaattccagtctcagattggcaagttattccctgtgtgaccttgagcaagttattcaacctctgtaagcctccatttcttcgtctgtaaaatggggacaataattgtactaggggacactgtaaagactcagtaaatgttagcagctatcatattatttttatgaataacaggtgactcctaaggcaaataaccagccacggaactaaaacttagagtttctgatatatacagaagcttgtttttttatctaaactcagtacctaagttaaatattcactggtactgacaatttaagtactgtctaactctgcattaaatagaaggataactatttcagtcttttttgctgttgaattgatcaaaatattagtgattacatattgaagtctcaatttcatgaagattcacacatatttagctttccataaacaatggatatttcatgtttaccttcatagctgtttcagtgtaattatatgctcttaaattattttccaccaaaagctgctcatataaaataaacaacaaggtatattggccataaataaaagttaggattgcacttactaatgaccttaaatttgactttagttagatgctatattgaacaagtctgatattctcaatttgtgcagttactcagataccagcatagcctctatacacctgttatggaggaagcaagaacaagggacacgtacaaaaggaaaaggtgggtctgcaatacgagttagagttgctttggctaaaatagactcctaggaatcaagcagccactaatcacagatatttggaattgccattttttttttttttttgagacagagttccacttgtgtcacccaggctggagtacaatggtgagatctcagctcactgcaagctctgccttcaggttcaagcgattctcctgcctcagcctcccaagtagctgggattacaggtgcatgccaccatgcctggctaatttttgtatttttagtaagaggggttttgccatgttggccaggctggtcttgaactccttgacctcaggtgatccacccaccttgacctcccaaagtgctgggattacagacgtgagccactgtgcccggcctggaattgccatttttagttaacatttgcccttaaatagttcattccactcaaagttgaatttaaaaaaataaaaaaaaaaaactgagtaagaaattgcataaagaatattagctttatataatatgctcttaatacttctgcttttgataattttagtcaattggtgatgttttcagtaaatattctcagactattcagtgcgtgcttaaaaccttttgttgtaataaagatcatttttctaatctcgaaaatgatacaattaattttaaatctttaaaaataattaagaacaaatatagtacaaatatagcaaatagacattaactcaaactatagtgagataagttcaagcataaacatgcagaaagcaagagcacctttttatgtaataccaatgtgattcagcagaccaacagatggagaaaatagtaatttgaaaggtggcaatttgtatccatacccagtatttagtatttcagctactagaaataaagtagtttggcagacttacccgcatttttgcacaagcatcttgggttgattctgtccccctaagctcttttatcagcatagaacctaaatactaaaatacaaaaaaaattcaatgatttatgaaatggaatatacatatgagtaatgttttaaaaacaaattgtggaagtattactggctaggtttcctggctgtaagttgttgcataactttaaaaaactgacagtaactaatcctaacaaataaatgcattcatagagaaaatgcagcagaattaaccataagttctgggggctgtaattgctctttataatgaaactgcaacatcttctaaagatgccatctttcaaatcatatttaactgcaaaatgggggcatctaaaaatgttttccccttttttgaggcagcaatgtctgcaaaaataaatcacactactatctctgtaattacagggttgcatgagacagctgagaagctaagcaacatgtcccccatttaggcttattctgctgcataggtaattaatgttaggcttttaggcagagatgcagttttggacctttttcattcacagctgtgtgccctatggttgatccacctgagaacgggatgggagggtggggggagggagagaggcattctcagttgtttcccaggggaagagagctgggttcctggtgcgaagtgccacctggagggctgaatggagctagaaggatgacagtctcccaagaattgccaactactttgttgttagaagaccagaccccatactgtatcatcctggtacaaaatgcccctcgtgctccagcttctggctggggccaaatggttttaaacaaaatgtctgatttgcctttctatcaattgactccccttcaaccttttgaagctttagtagggtttttgccttttgtcattcccctgccccttgccctccccccaccagcccccaaagagctctatatatgttttttaaaaaagtgaattacaataattattttagaagatatctgatggacacttcctgacaagactggagacttgtactctgcagagacggggatgggaaccactcttgtggactagggaagtgcctgacttgaagaagacgtgagagggcacaacagcagaaggcgtggtcagggccttggagaaaggcatgttcagaaaggcttggggacttggggtttggagggaggagccatttcaatcctatggttttgggcagtaccactgaaataaatccaaagctgcaatataagtaagctttagtaaaagaggggcagaaagcagaaaatgaaaaaaaaaaaaaaaaaaagctcaactggtatgagataaccacaatgtccatctaaatcaaatgaaggtgaaatttattatcttttggtaaaatccttatcttttaagttatcagggaagtttgcctgattgaaatgtttctttttaagagaggcagtttcaatgcactgctgaaggttcagccactttttctgctgtcgtcaagacaaccaccacctgacccaaaacctacagtatcttttgaacatttaccagttcctattacatttctcagctaattataattaattcccctcttctaaaaaactaaacaactaacctaaactaaaccaaactaaactaaacaactaaaacagaaaaatagtataatcctattgatgacagtgaaaagaatctggtatttacataaagtggcagacccagtgttttgagacccagtgtttggtgagtgagcagagatatatatatatatatgccatatttacactcatttccattttaagattgtacgttataacatttatttaaaaatatacaactatataagaggtcacaacagaccttaaacttacaagattaaaacggttttaaagctctagttatttggactttctctttggatagaaggctactttaagaaaaagtgaagagaaaaacattttaaaaatttcagtgatggatatggatattttggtatattttcaatgtaaatgcaaacaagctgaaaacataccccctatctccacttaggcccaaatactgaattgagggtaacttacaaaagctttgtaatcacacgactggaagataagcttttctgggtgatgctgccagtactgtaccggggtagaggctgtggcttcattcggaggtcgcaaggtaatggaaggttctccccagtctcctgtctgaaaatgacatttattctagaggcaatatgagcagtcagcaaagttcattccctgtagctaccctgagctcaccttacacacaggtgctgtgaatgtaccaaaatgcatttgggtgtcttatgtgaatataaatacttggttattacatttttatatgtattagcatatctctcaaggctgagttaatttttgaggtgtggagttgaattattctatttttagaatgacatcctaagctaagtcactttaaaataaaacatgaagatattcataaatgatttactaatcacaattttccatcacaacagcaaaggacacacaatctttaaaagaattttgtttttaaacttgactgaaatttttagtttgaattgctttcacattcagaacacacagttctataaatttcagttcccaaatatgacatgtactagccactttgaataattttagatctctggagaaatggtagtgtaagcatgatgctaaacaaaatttaaaagaaaaatttactaatgggtgacactaatttctctcatctgaattcaattgcactgatttaatgatgctgtctcagatggattcagctacttttctcagaaaacctaacgtaccaatgaagactaaacagtgaaatgccaagtttggtcacatgtacataggcatgtactttgaggattctgattcacaaatacaagcacattcccaaatgatggtatatcatatgatacagacctaaaacaggaggacctcccatcatttcatttatcattttccatgaggttagcctcaacctgtttcatcagtataatagcttaatgtgagcatctataaagtcaaaggccagtgttggcaggtattttctgggctctactctgatttacatactacgcatgagatatttcttactctttctcctgggaaagatttggatttttccaaaactcagttctttgttctcaagtggacataactaaaactaaataggcagatttctagagtgactctcctctaacctagatttggctatatatagaactatgagaaattacttttctcaggagttggaagagtgtaaaaaggtctcataaactccaaaatcaaataaaaccttggttagagaacaagttccacagaagtgctagaaagtgtgttgacacactgtgggatttcttaaggagaatttttaaggagtctaggacaagaatgcaaaattttggatgcagttgtatgttttgggagagaaaggaagttctctgctttattaaattctttgaaagaatctagaaactccaaaagattaagaaccacagttctctaggaatggcgtacatagggtgcatattttggggaggagaactagctctccaattttctttgcgcactttggacttacattaggtgacatatgaagtagctgccaatgataaaaagccctttctagaggacttcagtaatgcacaggctttttttttttttttttttttttttttttttttttttagcagtggagtgcctgaagcttttctccttgagatgggtcacttcgactcgcagaagagcaaagttagcatcacgctatttccttggcttctcactgtagttagtgtgtgactagttggaactccttcggcttttctctcctgctctgttctcagccactctccacattagttttgttttcgttgctgatttacttttacattgcttaatcctcctattccctgtctgttggtattttttatttttgtacacatttatggggtatatgtgaaattttgttacatgtatattgtctgttggtattgttaagactttacttgcaatattaactttagcatttttgtctgttttattatccatccctgactcattcttgagtttttcttttatatttatatgaatttttagtttgtaaaagtgataactgactgcaattctaaaattagattaagtttttctttggcttcttattttgattttttttcttttccttctttctcaaatggctggctctttattctctctctggtctttatttcatctggctgtaacttacttttgaaaaactagtataaaattcaaaatataggatacgtggatttcaatatcattttgaagctgagtgtaataacctttaagtgataatagcttaaaattctggaaacatgcagctatgggttcttaaacaaaagctttacccaaatctatcaaatcatcctctaatctcccccattaaacttctccctccttctcccgctccctggataaagcaacaacaacacggcaaacaggtattgtacatttaagtcacaggtaacactgttaacaaaacaacagaagtttgcatgcaactccgtggaatgatacaaaaggaggatctggatggcttccaaagatcctttgatccagtgtctgctgatgtgacaactcaaaccaagcatcagatcttcatgtgaaccctattacagttcagcagaggtagaccttggccaagctcaacaggtagttttcaaaaaagtctgaacacggcatgagctggtggtgccatgagttgcagggccagggctgggaacagggctgggggtgggaatgagttgggggaagctagggttatgaaaacatttcacgtgttagtacattaagcatgcaaatcatatgcaaattcattctctaattgttccattaactcacacacttttataattaaactttaatgtgagttccatacatttaaagccagagccacagccaaatgctgatccaaatatttacgtcatccacataagttgtagcagccattgtgggaataacaagccccagcacatacattccaatctcggtctggaaatcactgaaatcccttatttgataaccactggaagaaattagtggaacatccacttaaatctgtttagacagcgccatcatctgctctcccatgactccactttgtccaaaatcacaaaccacttgctttgaattcagagtgatctgataggattttccctaggtgctaaggtgggagataattacaaggaaaagaaatataatacttatttcattttctttgtggccttcaaatattgcttcagtccaaatattgtcaaattccctacagggactgaatctacctttctggaaagagacactgaattttatcagatttagtgctatttccagaaattcatttttaaacagagggaaaggtgttcttaagattgaatttattagaaaataaatttcttttctgcctggaaattcatcaacttctctccccacccctgcctattttttttttttttaaacttagatctaaaagtatttagaagactcaatttgtagatgttaattcttctttttggaattaatttaatgggaatggatggactccaacaactggacttaacattacactgtcgtaaaggacaggtatgaccttggcccttggctgggattcagctgtacctggttgactcccagtaagaacaaaagagttcagagaacaagggtgccttaggtctcaaccctcctggaggctgaattacagcaggaatgagctatggaggaattacgtagagtagttactatatggaatggaagaagaggtcaaaaaagaaagatttttgcctcatacataaaatcattttgaactttgaagcctagtgttaggtcttgttgactagtacattcatgtctacataatacttgcatctcctcaggcaaatatttttaaatttagtaattttccacttaaaaatccttattaaatattaaataacagacctaagaagtcttttgccacaataatggtttataatcaaagcttatttttaatgaaaagcagacctaaacacagctaacaacgcaatatttcattagaatagcaaaatgaagtaggaaaagtttagggtagaattctgtcatattttaaattattattgacacagtggtctttgaaaggattccttaagtaatcacaaatgagaaatcaaaatgattcaaggtactcctaataaatgtcttcaggctatctctttggcacttaaaatatttacagaaaatctttcctttaggttcatgtatttgaaagatcttcatattccaagaattttgtcatggcttaaaacttcatttatttggtatttattattattttttatatgtatgcttaaggcctttttttttattaagcacactaaagaacatcaattaaacagaggaaaatgtacatcattagctctcttcttcaaactcaaataaaaactaaacttctaacataaaggaaaaatactttgacattagaattttaaatggagaattgattctgtgtaacacatgtttgcaactgccaactataaatctgtagtctgggtgagtctgaaggactataattgggccacatctaatataatgtaattaaattaaacattctcttataccaacaactgaaaaatacaaaagcatcaatgggatttagttaaaaaacaaaaagcttcacaaaatacagagatttttactggatggcagattccaaattgcagcttttaaactttgcattatttcaacaggtggtaaatagctgcaaatttttagttcacatgcactggacacctacagcaaattctaaaacaaattgtatcaggtagctgtctccctccaaaagggaaactgaatattacatattctatatgctctgagaatagaaaggaaaaacccttctctatgttattttccgtctttattattatttatttttccaagatggagtctccctctgtcacccaggctggagtgcgatggcacaatctcggttcattgcaacctccgcttcctagggtccagtgatcctcctgcctcagtctcccaagtggctgggactacaggcatgtgccaccacatctggctaacttttgtatatttagtagaaacagggtttcaccatgttggccaggctggtctcgaactcctggcctcaagtgatccacccgccttggcctcccaaagtgctgggaattacaggcatgagacactctaccaggcctttatgttattttcttcttaaggaaaaagtttcctaaggatgtcagtagataattaaaagccatgcttacaacttacttttctaacattaatagaaaagtatggcattttccaagccttgtattattctttaaaatttttaaaaattaggatttaattgatttttaaaaatagaacctttaaaatcttttctatgaggactgctcccacctacttgcttataaatttagatctgaatattaacaaacattagtctcaatttcttcagaacacttaatgaaaaactaaaatgattttaaaggacaattattgttttaaggttttactttcaataattatgacaaatttcagagatgggctacccaaacatacataagatatatgtgattacatttactttctgtaatctctaaggctttgaagaatgctatacacagctctatgcttataaatatgcatacgtatatttgaaagtgaatgtaaggaaaaggcttcccataaacattcacacataatgaaagcaggatgttgtagttgttctttcaaaaaatcttcaagaatgaagaattctagtttgatcaaatgcagttggttatactgaatttgttcctttagatgaaaaagagcagagatggctacttacgaacacataaaagctctggttaacatttatgagtccaagaggaactgctgggtcacgtgaacaccagtaccaggcaatgtatagacaccatggtcctcaagagccagaagtcccatgcacaggagtacatatgtgcctgatgcagcatcccaaaaggcacttcacaaaaatacccgtggcatcccttcacatgccgccccaagaatctgctcagtgattctcaaccaagtgtctcaacctctcagacagcaggctatccaatgggagaaattcaaaagggtgtgaaaatagaatagtattttaaaatatggaacataaaaccccaaacatttaaatgtttattttccaaatagaaataaactttttctaaagtatgcaaaggtgaaatatgaacatttgaaaatcatgcagctcagagtaaaatgggtcacaatttcatacaatttgcaaagatcaattcagtactgtcaaatggaaaaaggctgagaaccactttgtagctgtaaccgtgcctctcccagctcacctccccccacatttgcataaaatgtatacagaataacatgcaaatcatactcagaaatttctcacaagtgaagcacatgaatctttgagaatcattagacacaaagggttgaagagtccatgaatatggggaggtacaaaatggggaggaataatgctgatatatacatgtgtgtatatatatatatatcaatttacccttttctttttcctgtaaaagcaagtttaacacagacgcctggaatgaaagccaaaactcacatgggacatattttaaccatacactttaaaaccaagtatgtttcttgttttaggacaatgtttgcacatcaactaatcacaaggcacagtaaatgaagtataatagacaaagagtctcggagtcaccagacattacaaattttctgcattgccaggacacagtacctatagctgttgacaacactgtgcaacacagtacatagcgcaagttcaggagaagaaaagaaccatttgtaaccttacattatgaacctgatggatcgctgagaaaggaaatcctgcgttctgattcgtccatatttcacagacagacgactgctgatataaacagaaaactatcttatcttgtcaatatttaaaacatggcagctaccaaggtagcatccaggaaggaaaagaggaaaataataaaatgcaaagaatcacatttaaaaaaaactcaaaaaatgttttagggtgctcaaggtttaataattgacttccaagtcattctttttgctttaaaacattttgagttgactaaaaaaatcatttatgcatttatgcaaggaaaattaccaataaattcatgccttggaaaaaagcaaactgtattttatatttgccggaaaaccagaaataccttcccccttcacgtcactactttcagaggataaatattttcatcaacttcaggaaaaacaggaaaaaacctttaacacaggtccgatatttttattttcttatcttcaatgaccaagagcaaacagtgcaataaaatgacttttcctgatttagtcattgctctatttgacaaacctagaagatatttatgcctccagagttcttacgggcaaaactcggtagttaacaaaggaagacgtgtcagcttgctacccagcactgggaggagtgaaggaggtggcaggaaggaggctggggcagggaagaactgaagtcagggaaattcagttctgttcctcaagcagaaacccttgggaacagcatttgggagtctaatgattcagctccataattctggctctcccccacaccattaataagataaacttatcagtaatgtttgctcagaaccaaacactaaactaaccagcatcccttcccaggagttacagtagaaaccttcaaagagaccgactgagctcttggcttgacccatcccaagttctgttcccgaatttcatcattctaaaagacactgtgaaattaaatcacagaaaatggcagagcatgtaaacttattcagcaagctctgtgagcatctttagcattcacaagcagtccgtacaaagatcactgcaggaagaaggcaagcacataaccataatatggttaagaggcccggcaaagaactgtatcatcagcaaacaaatgatagaaaagaaggcttatccctagctaaaagtttcctcaccccagaaacgctcaccagcaatttaacacctctctctctagttacaactgcatctccacacacccctacacctttgctttccatgtcttctgttaaccagaggcttgctggggatggttaaggaagttagatccccagggtctgaccaaaggcacttccaaacacctttcacttaaaccagctctgctatcctcagttccctctctaaacttcatgctattttatacatccatagagggttcttcctcttcttacctttctagcaagttcagtcttagacccattcactctgttggccttgtctccaatagctctcctctgatttgaatgtactaactccatgcgttagctggattaccatcttaagtggcatcctcacccagtcctgagctaattctttacacaaatcacatcttctgcaactttcacacacttctagtgttaatctagtgctagaagtgcttctagcacttctagtgctaaataatccagagaccacctgtcatctgatagatgaagacacagacatttaaagaggtgaagtggcttgctcaggtcacacaggtgagtggcacaatgtgtcagcctgctgggatggctaagaaggagtgtgagcctggtactgatgtcaccagaaggcagagggccactccagctatatacagcttggttctactgaccctgaaatgaacagaaactaaaaataaaatcgtaagccccctcaccgactgaacggacccccttgtggccaaggggaccccagaaaaaccttaaaattgagtttctgaccatgatgggatgggaggtgagacaagcctcattatacctcctctttttcatggtttagacacaacaactgatcggaattaatgttaaaatagacatcataagagtgacagaacagtctctttgtggctataagataccaaattatcaacaggacccgaggccatgctaggcaaaggttaagtcacgcacccctatacctaaagaataaactatgttccaactgccacaaggtttttctttttctctagcagctaaacaggtactggccttaagagaagcaatatttaaacaatttgcacctccaccagatgctgattgacccttagcccctgctccaccagccataactacagctggacaagagattgattcagtaactttatccaaataagattactaaccatggactagttctggttggtctacagagattgcacacttgtgtgccttcatgtcctgaaaagcccttctgacgaacagggctaactgtaatatatctacatgttaagtctccaacccaaagtgaacataggccacatgttacatgcatgttggttcaatacacatgtgtcaggaccaccttcatgaatattcacagctcttgtaacacattgaatatatgtgtttagctaatctgttcagcataaatcttctacctaagcccttttccttcgaagtacccgtctctggggtcttggttggaggtgcttcccagcctgcgggatggccatcttgcaggctgtaaccctttagaagaaataaagtctcctctactttactaaattcatatatatatatttaagttaacacaagtatatctaaatgcaatcagttcatgagacagtcttaactgcactggggtccaaacaccaaaaagttgttttaggttgttttggttactcccaaaggggccatgcccagtctgcctgcctgatgggcacaaggccatttaaccttttgggcagactgcatcacttcctggtcactttgagtcatgaagactccattttgtatgaaatccaaactcatatctgattcaaacttttccttccctccttgtgtgtcagtcttggggcttaaaaagcccggggtggataagagaagctcggtctgcgctttgacttctcctaggagaggtgagggcaggtgtcatggtctaccttggatgttccctgccccaagctctacctacttcatgtgtttagttggggaggaagaaacaggaaaaggacgaggtccctttcttgtctggctgttcctctggcagccgcactgcttttcagctaacgttaacatggtctcccatgtgctctacgtagcagctgctccaacctaggttctcctgtgtccccgtgtgatttctttggagagctcttctaggatagagggcaggtcctcccactgcacagtttctgctggcagaaatctgcctctagcttgacttcttccaactcccactcagccctcctaggacacatgcatgccccctgaaggggacccagggggacaaacataaccccagactccttctgcacatccatgtggcccacatgatatggacacacatccttgtcacacagaacagtagaagggcgggctgctctgtgaacactccccctctctgccagggcatccctccccaagactctctgtgtcagctcggtaggtgctatgtgacctgcctggcagaagtccaattatggataccaaggccagttttccctcctgcaggcacccccaagccagatgtacattcctcctggaccccttctcaccaggattggagagcacgggaatgcattctgtctcctctctcatggcaaaggaggaaaagccttagttctttccacaggactcagacaattccctgtccttctccagcactaaccaatgttctgcctatgtggagaggtagctgacaggggcagggcaggattcacactgcctccttgtaaaccccgaactaggtgtctggctccatgattgatagctttctctttagggtgtgcagtgcttagtacctacaggaaaattcccacttagcatcctgggaatagatcttccaatagtgaatagatctttcactactcacagaaatttaccagagttaagaagggaaaagaggatcctacgccatacttatttcattaaaaaaaatcatataaaatttttctcaatgaagaataaagaacctacccctagtcatatacactgagagttcatacatggcttatgtacattttttagatgttataacaaatattttctatttataagctatgttgtaaatttagagaaagtaaaacctctataatttctaataccgtcatgcacaacataacgatgtttcagtcaacgacagactgcatatgctacaggggtctcacaagactacaataccatatatttactgtaccttttgtgggggttggaagaagtaaagctagagccagacttaggtatgtttagatacacaaatactcaccattgtgttacagtcacctacagtattcagtatagtaacatgctgtacaggttgggaggagcaataggctagatcatatacagcccagctgtgtggcaggtgacaccatctcacgttgggtaaatacacactatgacgtttgcatgacgaaatcacctaacgatgcatttctcagaacgtatccccatcattaggttatgcgtaactgtcatcgtgtcagtgcaagtggtaaaaagtcagaatttaaaagagtttaaaagcagttgtgtttgagttgtgaaaattattattttattttttttgacacagaacctttgctctgttgcccaggctagagtgcaggggtgcgatctcggctcgctgcaacctccgcttcctgggttccagtgattcttgtacctcagccactcgagaagctgggactacaggcatgtgccaccatatccagctaatttttatatttttagtagatatggggtttcaccatgttgcccaggctggtggtctcaaacgcctggcctcaagtgatccacccaccttagcctcccaaaatgctgggatgaaaattatttttttaaaaaatcggatgcattccagataccgcagtagttttgttagcagtaaataatttgtcaggctcacagagcaagcgacttaaggcagacctgttgtaactgctgcattcataatatgaaatggctcttctcctagacatagggtcattatactgagtgctggaattaattttttaaatccaagagtttccagagtagaaattaattatgtttatgaaaataacatttcagggtaaaacatgtattgaagtactgagttttgaaaagttttgagaaagaaatataataccagtcataaaatttcatctggggcccaaattcctagaaaagtagtgagttaagtttttttgtttttttttttttcttgagatggagtctcattctgtcacccaggctggagtgcagtggtgcaaccatggctcactgcagactggcccttccaggcttaagtgattctctcacctcagcctcccaaggagctgggactacagggatgcaccacttcacctattttttttttttttttctaaatgtgtagagaggaggtcttgctatgttgcccaggctggtcttgaactcctgggctcaagcgatctgccttcttcggcctccggaagtgctaggattacagttgtgagccactgtgcccagtcttaaatttaagttttgtttttttttttcttttttggtggcattggagacagggtcttgctctgtcacccaggctggagtacagtggcacaatcttggcttactgcaaccactgcctcctgggttcaagtgattctctcccgggttcaagtgcctcaacctcctgtgtagctgggatcacaggtgtgaaccacctcacccagttaatttttgttatttttagtagagatgagtttcaccatgttggccaggctggtctcaaactcctggcctcaagtgatccaaccaccttggcctcccaaagtgctgggattacaggcatgagccaccgcacctggccaaattaaactattttgtttttttagtttttgtttgtttgtttttgagacagagtcttgctctgtcacccaggctggagtgcagtagcgtggtcttggctcactgcaacctctgcctcccgggttcaagtgattctcctgcctcaacctcttgagtagctggcattacagatgcctgccaccacatctggctgatttttgtatttttagtagagacaggtttcaccatgttggacaggctggtcttgaactcctgacctcaggtgatctgcctgcctcggcctcccaaagtgcttggattacaggcatgagccaccgcgcctggccataattaagctttacaatgtcttcatctgtaaagaaggagaatagtacttgacctacttatttcaccaagttgttgtgcagcttcacgagagaggaaactttttcacagctaaatgtttagggcttggaacacagaaggaacacatttttaccgaatgaatggaatcatataacacattcaaaaggccttggtaaatggcaaagcattatgcaaacattagtcactaccgttatccgttatcatttttaactggtctactctattggtgccacttgtgcctttcataagctatgtcactgccaacacacttccggttaattgtaccagaaactgctgacttcctattggaagattcctcatatttcctgataaagacagtaaagggctgccagcttgccgaagagagaaggaacatttgtcattagcatacctaggtgtcaaaaggctgcttgtagagcttagaaacagttccatgaaagaatgttaatcacccctttgcaatttcatttgcctattttctctcaatccctgtcacatatattgcaaagcctcatttagtttttctgaacctgaattactatgaaacccaaacaaataggggtaagtaaaggtagacttacaactgagatattaccaataatttaatgtttacttctttgatggtgaagtcaacacacatttgaaggtgtataattttatcttcagttcagacctctctcttagctctggaaatgttttcttaaaatgcaatgcatgtctcgctcttgttaccgtcttatactttcggttaccatgacttcagctcagaaaatacaacacaactgcattcaaatctaatcacaaaataaaaagaatataaccaatttccaaagttttcctcctaaaggtggacttcctttttgatccagtagtttacaataaattatctccccttcattatggtttgtcctctttcctggagcattctcagaaattgctataacatcttccatcaaaagcaaacaaactccttcccttgccccaacatcaccctcggtttcctgctcaattactctaatcttctttaagcaaaactccctgagaaatgtctagatggtctccactttctcttttcctgtcctcatctgagcccactctactgaaactgaaacaattttctattttccttgacctatgtgacacccttgatcactcctccattccttagcctctttggctgcttcctgttatctgagcatccctggagtgttagtcctcagtcttcccttccttcttggctatactaggtggtctcttccagttgtgactcccaaattcatatttccagcccagacttcttccctaaattcaagacttggacacccagctgcctgcttgatgcttctccttttgcatttattaaatcagctcaaccttaaattaaatgtcagagaccaagctcctgatgacctcacctccctgtgagcttccttgttttggcaaatggcagccattttttttccagttcctcaggttcacaatgctggagctctcctttctcctgtatctcgcattcaatccagcagcaaagcctattgaatctacttctaaaatttcaccttcctgtcactacttgctccaagctactcccttttctcgtttgatttattccattggcttcttacgggtctcactgctgttatccttgcctccttagtatctcttctcagtactacagccaaaatgacccatctaaaatgaaagccaggtcattccactcagctccattcaacacagaagataattcagtcctaacaatgacctgcaaggttctccgttctctggtacccacactgctctacctccctaccctcctctcctacccatcttcgtcttgctgtctgggttcttgacagcaaagcacattcttgcctcatagcctctgcatttgcttctctttctgcctgacatgttctccctctggctactataggcctagctagctccctcacttccttcaagttctattctaatgtcactttttcagagaagccttccctaggcatattacatccaaattaagtctgtgctttccactctataaaagaattattctttcaagcagaaattatttatttatttatttgtttgtttttgagacagggtctcactgtcacccaggagggagtgcaatggcacgatcttggctcactgcaacctccacctcctaggttcaaatgattcttgtgcctcagcctcccgagtagctgggattacaggtgtgcaccactacacctggctaatttttgtatttttagtagagacggggtttcgccatgttggccaggtctcggactcctggccttataggatcccctcgcctcggcctcccaaagtactgggattacaggtgtgagccactgcacctggccttaagcagaaatttaaaatgtaaaaaatgtttggcacataagaacctatctccctgtcaccctgacattcatgcaaaagtagttactggtcatctactgtgtgcaaggcctgggtcacaaagtgagtagggatcaatcttgcttttaatcaacgtttatggcatgaaaattgctttctccgtggacagaaccagtagtaaactgggactgacaggctgatggtgggtctcagaacagagcaagtagatgacagctccatcaactcgataacccctattaagctctggaaagcttctgggagtctgctgatattatatagctaatctaataaagaaacttttatgaatagagccctccagtcagattctaccagagatgaaattttctgccgtgttctagccctgaaaaaaaaaaagaaaaaaagactttttctctgtttctcccttatgtttgtcataatactttcaacacttcagggtattcagaaattgaccagaaagaaaccagcaagaaatatgaaagtttcagagtgaaagctcaaggaataatgaagtgcattccttcttctggatgatagtgcttctaaaagaaaatgaaaacagacttgaagagcaaacaaaacagcttcaaaggcagaagaaaaaagggcatcccagcaaaggaagccttagccaatagccagcaaactcagtggctccttgagcagagactgggatgaaatgagacctgtcaaaggatggagtcaaacaaattcagtgcagtcaaggggtaacgcaccaaacaccttgtatgcatattttctttcagcagtgacagccccacagttgcttcttctgtgggcattaactgaaccctgcctggaaaatcagaaaattagagccttttgtttcttgtgagttacccagaggccgcaggccagcatctgattacttcttcctgcccaccatcggagacagaggaacactcctccttctcacctcttgagtgagttttgagatacacactcagtcctgtaacaactgcatgggatttagattcttctctgcaaccacactgttagcttctcaagttccctgtctgtgtctatttatttctagttctaaagtgtgaaaaagttatgcatgcacccactgaccctttttataaaaggtctcagctgaactatttcatttgcaggaaatgctagagtcaagaaaatgctgcttcctgccatttctccatctttctgaagggcaatccttccaaaacttcatgatcgtgaccttcccctgtgcctgtggggaggatttttggacagatcagttatcacctgctgggaaggaaaagccaggccaacagttgtttctctaacaacatctgcacgtgtgacccatgattgctggagtcagcattaatcaacctaccaagagtgggaggaagtaaacaacacatttggttccatctaagtccactggcatgatataaattctaacactgtcttcccaagtttaaggttttccttccattccctttccaaactcccttccctttcccattcctctccagttccctccctccctccctccttccctccctccctcccttccttcctctcttcctctcttcctccctccctctttccctctttcccttccttccttaactctaattctgggactgatatcacataaaagaagtcctcggctactaaagtaggagagaaggagagaactataggcttatgatattcctgttattcatttgtagaggtaatatataacctgtattccctaatatgacagctgtagccctaaatggcattacacaattgtttatgaaatccctttacaagaaaaaaatagagcagaggaaaaaaatgagcattgcctgtacaatccagctctcattgtgcagctccccaggttccagggatgttgcagggaatttgagtcaattgggatcatgctgtttatagcaatatgggctgttttacttgttctacctcaaagtctggatgctatcaaacgtttttcagggccactaaaaagcagaacattaataactaattcagaaaggcagtgatcagctttttatcataacatgaatggctgaaaaaaacctagattttgcaaagtaatgttgttctttgtaacatctctttacaatatacattatattcctttcttgcaaagtgaggttgtcatttcctttacttaaattcatttattaactggagcccgactgtttgtttcctgcttctgacagaaaagatgcattgggcagagtcatttattcaatgatgtttattgagaccccaccatttcttcattttatccttgtgaaaaatatgaaaaaacaaggtgcagttgaacaatcctcttgaacgatgccaagctaagaggtctctagtagaaagctcacagtttttttttcaattctactttaatcaacacttcactcaatacactgatggatgacttcaaaggtttgttgttttgaggtaagattcttaaaatgagcacattacatagttgaaaaggatcactgatatactgagtggcaactaagtcttagaaaggtcttgatagactaggattattggatgagtaactttataaaaactgctttatctggaaaaggataatgtaaatccagcgctgctgagaaaggaggcgtagctattgataaaggctgggaaattttcatgaagaaaagcacagtaagaatgaatgacatgttaatgttgatctgcccagagctggggaaccaggatgctgtacggcccacatcccccttatcacatgggattggcaaggagctggagacatttaatatagtgaagggaaaatatcaaattgtcttcagtcttaaaaaaactcttcccagcaaaagggagcagatgtattctttgttgtttcagaagatatcatgaactatgtaggagttatagggaggcttatttcaattcaatataaggcaaaagttatatcaactagaccttttccaatcatggggctgccttacaaagagcgggccagctttccagtcaagtttaggcagaaacttgtggctgtctgtaaggatgtattagaatgggtgcctgcatcaattaagagatgggactacatacattttctggccccttctcatcttaaaattctctgcttttctttaacagtacagttggtcatctgtattctcagttctgcattcttctgactgcacagaagaatcttctagctattaatgcatacagacaaaagcaagttatcacaaattttgtgatcctgcattcaaacctcattagaatagaggcccatacagaaaggaggtcatatcatttcacaatgctttacatgaagcaattgtttactatctctgatttgtaaagaatgaaaaattggatgtcaggagcaaaggattttcttcaaatacaatgtttatccatgctactttagaggtttaattctctactgaagttgcatttacataaggtattagatattcttaataggatttttcaaggaactcaaaacattgcattggagcatttggggttttggaatttctggaatgtgccacgtccgctagttcccagtttgcagagacaatatggggtgttcatcaacactgtggttcacacgacagctgtgaagctaggctgctggcattggaatcctggttctgtaccttttaatttttgtggccgtgggcaagccacataaatgctccatgcctcagtttcctccttataaagctgtactaatcagtgctggctctgacgatgatgccgatgaatcaccaggcctaagctagaccgatgatacgctattgttccaggcagtgtatttccctaaaaaactggagaccatctcaatttgtgtccaatctgatctgtcgtagagccctgtggttttatgatgcctatagccttacataaagtaatttggtcaacagtatttacagagtgtttattttagaggaattaaaaaatgactacggaagagtgaggcattgcccccacatagccaacatacactttaccaaaaaagaagcaaacatttaaaaatgaaatataatgaaatattttgaaatacactaactcataaacatcctttaatttttaaaagtatttaagtatggatatcatccataattccttttccaaagagcaccagtgttaactaggttataacatgaataggagcttcttggacagtgtttgctttcataaaaactatgatttccaagtcagtgaagaggtattagtttgggcttacaagctggaaaacagaaacagttttgcaagatgtagctaaacatgagatttactttaaaatgcatttactcccagatgcagttgagaaagcataatgtagaagaaaactagaagttatctcaaaataataacaataatttctaaaacaacccaaacgtatagtttcatagtttgtaaaacacttcgaaaaaataccattttatttgtgcctcacaacaatgatgtggggtgggcattaacctcactctaggaagagaaaactaaggctctgcatagctaagaagcgtgtccaaggttacagaggaaatagacatcagagatgggatttttcaccatgatctcatttcttcaaacctggcattctaacaaagctcatcaaattaagtatgaaaaaatgaaatcaatactcatctgatatagcaattttccatcagacaatctcagaattccaaagtcagagtggatttattcagatgcccattattgctatttctgcctgcttagaaaccagcccctcttctagcagcagcggcctggctgttcatgggaggaggtgcctccttactcctcagtccacattgttcacatggagctaaaaccacccctggtgtgggacctctgtcttgctaatcaatctgtctgtctgtctgtctctctctctctgtctctctctctcacatatacacacccctttgcaattagctcagggaaggacacttgatccaatccaggctcactggaactgatggaacgtaatactgagactttttcttttttgagacagagtcttgctctgtttcccaggctggagtgcagtggtgcgatcttgctcactgtgaactccgcctcctgggttcaagtggttctcatgcctcagcctcccgagtagctgggattacagacatctgccaccatgcccagataatctttgcatttttagcagagatggggttttgccatgttgcccagcctggtcttgaactcctggcctcaagtgatccaccggcctcagcctcccaaattgctgagattacaggcataagccacgatgcctggcctgggactttttttttttttttttgacactcttggaaagataggttctctttcttgtaacttcaagttaaacagcaatttggcttgaatctctccacacggagagggaggctctttgggaaaagagccaacacagaggacagcagagccaagagaaggagagccagagagcaatgcagcaaaacagcacctggatccaggactcctgcccttttctgcttaagccatcttgagttggattttttgttacttacatgcatctggaaaagtccttgctgataaattactttaggcctatacgcacagaattaaccaagacagggccacacaaacagccctatttctactagatgttaaaaaaccttctttttattttttttaccactggaaaaagaaagggaagaaggagaaggagaataagaaccagagaattctcctacccttgaaaatttagcaagggcagattataacagccaaaactgacctgtggacccaagaactggactgcatgtaataagaaacattctgaaaatttaacaagtggaaaaataacctgctgggcctctttgtgaacaagctgctcaatgtcaacaagcccaaggcaccactaaatatcacaaggtcaattccactgaaatagggtttttatatattgtcagattttttgtttagttgttttgaaaacagaatattttctattgatatcttctttttctttttttaaatccatggtctggttttaactgcaaacaggacccttggttaagcaccagcacatggagacaaggtggagacgtcagagcttctctagcaaaacgactggaggtgtttagggctgacgggtctatcagaatcaactctggctaatttgccttcttgatgaccttgacagggaagaaaacaatctagacctgtaagatgagtatcaaagcctgaaaaagaatccatctgagtgattctcccacttcttccaattatttgttttaagactatagtacagtattcacaagacactaatcatattgacattagtgttgcccaaaagacacttaatcatactggaatttctaatcccaaagttgtctcagatagagcagggtgtatttgctaaaagaaaattaactgaccatattaataaaaaaggtgtacaatacatcaggtttaaattccaagtatggaagcgctattttccacttttgtgttggtcatagctggctagtggcctagagttcttggcttgaaatagggcacagatatcatcaacattccagatgatctctgaagctcgggtgtcagcttgtcaacttgacgagctgtcaaatcggaagctcctgacggaagagcttattgagtgcactcttgaccttcttttttggttatgtatgatctgtctgtgcttaagtattaagagttgctctttagaccttcatggaaggaaatgttgaaatcatggacaagctgagcctttctgagtagtggctatgtgatgaaaatctaaattaaatctaggcattaacttacggacattaaacaaaaaatctgatgtgacacagtaataggaaaacttgtttagtttggggaaaaaaacactctcttttctttgagacagagtctccctctgtcactcaggctggagtgcagtggcaccatctcagctcactgcaacctctgcctccagggttcaagcaattctcctgtctcagctctcctgtctcagctgggactacaggcatccgccatcatgcccagctaacttttgagtctttagtagagacggggtttcgccatgttggccaggctggtctcaaactcctggcctcaagtgctccgcccgctttggcctcccaaagtgctgggattacaggcgtgagccacggtgcctggccaaaaaagccactttccaaaatgctgttcctttcttggttgtgctattttctgaaaactgattctgtaaattccagtaatgccagagcagtgggtagaatttctgggaacaacaggcctattctctcaggaaaagtatataagaggagaagttactgtcctacttctttcccagacatggcaaagtgtttgcctcatggctttctgggatatccatgctttttaagctaacagttctgtgcacaatatatttccataaagttccaaatttcacttaaagaaaaaaaagccctctcacttgatattttatctaacaatgttacaataataacgtgttattaccatatgatattttttgttacaattttgtaacctgaattggtagagaaatatggcatccattctctgctttccctggctttgacatcattctacccagatccctctgcatcgtgatatatgctccttggcagatgatgtgtttacacaattaaaataataaaagaaaaatgcaaattccattctcaatctacatgctaaatatgggtaacactggaacaaaagatggtctttatagaatgctacaaccaccggagcacttgcccttcaactctctttgtcattaattggcctacaatgagcagggacctttgaattagggactgacaggtgatgggtctgaaccgatagtcatatctgtctatatagtgctttacagtttagaatatgctttcatataaattatctgatacatacaggcctgagaagcagacattatccacattttaaagacaaaaaaattgaaattcagagtcaccacataactcggtccaggtcacacagccagaaagaaaccaaatcagaattccaaccgaagaagccactaagaaaacagcatcgactatttggagaaacaccacaagcaagaatttgtttgtagacagagttaaccccacacctacctacaaagcttttcacaaacatgggagacaggcagcgttctgacacactgtgcagggtctctgctgaaggatcaacaaataaccagtgcagttttgcatttaaggatttcatggtgttaaccacgagttgattcaatcagtttccactaaactactgtgattttctcttctgcttgctgtgcccacataaatggaatctattatggcacatgagaaattagtatttgttgaactgtttttaaaatattttatatcattttaatacagaggcaggcacagggcatcagggactatagaagaacaaggatagggttaggcaggccagggcttgagtcccagctctaccatttaccagctgtgaggccaagcactcaccctgtttggcagatgtgcacataggctcttgtgaggattaaataagatactgcatgtgcaatcccaggcatgaacctggtcacagcagtgcttctgtatggctcagcttctacttcccttcctttaataatatcaaaacaacaaaccttggaagaactaaaatgtaatatacaaaatgctttcaaatagagaagtaattgacctagttgtacttattaatactatttagattgagaaatattaagcttgcaactgaattaattttctaataatttagaaaaagtgtctttagtgcccccaggtaatactgcttttttttaaatcttaggcaagagcattcaaaacataaagattttatattacacactattctcactaatatttaagctaaagtttatgcaaagatatgcatttcttttactgttgagaagcctttgttttgtgaaaatacaagtactatttcattttctcatacgtttttctgtaaatggaagccttctataaatggcttaacttgcagcatttggaaacttttttttttcttgcatgagtttggagaatgtggccttaaccttattcattccatcactctcttattgttcattttaagggtacttcgacttctaaatatcattcaagaaaacttctgaagactgcaattaggtcctaaatactgaaaatattttcctccttctgatatattttccatttactatctcatttccacataactcagaattaaaagctgatctgccatgtgctgtacacacattaatagtgtgtaggacaccttgtttgtgctaaaatgagataacagatgtcaaagtactttgagaatttaaaatcactatgcacattaaggtataattacacatatgtgaatgcaacatttatttattaggggtgtggaaattggggagtgtttcagaacttctgggctaatgagtccagtttagaattacaggctggagaagctatgttttcaacatgataggaaacccatcattcagatgtatttatatcattacattcagttcatgctgaactcaaattttgtttcttgcatattcatttaaaataatttgatgccagagtactgcttatatcagaataatagcaaacaatactcacaatatttgcaaatcccctgtatcccaagacaggtattttaaatattgtttcaaattgaaaaaatcaattaaaccccattctagtgttttattttaaatatctgccaacaaatttaacaggtaaaatggacattaaatttatctcaatttaactttaagcattgcttttccaagttaagcaaagcacctccaaacatctggtaagcagacctcaagaaggcaaaactcctaatgaattattgcggccaccaagaacttaaggtttctggcccagggctagaattccaaatcactctaatggtagctcagctaaacttgaagtagaggggtttctaagaacataaatctgtccaggtgattttctctcaactgcattctcatttcttttagtaggtaagaaagaaagcctgaaggtggacttttgcattttagtgggaaatggactggttaggcaagcattaaccaagctacagtaagcttcttgggagaaactccttgggaaagaactggaggaatggagctccaggttggaaggaggtataactggctgcttgcttgcaaaaattttaattgctaattcaagtctttaggaagacccaactcgattgtctaaacacataacttcaggggaaaaagtatggtctagagagatatgacaggtttttaaaaaagtatataaatttcaaaaagtattacagcaaatgaccaaaaataaggtagaataagaaaaaaacaaacatcaattgagtagttgagtggtgaaaagtcacataaattgaattattcaacaacaagatgacagagtatttcatattttgacaggttaaagcagtatttttaagaggtatgcattcattgctccatgggttttggccttccatactagcgatcatgctcaaaactgcaattaacaccacccagagagttgcagttccagaatccctttttctcattgatcagattcctgtggtgtcatctcctattttctctgcagcagaagtgctgtattgaacagcaggcttttagaaagcttctaataagctcctgatggctgatggagcctgtgtgtctagcagtcactcgatcatcgttagtactccacatgaggggaatgcatgcgtgcacaggtgctctagttcactacgtcccatcagcctgcttatctcactctgttttctgcttttaggcttttttcacctggccagataaaagcccattccattttctcaaggcaagacaattctcataagggatgcatttctgattggagtgacccgttaaaagatttgtgctatttggtactactgcccctgctttcgaaaacctcaggcagcatgtaagggtgcagtcttgctaggccacctctgagtgtttatacataggtagaagggtaagtcgttttttaaaaaaaccctgcagtatatggagaaatttcataaattatgtgagcagctgagagaggtaattctgctatactgcggttgacacagtcaataatagctaatgctcattaaagaactatactcccttacccagggaagaaatgggctcagaaaagacccagttcatattaatacacaaagacaacatggctcaaagttaaaacaaaccacatctctgaaatgctgtcattagagaaatttaaccacatatgtgactcgaaaatataacaagtaacgaaataaatgaaaagtttggggggaaaaagctttcagatgccctatttaaaagagcaccagtgaaaacagtaataaaaattaaaagacaatacctagcaacagagaaagataaaattattcttatttctcctatattttccatcccctttcaataaaagagtctccataatcccaacattgccattgcctgcacaaagaacccagagaacaattcaaaattaaaggagctgaaagaagacacagtatcccaggccttctctccccaaggcatctgcaggcagaatagccatggtttccagaacattctcatcacatttgtctctcgtgagctgcagcatacaatgtttaccagaggctttaaaaataaaatctcactaaacagttgagaaaaatatttaacaaccaaggcaaagcaattacagtcaaattttcacctcgagattcccatcttaggtgtgggaggcagagagaagactcctgcacatcagtctgaacctagaatgaggatgaaaagagttgattctgccaatggttgacaacaaatccatatttttgaatctcagggtgaaatgcggagctacccgcccatctgaatgtacattaagaacagcgccactgttcggttaaggctgactcaagtttctaagcagcaatccgaggacaggctagacatgaacatccctactaaaaacatggaaaggtctgaacgtgacagatctcccttttcaattacttgtgctagaaagcatcatcattttcaactagtcaaggtgacaatatgagaaaacgcaactagtcccagtagagcatttctgtatgaatgtatagacttgggaggaaattaaccacatcacacagggttaatccttccccccaaacttctgccccattatccaaccaatttacattttgtaatctagacttttattactcattttcattatgatttgactttgacactatattattcccttcagggcaaagactttctgggtgcaatgagatcagacataatttcttcagcaggaatgcataacaaggacatgtgtacacattccattcccagacatttctgtctcggtctagttcagatgagcaaggaatgaaaggcggggcataacatggtataaattctagttaggcacggacaataagcatccataggaagctactgttcactattaaaaggcattacctgatatggttgaaaaatatcacaaaggcttataacaccttacctgagccatctgcctctccagttttgatcggggaatatcatcaaagtagttttcatttcttctcctccttgcatcgccctgcatgataatgtgaggaacgtctagggagccaccagtggtgtaagtgctttggctaagtgatggagacaactgaggaggagtgtgattaccactgggttcctgaatggaaatacatcatgaaataaataccatgttctgtggctaacctttggtttcaaaattgtgaaatactgacaagacaaactgtgggggtggggagtcgcttttgaagcaacagccaaggaatgaatgacattccaccactttattaatggcatgatctagtcaatacgtttttcccctaagtatttcaggtcaaaggtctgaaatatcaagagtcaggttctgttttcctaaagcagcatcatggatggtctcaggagggaggcacacctatgttgggcacctctgacactactgcatgtgtttacaggggaggaactgggccctcatgtgggcagagcgtcctcaccatggtagatgccatgatgagaaagctaaaatgagacccaatgggtcttgatccttcatcaaagaatggtctgacaacagggttgggaagaggacacagtacggcaacacagcatgtcacacgcacagactgcagagcagtgcatgctacgacagaggatgcttttccaaggcaaagacaactccatccaagggaaacgggtcaggaggaagatagggggcatagacagctcagctctactatttgcaagtagaatgaggattgggatcatggtgtttctccagatcccttctcctccggatattctggaccttctatgatagatttaggtcctatacttttgcatggaaatctctgtctttgatctttttttgttcccctaaatctcttccagagagccagaatgagaggttcagaaggggaaggaaaaagagcagggtaagtagcaggaaatgactcctctaaagagtcattttagggtgactacactgatggtgcttatatctttctctccttccatgtagcaaaatgaaggcaaaacaaaaatcttttttttttctaatttatttgaggctcctctttctaaggggtgaaatttctatttgtacttttatgactcccaaaactctcaagtagcctccaaatatcccagtgtaccctaatgcccccagtaattaattaaaccagtattcatgtagtccctacccatcccactccagtctctctcaggaggctaagcttgtcctcctggagccaattctcttgcatcccctgaaatccttgcgcattttcctctccaaagctgaatcaactccaaatcctaacagctcctttcctgtcctgccctctgttatcctgacagtggctatgctgtttgctgaagtttattgataagaggcagcccactgcatttcatcacgatggttacgtccgggtgccgtgcttgtgttcatctcttcagaaaagaaatcagaagcaagcaagtgcaggacaaaatagagagcagagtgggcaccccacagctttcagggagatctcagcttttcgacgaattttagaaaagttcttgtaggactcatgaacaccagtgactgccggccacttcttgccactgccatttttgcctggaaatcatctttctcacttcctctctgccctttcctccctcccttccttcacttcctctttatttctctctcctttatacaggttctctttagtttcctacctcataatttttttttttttttttttttttttgagatggagtttcactctgttgcccaggctggagtgcagtggtgcgatctcggcccactgcatcctctgcctcccgggttcaagcgattctcctgcctcagcctcccgagtagctgggattacaggcgcccaccaccatgcccggctaattttttgtatttttagtagagtcggggtttcactgtgttagccaggatggtctagatctcctgacctcatgacccgcccacctctgccttccaaagtgctgggatcacaggcatgagccactgcgcccggcccctacctcataattctaaagtgtagttgaataaaagaaatacaatttattaagtaaggttttagattctctattctgaatttttgaagtgagtaaagctggacaaattttacttcttgaaaaacagaagaccctaaggttaattttaaattgatctttacttaactgtggtccttgatcaattttctttctgtgggtttgaggagtctgacagaaaacccatttccgctctcttggcgtagatggggtgtgggatgggaggtgagggagtggttctttaaaggtagtggtttgtcaggctgaattccattatagatggatatctaaatctcaaaaatatatatttaaccaatctagaaaaacaaatcttgttgttttgattgtgtcaaacaatcaaaagacagattgttttctacacagatatggtaaacttcatagaaaagagccagcacttcctgatctattgcttcagttgtataaagtgcacgtttataaaacctataaaactacataaaataattcttttattttcttactctgttgcccaggctggagtgcagtggtgcgatctctgctcactgcaatgctccgccttctgggttcaagtgattttcatgtctcagcctccggagtagctgggactacagacaggcacaaccacacctggctaaattttttctgttttcagtagaggcagggtctcaccatgttggccaggctggtctcaaacaaatagttcttaagataagggcagagaaccagatgaatgtgcttggcacttaccctgagggtgatggaccgagggggcttctgtgggggatcgtcgtgcagcctgtctcccagagatgccaaaatacgtttcctgtggccaatcaaattgatttttaaaacctgaaacaacatatatttgggttaaatatttcactggagaacaaataatttttatatgtcctaaaacatgtggggtgaaaaaagatttgtgcaaagttactcctgcaccatgagatgtggtgtcacttcagtgtgaccgctgaagtccagaaagattgcagtagcatctggaaagcctggagtggctaagtatcaggggcacaaagagaagggaggatggttctccttccactcatgctgcctgagagcctcattcccaatgcagcagcctcaagagaaaccagctcttcttataagcagccgaaacctcacaggataaaatctgagtctggactcaggcttcagagggacaggctgccctctgtctctttccctccatccaggatatgcagtcatgccagcctcctctaggtattagaagctccacattcattctcaccttggggcctctacccctgctcaaccacctgcctggaatgccccctctcccctctgagattttcaaataaccagtgacttctcatggttctggacactgtgctgctgatgtctcctcagaaaggtcctcccccgcctccttattgaagaagccatgccctcaacccctgacatgctctccacgatgatccatcctcattttatcacactctaaaagcactttctttacaagcttagtgtttgtgttttgttccaccctctccaggtaagctccctgagagcagggcactggcatatgtagagcactattatttcccaaaagcataaaaggatgactaaaaaaaaataagggattaatgaatatgaaagaatgaatggtaatagagatgggagttgcaaaattagagtcatcttgcataaggatacagttagaatgaaggactgcctattggggtagactcagagcctccccaggatggtattttgaatctgaccatgctgcaaagggcacatggtagaagagctctcaaagggaactgagaattgcagcgcctcaatcctcagccccattcccggtgctttaccagggccacacccctttcaatcttcccaacttctctatctggaaggagttctcacttgacagatgaagaaactgtggttccgagtggttaagtcacctacccaagagccagcatgtcgtggctctgggatttgaatcagatttgcctgattccaaagcatgttttactccaaagtatacgtcacaaaatttgggcatttctccaaatgttaccagcttcttaaaaacacattgtatattcatccattcataaaaatgtgtttacctcttccctacctatgtgtagtcccaggatataataatcttgttgggtaactagtttccaaagtcgttatcccatgtgtacatttttctcttctcttttcaagttttaagatagaaggtggggagagcgtttctttggcaggcatcccatgataccttgaattttttttaaatttcaacttttaatttagatgtaggtggtatatgtgcaggtttgttacatgaatacactgagtgatgctgaggtctgggatatgaatgatcccgtcaccaggtagtatgcatagtacccaataggtagtttctcagcccttcttcccttcctccctcccctcctttgtcgtccccagtgttcactgttgccatcgttatgcccatgagtactcaacgtttagctcccacttataagtgagaacatgcaatatttggttttctgtttctgcgttaattaacttaagggtaatggccttcagctgcatccatgctgctgcaaaggacatgatttcattcttttttatgtctgtgtagtatttcatctaccttgactttttatttgcctatttgttggttaacttacgggccttttggcctaaactgatgtagattttaaactcacactacgccctattcctttgacagccaccctctgacccatgtctgttgatgatgaggagggtaaatgttagccaaggtgaatgtccccatgcaccatatccctatgattttataaaaccttcatctccccaggctgattaatcctaatctttgcaagtttgttttcataaagcagctcctcttttccataaatcatttcagttgacatcctcaggactttctcctaccctattatagctgcttaaggtttgctgaaaaaatggctcacaatattccaggtgtaagtgaaccatggctttacatttatgcaggatactgttttctgcttttaatacccgtttaaaatgtccttcctaagcacacgtgatttctagctagccttttagctgcagtaggaataaccagggacaaaagtatacactgactataaaatcccttaattttgttatagctaatagttcaaagccctttaatctaggagggatgatttgagttatttttccctaaatttcttatcttacagttgtccaggcagaagcccatctgccatccttctgcccactcacacagccctatgttagctttttgcatttatattaaccagtttggcatttcactacctggaagagcttagtgatttttgcatatctggaaatttcactatgtattcctttcagatgatttataaatatgctaactaagtgtggccctactgctgattacttgcaggcagcattgtttatacgatccatagaaatgcccttatattcttgtattgtttctgtttttaagcatcaagaccaaataattcctccatctcagaaaaaatatgataaccttttcaaaggtattttgcaagtctaaatacagcatattttctaattctcttttattctcatcctcaattcctttgccaaaggcttctattggatataaattcctcccataaaatcttcaccgcctttctcccagcaggtagctggacctcatgctgatggtactaccttgccccctccctgagtcctgctagaaatgttttttataataaagacatttgcttaattattattattattattattattattatttacaaaactgacactaaataacacataactgtggtacaattgagctgatgtaatccccactattgcttttggtttactctcccacaactcaattttgggcaggttacctgactcctctgatctcaggttttctcacatataaagtgaagaagttaatgacaatttcaaatgtggttgggaagatgaagagtaagttgtgagaataaccagcatagtgcctgacacatagaagaagcaactttcacagtgtgcttattccagtgaatgggttctgagggtgcacaggaatcctggcccagaagaacaaggacttgttcattgtcataaagtcaatcatgttaaacaaatacactggagctttggatgaagagatgtggctaaccttgggaaagccctcaatgaagtaacttatcctagtaggaacatggctgatttctagctattagtctgaggccagacccaatttaaaagaatatgctcttctgccatccacatcgcttaatcttcaataggaggtaagctgaggcactcctctgcactgaagcttcattgctgtctcctccatagagctacccagatgagggtggacggatgaatgaatggattgatggatagatgatagatgatagacagatagacaggaaacgaattaacacaggatggttagtactatcaagatcacctggataactctcctttttatcagaaatgagcccccatcactgaagatactgatggtaacttccatttactgaacattttctatactctagttctatgtcctagttgtgctagaaactaccaagtggttatacacaaatataaatatctcctgtaatccttacaatagcatacaataaaaccattctcattttagagatgcaaaatctgagattatgaaatgctaagtaacttgcccaaggtcacactgctaagaggtacatggctaggatgtgcacctgattcttaaccagcccttcactactctccttgctcttcttcttgctgttaacctctataccttttgacctttagctacactattggttatgtcatcatgaggcttcttaagatgttgcttcttactttgagttatcatgtttaaagcatttatatagggttttgagcatctgaaaacattaaaataattcactttttagtaaggcttatagcattgttaaagctacaggctacaagggcaggtacctcacagtattccctgtgaaatacacatatagaccaaggacaggaaaccctcatcacccaagattcaatccgagctggctcactgtggagtggtagagagggtgacagtgggcttcaaaacgcccaagttgacagtaagaaatccaattggcaaaacaataacagagagaatattccaaagaaagatggtcattatggaaaagtcaagtctgaaggtggctgggtttgccttgagtgagaaaggctttatagcagactgtctttgcaagcagatggggttcctgagtagtggaatcctacaaccccaggcatcatgggtgataaccagtgtgaaaactttagttttcaagaacaccaaagcaatggttactgcagtagagaagaattctgtgttttcgttactgtttgggttaaagttaactgttcagacaagaacataatgggagtaaaagacaaaataatggtaatatattggagattcagttattctaagatgttgaagcaattcagttcggctcaaaaaacaatactgaatttctgctaccaattatttggaggattcaaaggggaacgtctatgaacagagcttacaatattggagagatcaggcacaaataactacattatcacaccattaactaagaaaaattattatacacataagcataagaatgtggctccaactgctgagttccaatagataagaaataaaagttggccaggcgcagtggctcatgcctgtaatcccagcactttgggaggctgagatgggtggatcacgaggtcaggagatcgagaccatcctggctaacacagtgaaaccccgtctctattaaaaatacaaaaaaaaaaaattagccaggcatggtggcgcacgcctgtagtcccagctactcgggaggccgaggcaggagaatcacttgaacccgggaggtggaagttgcagtgagccgagattacgccactgcactccagcctgggcgatggagcaagactctgtctcagaaaaaaaaaaaaaagaaaaagaaaaggaaataaaagttatggcatgtgttcttaatggtttttattacaactattgtaagaggaatgtgggtcaaaggcaaggagtattgttgaaaccacaggagtcagccacaggtgggtatccattcatcacagcagtagccgcctccaggaattttctccagtatcacttaaacaggataattccggaaaccccactgtgaatctcagcaacaggagaataatcatgctggatgacaatcctataatatcacgtcactgctgtttatgtttctgggtttggctgtgggaattctgccagacagtatcatgatatacccttacatggaatagcttacttcagaatatatgtcatagcaaagctgaaagtcaatgtacttaaacttccttttttcttttaaaatttaatgtgatataaaattaaacatgtttaaatttatatcacattaaatttaacatgtttaatttaaacatgatgtaaatgaagcatttttatctgcttttaaaaaagtaaataacattttgattataatagctatactgctttcccattttagacactttataaaatacagaaaaacaagtaagagaaccagtaatccacaaactatatctaaatagatatatttcatttctcccccatgattatgttttgtggtggtcatatcacgagtaccattttcgccttttcttcagttctttaaagctaaagaacttttctacatatacaactctcagtagacattttaactaactccatattatcacattattgtttcagagaagtatgtcataattcactaaacatttcccctatcattgaaaattttggtttgtgctcctttctggatagcaaacattccacatgcttaaataattctatcatcctacaatttccgttctcaatgccatgtttacatagacacagcatagaaaacaccaaagaagactgcaagaatcacacaagtcacgcagaaaagtcatgtagcaacagtctgtctctatgttctgcatgaaatctcaatccgtttattgccggctggaccaactcctgggaaaatcacaaacccacataatgttcctcagtgccatattttgcattttgttatgtttttggagttcagatttagctgacagatgtgaaacagcacatgtagctggaattcttcagagagtacacatgcagcgatgctgggcacacaagcgattctagttctcaccaccaggcgactgcatcctttttatttctagattgttattgagggagggagttcatcctgcatttggaactcccttccattttagggggtagattatttcccctttcctttctagatacttggccaactaaagagaacagctcctatgcaagtctgtagagctcacctggcttcagagtagcctcttctaataaaactgcaagtgttctgagcagttctggtgttcctaaatgccaagaatggaagttgcggtggaaactgatctgctttgttctcatctgcagaactaaaattgcaaataattgtcaaagttttcccccctgcctgataacaatttctaaacactttccacctgaaagcatcaaggcaaaagtgcctgtgtaaaattccatttcgaattcctgcaatcttagaaatcctcacttgaacttgcatacagttttgaccatgacatttttctctcttatttcttgaactgcaataatccatgtccagcatgggatggtgaacagaaagacctcaggagcagaaagtcatgacatttggttcttctcttactcttcttctagctaagtaatctttaatgtctttgagttgtaatataaaggggacaataacagtcttattcaacaaatatttcttggatgcctttcacatataaccaccatgttatgcaatttgtgagccacaaagaagaaaaaatatcgagtcctccagggctctcaatccaggcagtaaaaaaatattaaaaccatgtgaacgtatgtgtgtgtatatttgtgtgtatgtatgtaggcatctatgtatgtatgtatgtatctatctttctatcatccatccatccatctaaatatatacgtctacacagccttcccagcctaaaaggggtttctgtggaatgaatgagaatgactaggaagcttatctggaaattataaagcacagaactaaggtactaactaaggtattatttctcttttaagtataacagaaacttaaaactttcttaccctatcaacaatatttagatattacctttgatatttaaatgtgccattatggatatctctgggtagattttagatccagaatcatgccttccacttctccaatcttctctcctgttatttctttgctccatgtatacacacttgtgcatattccagagtgtctctgcctggattttcattagaatctcacaaggatgaaatcgagatccacctaaagccttgcttgctcaccttggattacatagacctttctctctttgaatttctttagtatctgtggtctaccctgtgctgttgacacatgatacatcctggtgggtatagctaactctcttttttttgcgtatgtgtcttacctgatcaactagactctaggcgctgaaaagtcagatatagtgtcactgcatctcagggtccctgaatgcatctagctcacgaatacaactcaaaggtgatctctaagatctcaactcaaacccctgtcaaggtggacaacaaatgaagcaggggagatgtctctaaaagaaaaagagggaaggaaaataacacctatgtcttatttcattccgtttctactctcaagagtcttctattctttctgagctttggcaccttaattcctacacacagtcttgccacgggtgatgcaaaacttccttacatcccaccatctgtaactctttccctttacctctgccacttcatctaaaaaaaatccctctgactacagtttccaaattcccttttccttctgctattactttccaaaccaactgctactaaataatcagcaaataactgtttgacagatgccaccgaaatacaactgtactaacctatggaaaggaaaagaggttccaagttatacagctccagagagagcaaaggatagtgagaaagagcgagggaggaggaatgcgtgttttctgaatgtagtctgtctcattaaataggaaatactaattatgaggaaatgagatcatctttgcatggaaagagagaccttaatggtataattgcctctgaacatttaagggctctggaggtacaaagccttcttttgtaatcaatgagaatcttaggtttatttgtaaagctctctgaattacctcttgatgaaggtactaattttctgattttcatgtaaacattgcttcagaagattaaaaacacacacaaaacaaaacaataaatcagttcccaactaatttccctgaaagttacttttaagtaaagcttgctgccagttaagtttttataggagaaatttggtttacattgctcaataacccaatcattggggttattgaaggaaaaatttgttacaaaagaaaatgggaagtatgtgcaacatcccagatctgaagttattcttggagatgtgaagatgtgctaatagcatctgaaaagtgcaaatctccctgcagtactatgaatacataaaaatgctctgcatcttaagaagtagagagactgctgttttgctatattttgctaaccatgcaggatatttactgctaacgagggtattttctaactttatttcctttcaatttttgagatcataaaatttatgatcaattatattgtgtgactgatgctctcagtattgtaaaggaaattatggttaccgaaattcattaacatatatccatataaaataaacagaaacacgcaacatacatgaacacacccatatttgtaaaagaagctctaagacaaattgagtctcaagagacaatcctaggtaagtgagggcctggttactccgtttttggattataagtggtcttttctgctctgttgctgctctgcccctcttcttgaggtttagctactttaatggcatataacaccctccatcagcagacagaatagtgaaagaggcagtgaattcaatccagccaattctgtttctgtcagcagctctgataaaagggttttatgtgggaggaggtaaaaaatctacctaaaactagctaaactaaagttttaaaaatgcatccacagattttacttagcctagccagctactactgcactttagaattggacatttaccatatttcagctacgtatggaggcaaaaaggatgttaaggttaaaagaaagtattataaggaaagcagaggttgagtcccaaggatgagttcaaaaagaggaaaaaaaaaggggtaacaacagtgagagagatttcttatcgtcccttttctccctttgtccccacccccaccactatccccttccttatcttctggagagtcacatcacagagtagagctaggaatcaccctaaacccataagaatggctaatgttagaaaagaatgaccctacctcggatgataaggatgtggaggaactggaactctcatcttgctggtaggattgtaaatggcacagtcacttttgaggaaactgccagtttctcaaattttgacccagttttctaacatataacccagcaagttgactctagctagcaactcctagctaaaaatgaatacatatgcccacataaagatgtgtacatgaatgtttaagcaacattattcataatagctaaaaattagcaataatccaaatgtccgatcaactggtgaatggataagtaaaatacagtatattcatgcaacaaaatactgcctaatgatacaaaggaatgggctacatgatacaggctatagcatcaacagacctcaaaaacattatgctaagtgaaagaagctgcacacacaagatgatagaatattgtaggattccatttacatgagtttctagacagcataaaactatatgtacagaaaacatatcagtggttatctggagtaggaataggagcagggattgactgcaatgagcataaaggaactttttagggttatggaaatgttctaaaatgggattgtgttgatggttggatagctgtataggtttactgaaatttacccaactgtatacataaaatgggcgattttcatgatgtgtaattaaattgcaatgaagttgtttttgaaaaaagaataatgctgggagaatgcattcagtatgcagtatcgtataaataaggccattcctgaaggctgtaatccaggctgctcgagaagacctctgttgtcttggaatataccacttatcagctggatggaagggtgagcaacatatacactgcaggatgtcttaaggaaaatgtgacctgcagggtagctttgttctaggagcctagtactatttaactataggctaatagatcagtagcatattctttattataagtgcacaatacagtaaattagtacgactttcctatgtatgtatatttttgagggtcttaatcctccaagtcataacacttcagtaaaaatgtttatgctttctaagtacttacaacaaatggcttatggatgtttgcggagtgatcactaggagccaacatgggttctctctggatgggtaacaggtggtgatcatgagatgacactcaagaaccagagaataaggttgcattctaagcaccaaattaatcacatcaacagtgctatgatttgagttttctctgacaaaaactcagctttaaattggatctccaatgtggcagtgttggcagatggggcctaatgggagatatctgggtcatgaggtggcgaatcctccttgaaataacttatgccattctctcaggagtgagtgagttcttgccctggcaagactggattagttgtcacagggatgaattagttcctgcaagagtgggttgttaagaagccaggacatcctgtgggttttgcctcttcacacgtcagcttcccctttaacctttcaccatgttgtgatacaacaccagaaattctcaccagaagctgagcaggtgctggcaccatgcttcttgaacttcctagcctgcagaaccatgaactaaataaaccttttcttctttataaatcacccagtctcagatgttctgttatagcaacacaaaacagactaggacaaacaaagcgactggagtcagaatgactttctagcccatgaagagtcaatgaaatagactggcagtgtgactacagtttaatcggtgatactgaaacccagctaaataaagaaggtgtgccagggtggggtggagaagcaagggtagagggcatattgaagcagtgaaactatctagctttggcagcagcatggggagacactgaatcttaacataagtaagctccctgattactcaaggggttattttatcaggttttgtactgatctaaatgaaacatccctcaaaattccctttccttcaataccacatgtaccaggaagcagtaattgctgaatcagttttctgagtgcccagatatgagaagaggaaatgttgaagacgggggatcagggaggggagcatttggtcagagaatccttcccatcatgtattaacagaatggacatcttgatacattgatctctccttaattaaattaaatccacaccaccgaggcacagaacctgctcaggagggcatagtgattaagagcagggcttggtgtcaggatgacctgagtgtgagtgttggtactggcatttactctatatgccttttggtcaattacttaacgtctctcagtatcacctaacttgtgtaaaatgatggagctaagaaacagtattcgcctcttagtgtaattgttaggattaaatgagacatatgcaatgcatttagcacagtgcctggtataaaatgagcttcataaaattctaacttcattcagtgttttgattaagcccagtttctgaaatggaagggctgagccctcccctggaaccccaccagaaggagctcagcagccagccatgcaccttttccctggcaacaatccctgcatcatcagccactcttcaaactttggtggcctcattgaaaatcagtttttgccaaactttattgactttctttttttgacaggtattagtatgaggttgacagaccaggagaatgtcatagatatagtgtctttgattccaataaagcacttgatgaagtctttcattatctgcaagatggtgggctctatgagggaaaaattaagtggattcacagctggttgtacatctatagccaagaggcttgatgaatggctctgtcataacctgttgggggaccactgattgaatgccacaggctctgcccctggattctgctctattcaatatttttattaatggcatcaaaatagacataagaagaatacttatcagatttttcaatgacataaaactgtgaaaaatatttaatataataataggctaatgtaaaattcaacattctctcaacgggctgaaaaggccaagctgacaccaaaaagatgcaatttaacagggataaatataatgtcttacattaaggatccaaaagaaatcaattgttcaagttcaagatgggaaagatatggctgtgccacagttcaaagaaatagctgaatttttagttaaacgtaggaaggggtttagcagaaagaatgcaaaagtatgggtctaatggggagggaatgaacccatttagaataattttaccaaataaataatctcatttaccttgctattacaacctaacaaggctggtaattaccttaactttagaaatgaattaactgaggttcaggaatttaaggaacttgtcaaagtgatgacaaaatcaggatttgaatccagttccgacttccaaaatttgtgcactttggattcattctatcttgctgccacttctctcccagagatgctgtgtggctcaagtgagacaattttaatggacgtacctagcacagtgcctggctcctaccttctgctcaaaagtggctgattatttttctcccagagactcattaaatgtaaggctgggtgcttatatgaacaaccagtactttattattataatatgaactctgcagtctattctaagtcttttcaagtttatccattaatatacctagtgcagaaatgattctgttgatttttattctctcattcaccattatttccaaatccttaatgccagaagaggaagtccagcctggaaaaggcactggaaaatttgagggcaatctaaaaatctctgtcagtcagtaatgattcccagataattaaaacttttttttttttttaattaaggtaactttcaagggctgcattagtggttcaatgctgcgtattaacatgacaaaaacctctattacctttagataatgaggtggtgtgttaagtaaccttagtacaatgatatgcatacagaatgtacaaaattttcaattaattcaattatttaattagtttagcttatggttaaaaagatacttttttttctgttgttggaggtcttattagaattcttcatatatatatatatacacacacacacacacacacacacacatatatgtacacatacacacatatatatatatgtatattttgttctttcctgcctaagggtggtttattgacagtctttaattcttccctagatatctggaatactgcattgcatctgagtcatgctctgtgtagactatttgtcactgggccacagtgctgctgcaaaaggtggctgaggaatgcacactggctccagcagtatcctgtaagatttagctcttttaaataaaggaattcttaggagcagttagttttcattgcctcttgcactaaaagcaaggcctgacaacattagctatccaaaagttccagttaatgaaggtttcattgtaaaaaagaatccatttgggggaaggtgcaaactctttgtaattttctctccctctttctcttggcctaggccagccatggttcacaaagctggagaatggagaatcattagctgctgatggtgctggtcatcccaccctggcaaggaaaggaacaggtatgttgagtgaccaggttgacctgtgcagtggatgagccgaaaacctcttttgtaagctgttttgtaaagatatggagacaactgatgattctggaggtggaggatgctttgagggccagaacacacactctgcaataaagcaggtcacttccttcaggttttaagctaaaatgtgaacacatcagtggactttcacataagctgtgctttctttctggaatgtctccttttcctcttctccatctagtgaacctctactcatcttctactctttcgagttaaatactacttttgaacaaataatagcaaaagaacaattaacggcaacagaactttggaatgacagttatcaaactagtcctgatccataaacaaaagtctacttagcacattgtgtgaaaaaatgaagtctctttgtttttattttcttaaaccactttattccagtatgactgacatgtaaaaggttgtacgtatttaatgcatacaacttgatcaatttagggataagtacatacacatcaaaccatcaccaccatcaagactataagcatacccatcagctcccaaattttcctccagctcctttcattattattatcatcatttttgtgtgtgtggtaagaatacttaacataagatctcctcttctggcaaattttaaatacacaatacactattgttagttactggaactatgctacagtagatctctagagcttatttctcttgcataagtaaaattttctatttaaccatcacctttccatttctgcccccagcccctggtaaccaccattctactgcctgcttttacgggtttagctatattagattccacattgaagtgagatcatatagtatttgctttctgtgcctggcttatttcacttagcataatgtccttcaggttcatccatattgttgcaaatggcaggatttccttctttttcatggccaaataatattccatggtatgtatacactacattttctttattcatctaatgatggaaatacagattgattccttgtcttaggacattgtgactaatgctgcaatgaacacgggagtgcaggtatctcctcaagatcttaattttttttcttcttttgagatggagtcttgctctgtcacccaggctggagtgcagtggagagatcttggctcactgcaacttctgcctcccgggttcaaacgattctcctgcttcagccttctgagcagctgggattacaggcatgcgccaccatgcctggctaattttcgtatttttagtagagagggggttttgtcatgttggtcaggctggtctcaaactcctgaccttaggtgatttgcccgcctcagcctctcaaactgctgggattacaggcttgagccactgcgcctggccaagatcctaatttaaatttgtttggataaatatccagaaacagaactgaagaatcatatggtgggtcaatttttaatacatgtttattttgtatcaggttgcaaatttgttgatcaaaattatgagttcaagatgaaaaagtgaaaagtagagcaatgctttctaagaaatagatactgaatcatcaaatggaaaagtaatatccccacttgctaatttaattcatcataatttacaagtctctaatgaaaaccaagcaacaaacaatgacttagtatttgttagaaaacagtttaatctccagttgtcactgaactcattagcaacatatgtcattcacacacagtgaggaattattaatttttcatttcaagaaaattgtcaaattaagctggatagaataacaacatacaataaaaaaattggtaatttattcttatattgccctagaatgatgatagtgtgtggcatgtcattaattaataaacataatattattcacatagtgggcccttgatatccatgaaatgtgtaattaatgatgaaaatgctatagtgttactatcacacttactgatcacatcgaagttttttccacccacacttaaattaaatctccctgaaatccctggttcaaatttcatgagattcaagtaatttgtgatttttttttttttttttgatgcggagtctcgctctgtcgcccaggctggagtacagtggcatgatctcagctcactgcaacctcctcctcccaggttcaagcaattctcctacctcagtctccagagtagctggaattataggtgcatgccaccatacctggattaatttctgtgtatgtgtggtttttttttttttgagacggagtctcgctctgttgcccaggctggagtgcaatggcgtgatcttggctcactgtgacctccgcctcccagatttaaacgattctcctgcctcagcctcccaagtagctgggattataggcgcctgccaccacccctggctaatttttgtatttttagtagagatggggtttcaccatgttggccaggctggtctcaaactcctgacctcaagtgatctgctcacctcggcctccccaaatgctgggattacaggcatgagccactgcgcctggcctgatttgcgatttttcatgaagaattttttaaaggccaaagttcatcctcaagataagaaaaatgattgtttgccatagaattcttctaatctcaacttttaaaagaatttattaacatttcaggtcaaatgcctcaaatgttgaaatctcatattttaattctttgagatgaagtgttttccccagcatttcttttttttttttatttagatttagtcttaactcgcatcaaggtttataaaaaatgatatttctatttcatgagcatggacagaatgtgttgaagcctccctgcaggaaaattatgagcagaggtaaaaatccttgcagcattcttagctccttagctgtagtgtctcttagagaaatgttgcatataaggaatgctaattaaggaggctgggagaaaagagatgccacctttccaaacacaacatttcaaaaacaagtattactaacatggtggttttatgaagcacttgaatcttacataagtatggcttgttttttgtttcctaaaaaaagactgcatttgagcaaaccaaaacccgagtaatttaaatcatgaatttcagagaaaaaagttttgcatctagctaggaacttaataaaatataagttttcaaatactttttttttctattttaaaatcaggtacactgctatttgcaaaatctctagtcaagtagaagcagaaaaagaccgtcttaattttaaaagagtaaccctgctcccatttatgaggatttttgcagggagaaagattttataagatattcacttcaatacaaaagggcttaaattcaagagtatttaaactttgaatttcaacttatcccttggaatggcctcatggctaatttcttgtctatatacaaggtcaaatagatgtatgtctttggttaatttggactgactgccaagcaatttattaggaagctggaggatctaaattgatcatgaagacaacagaataaatgggctttgtctgattacttccgtttacctgatgattaaatcctgcctgcagaaaatttatgtgacttccaaataacacagagacagacagacaaccccatgacacactatttaaaactcttatcttcattaaatgaaaaaaaatcaatttcaaaagtaccttttgttctttatgtctttgttaaattacgtctgaggaagtaaaagagcttcttgttgccgtacttcctggtctattgtcatatatcccacaattggagactttttgcaagatgggtaatttggatatcaaatatgagaaattataagtgcctttagcagatactgcttttccaagagttcagtgtgatcttggataaaaatttgggcagatggcttcctttggaggcttatacattgttttccacaaaatgtagttgatggagaccagagaagcattgcattttttttttttttttttttttttttgagacggagtctcactctgtcgcccaggccagagtgcagtggcgtgatctcggctcactgcaacctctgcctcctgggttcacgccattctcctgcctcagccttctgagtagctgggactactggcacacgccgccacgctcagctaattttttgtatttttagtagaggcagggtttcactgtgttagccaggatggtctcgatctcctgacctcgtgatccgcccgcctcagcctcccgaagtgctgggattacaggcgtgagccaccgcacccggcccagagaggcaatttttaagatggaaaaaaaaaaaaagattctctccaactctctttgcccagcctgccaatgctcccattttcacagcacccaggccagccaagacctaaccttatgcagaaaaaggaacaatgctttaactaggcacagagttctattacttttgctacctaatatgcaaaacactaaaggaagagggcttattaaagaaccgcagcatgttttgtaaaagttggtcactgagtctttgacagaactgctacagtactacagttctaagttcctactggcagcttctattttgagagtcatgccttgatgggagctacaaacaatgcagcccacagtagtacacattcatccatccattcattccttcagcaaatacacattgagggtggaatgtgatggctgatgttaagttggttaggagcacacaaaaatgcacaggacatacttattgctttgagaagctctgggcctagtggggaagatgaagtgacagatgctcttagggagtaggttcagagtggtgtgaaaagtagggagtggcaatctctacctggggagctggggatggcctcacggaatagaagacaggcttcagggctgagaaggagatttccaagtaaagagctataggaaggcgattctacacagaggagacaccgtgtgcagtctcagacgtgtgcaaggacacaacaggacatgtctgtttatggtttcaaaattttacttagttccctattaattttgctaagggggaaccatatgtgtgagtagcaggactgggggatatgaaggtgggtcagagccagattgttaagagccttcaaaaggaatttggtcttcaacttaaacaaattagaaaatacgtgtaaagtgcttggaaagatgtccagcatatagtgtatactcggtaaatacaagctgtttctgttatgttgaagtagacaggaaaccaaccaaggttttaaagaagggaaaggatgctcatgactataatcccagcactttgggaggctgaggtgggtggatcacgaggtcaagagatcgagagcatcctggccaacccagtgaaaccccatctctactaaaaatacaaaaattagctgggcatggtggtgcacgcctgtagtcccacctacccaggaggctgaagcagcagaattgcttgaacccaggaggtggaggttgcagtgagccaagattgtgccattgcactccagcctggtgacagagcgagactccatctcaaaaaaaaaaaaaaaaaaaaaaaaaaaaggagggaaaggatgatgatggcagagttggtttataacaataattctgatgccaatattgagaatgggctgcagtggggaggcactgtccacaggccaggaaagggaaataattcaaatagtgaggataaggctcagcaattagaacttgttcattactaaattcccagggtccaacatagtggctacttgcagtgggtgctcaatgaatagttgctgaatgaataaatgaatggcaatgggaggagggagcagatctgagaaatctctaggcggcagaaacagcagggttggtgagtaccagatgtaggcgttaaaggagagggaggtttttttaaggatgactctggaaattaggcttgggaagatggtgttgccaaattctgcaatcaagtagaaaggaggaagaacagggttggcagggaacatgaggctctgggagtactactttctatgcatctgctgggtttagcctcttggagtgttgagaaaaagtgggcaagggaggacaaagaaccctcacatgggcactgagctgggtgttttcctttttactgtgtttaatccccacggactatgagtttgatattgttatccctgtttacaggtggggaaactggggctcaagatgacacattagcgaggtggcagagcccacattaaaaacacgtatctttctgccacaaagcctgagctttttccccccctccatccatcaaattgcctcctccattaaaatgaacatttggaatatgatatattccatatttagaaggctcgggggtgcagggtgagtactttgcaaaggaaccaaagcctaacttctgttaactttctgcttcatcgatactccaaatctgtcttcctcattcacagagtccctatgaggatccaaaaagatgtgagaaatcttttgaaaaatataaagcgttctataaaaacaaggtgatatcaaaaatgagaagaaaaatatgttcagattcttgttaaggaattctagaacactgtaaaagatgacagaagctggatactgtcttaggaccatttgactggcaacagcctctttccaactatggttcagggagcaggttgaggtttttctgtctttaggggtcagtcttcctaaaatatgaaaacccgggtttgaggtatggggaaagaatgaattttgccttccaaaggcagagtttacaacttgacggctttcactcctctttcaaaaataaacctaaattcctatcagttgtctgcagagttccatcagggacttggtagagtggcccctaactggggagcaggaattatatgtgcttcctccttgttctgcaaagcctctgaacaccaccgagggcccatggagagcgtgatgatgtgtctcttggcccatcacaacgtaagcatgctgagcagaggctctatcccacatcctcactgtagccacagtgtccagcaggaaggggctcactgtatgtaactacaagaactttcggtgtttgcattcttccctttgctctttaaatggctggcttcttcttcccactcagttttcagcttaggtgccacgctgggagaggcctcctgtgactgccctagttaaatagatcccccctgctactctctatcactgcactctgtcatttttcatgtggttcctttcagaatttataatcacacatttgcttgtttggttatctgtgcctccctctcaaaccagactgtaggcttgagggcacaaagcatgtcaactctattcagcccagcatctagcatggggctggcatgtggtaggcattcagggtctaactgttgttttaatgaacaaacagacctaaacctgagatggtgggacaaccgacaggaaagcagaaggccccctcagcactcgggggctgttgttccataatcaggcttcattatgatctgggaccagggatggagccgtggattggctcacatgtggactgggcccacccctctggactcatcagcaagacatgcaaaccacatgagtcaatggtccacacacagccccaaaggagaagaacacaagtatcactattcctcaactttggagtaggttccttggtctcctagttaaatatgcatggcacataaaaataattgtgcagacagaaggactcacagttgcttaatgtagaccaggaaagtgtttgaaccattcagtgggtggtgcgactcctaggggaaaccagccacgggtgggaatagaaactactccaggaaatggtactgtatggaacaatttacatattttggggcatgggaagttttggaaatgcatttgttctcctccatatctaccactgaaataaatccttgagatttaaaatgagtagatgatatttagtaatatgactgaaaaatcacataggactcatttatgagccaggctttatgcgcaatttacaacctgtatggaaagcaacaccatcccctgttttacaaagaaggaaacaagttcagggaggttatgcaagtctgttagattttaacacttgcactcccttcaccatggagccaaagcctagacttaattgtttagaatatcattctaaattgctttttgcaatgtcatttcttatgcatttcttacacaccttttaggtgccaggaacgtatttctaaaggcaggatagcattgcagaaatgctagcctccaagagatggggtgtattttccattgagaagcagaattaggggaagggtagttttacctcctcagtgtcaactgaaatggcagtcattcaacatttcactcatttcccatcagacaattttaatctgaataaagtttttaaaaatctcttggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcctagctactcgggaggctgaggcaggagaatggcgtgaacccgggaagcggagcttgcagtgagctgagattgcgccactgcagtccgcagtccgacctgggcgacagagcgagactccgtctcaaaaaaaaaaaaaaaaaaatctcttaagaaaccatctccttacaaattcccttcttgcaaaatacttatttttcagtaaatatcttcgttgacaattctaacaaaggtactcaaattctatatcctggctatgcctgtcaagagagttgaaggaggcagtggccatatttagagggccaaaacctgttcttctggtggtatattttgctgatctgctgatcttgaaggactccagtgccttaaatttacccacatgtcatttattgctgcctaatgtgcttattcattattttttgaaaatagaagcatattcggaaacatatttaattttacgatgttaaaaatgatcacttctggttcttcaccagaactatatggagtacctggaatacagtaggtactcagtaagtacactattaataaatgaagaaaatatacgcaggataaaataaactgtttttcataattctatccatatatgatttttaggattgtactggcttaaaagctgggactatacaaatacatcatcaatgtgaaaagctgggaaaatgggaatgcgaaaatcaaactggctcttggccagtgattttttttaaaaaaacaaggtcttcaaatgtttgtaaactgcaaaatgtccttgttgtccttctccctttttttttactactggcattgtcatacaaactttgtgtctcttccaaattagtctgttgtttgggatccttaactacggagagtgtcaactgtgcgtctccaagacaaacaggttgatgcgctgtctttctcagacctatgctttaaagcccaggctagggtcatgctctgagactagagcattctgactttctctggtctgctcttttctggtccttgattttcttatctgaatcatggggtgtccattgtttagacggaaggttgcaaatataaattaaataattcctcagcaaacaatatctttctgtgaggtgcatatatcagtggctaggaaaatatctgaggcctgctacatcatggtttagtgaataatttgcattttatgatgtatatacagtgtagctatgaataatctgccagaaattatagctatacatatataagccatacactcactaatggtaacccattctccttatttttgaacccattctcggtaccagtaatagagagctcactggctttgatttgaggcagacctaggtttgaatcctagctctaatatgtacaggttgaatctcagggaaagaattcatctttctcagctttagtttcttcatctgtgaaatggagataataccaacttcataggcctattgaaggcatttaatgtgttgattatatgcatgaagactgatttgttaacaaacagatgatttcatgtgtgtgtgcatgagttgggtgcagccttaataagtgttccccttctcttctgttttgctatttaatgtgatggtgaggagagtggtcagtgtttgtctgtctcttccttctagaagttagggtggcataagatgaggatatgggggacagcagcctcagggagatactgaataacctctgggagcctaggaggacagatgcttgacactagctggggacaaaaaaggaagagcccaaacagtttttaaagcagaatcttctgtgtctagaagaatcaataggaaggtgcatcatcaaaagaactagagaacacaaatgacagggtatgacatgagtgttcactttcattaagtaaacactgctggggtttacttaatacctggtgagagggaaaaaaagcagtattactccacaaacatttgttaaaatatcaactatgtgagcaagccatacaatggagaggcaatgattcctaagacataacccctgcacacaatgattcctgacataacccctgcacacagtgagttcttagtcacaggggaagcacacacagacacaagagggctgtgattaatcctatatgaaaggacaacatgccatggagcacagaggaggaagtagttacttctaagaagaccaaagacattttcaaagaggtgaggatattttaagcgaggtcttagaggacgctgttcacagggaagaggagatgtaaaagcattctaggccaatgcacctgcatgagaggagtgggatacggtgtgagcaatgcttggagaattgcagctatttggatactgctgggacataatgacctcggcagccaggaattgtggttacattgcagggggccttgaggctagagagagagaactgattgagcttgaggagggagagtgggaagggacccagagcacagatggagttattggctttggagataaaaagggacacatgtttctctgagtaggtgagtctgggtgttacttggataagtctagagaagaagagacagtacgttctaacagaacatgccttgttaccttcatgctctcggtgtagtgggaggcaatgtcactggttgaataaatatgaataaatgaatgaatgaataaatgaatgaaggtggctagggtagaggattaagaagcattaaaatgaatatttcaagaactatttatgggggtcagtaaatataatatttctaaactcaaaacttctaaactcaaggtatttataagctagttgaagatgtaaagacatcatacatcttttcaaagcacaggaagttaaatgaatggttcctaaaatatgaatgttcagagggaaaagtacgtttattaactgcttgacaaagaagtatgtagctatattttgtgtaacacactatggtgtagtcttatctttttgggtatgtttttctttcttaatgttaaaatatttcatagctggtccatgtaactatagttatacttttagttttactcaggttcccgataatgtttgtcgcacagacaggtttgtgtactggttttaataattccattgtactttctacctcctcctccgcccccatccccagggtcttcaggtcacagttgggacctactctatgtactctggtgctctccataagcaaatgggatgatttctctgaaaagacagctctagattatagtcctgaaaaagagagctcttgagtcaatgaaaaaatcatagtttagagtagaagagaaaggtaagtatgttcagaggaaaagctggtcagatgaatgtaagagaggcttcttttatttgttcatttaattttgagacagtgtcttgctctgtcagccaggcttcagcgaagtgctgagatcatggctcactgttgccttgacctcctgggctcagccattctcccacctctgcctcccgagtagctaggaccacaggcccatgctaccatgcctggctgtttgtattttttgtagagatggggtttcgtcatgttgcccaggctggtcttgaattcctgggctcaagtgatccgctcgcctcagcttcccaaagtgttgggactacaggagtgagccaccatgcccagtctcaagaggaaattcttttagcagagctttgagagataggtatggaagaacaggctggggttagagtatatgttgctaaggaatctgaccctcactccatgggcaataaggagccatggagcagggatagaacacttctctggcactactggaagctgtgatgtccaatgtatgctctctggaagatctaactaaacacaaccttagcacttctctcaattttctttgaaaaggcaaatcttgtgagtcatttgttctctgtaaaatgagagaggaacatacattatcaccttatattatcgatttacattaagaagacttccggattctcttagggttgttgtgtctttctaagatttcaggcaggtgggtaaatccttattttcatggattttctattggctaaaggaacgctgtgtgtagtttgttggaatatactttgtagaagacattcttgcccttgtgaaccagtttgattcccgaatcacacaagtgctgggttccagaagagattttggatataacgccaggatttctgaccctacagctaagaataggcagcaataggaactcaagttacaaaaaatgacttcaatagagcattcacatatgtgatggtatcagagcccaagtcttcaaagagaaatattttgaaacttctccctggtttctggcaagagcagcaaatcttgatttttcaggcctttataaaaataagaaaagactaacaattttaaacctgggcattaatcaaccatttaatgatgccaacaaatgagttttactgtaattcagtgcggggagattaaaggaaacctaagagccacaaataagccattatgaacagtttacagtgattgagtacataagctgtgattaataatgatcagaagtaaatctatgaataacaacaaacagaaaggacttgttagattgagaattttatcagaaaggtataatttggatgttgactcagtggtaacaacaggaaaaataaattacctttatgcattttagtttatgaaaatcaaatagataatatatgaaacaacatttaaatcgatacagcccaggagatataaaagtataggtttgtgtggtcttctaattaactgacatttacacatttttcttaagatcactgtaagcaaaatgggaaagctctctaaatttttggccttttgggagggaggcttttcagtcttgctcatatttgagtcaatacactgatgtcttgacttgcgaaaaaattttcacatccctgttttgggctctcatattttctttattacacaggaaaaaaactttattgcacagacaaacagaagttaaattgaattgattttataagctgcaataagtacagctcccagaaacaaatgcaaatggaatgaacagttcttaccatatgtttcacataggctactcacgttttctctcgttccgagatgatttcaaaaaacctgttctgttaatgtatgtatgaaattctgcaatcttaaagatttaaaaacctatatgttttcaaagacctgaatatcctgatacacatcctttcacacctggatgccaaacacatacactgaaatatattctatgaacaaaggaatttgaaagggaccacaaatttcgcattgcatgctgaagctgtcctgtgtcagctcttcaaactggggcctctgaattttaggaaaaagtgctattattctggttcagtaagtttgaccctttgttgtctatctctgctccttagagacacaagcaggccttgtgcttactaagtgaatattaatatcttcattaaaccttgatagacaagcacactacagccctcatccaaaatatgcacaaaattagaaggcaaaaataaaaaaagagccagacattataagcccgtcaatggaagcagagagccacaccattaatggtggattgaaaaagactctgtgttgttcacctcccacgtataaatgagaacacacggtgtttggttttctgttactgtgttagtttgctgaggatactggtttccagctccatccatggacacagggaggggaacaacacacactggggcctgtcaggggtcagggggagggagagcatcaggataaacagctaatgcatgttgggcttaataactaggtgacaggttgacaggtgcagcaaaccaacatggcacacgtttacctatgtaacaaatctgcaagtccggtacgggtatcctggaacttaaactaaaattaaaaaaaagaaaaagacttcctcagttttttctctaatggcctgaagcaaaaattactctcatttcctcttcattgatataatttgtttttgagaggtgaggggacaatgggaagagagtggttttaagtcactataaaaagattattgacagatgcgtggtaaaatgaaagactcaaaaattcctgaccctttctcccctccagagttaggtaggcgggaaggaccccaaacttccatacaagagtctcttaaggtaaaattaagacagcttccccttcggagtttatgctagtatttcataattttccagccaagagctggaaattatgaaatagttgcataaactctgttaatatagatggatcaggctccaatcttgattttgccatttctcatatcatttttctagggctgagggggcgcacttcttggagtccagtttctgatataaagagaaaagccatttagtgtcttggaaaaaaacaaaagaaggaaggaagggtgttgttgatttaatagatcacccttattgttctaatggctccagatggctctcctactgtgtggatgagatttgacagtgccttcttggggagaaacagaagacttcactagcttcgctcagcaaatgaccactgattgcctggaatggaggagttaatgtgatcaattaacaatgtttgaagaaaaatgatgtttgccagctgttgatttcatcagcaagaaaaagcccacaataatcatcttagaaaagaacttaattagttttgatcctaagatagcatgcaaaagttctggactaatttctagtctgaagatattcataacatattagagctggcatgaactctggtgattactagaaaaaaagatttttaagtttgtgaaaacagagatgtgctcaaggtcacccacagttaacagaaaaactggggctgaatcctggggcttctgagctctgatatgctgctttttcccaccacaaatcacagtttttgagattcacactttgaaaagaatgatccaaagtaacactgccattttggggtgagtgttctcttatgacagatgagtttttttttaccttcctgtttccatatgtttaaaatgctattagtatttcaaacctcattttctttctttttaaaaattcagccatgattttagagtgacagatttgccatatcaatttctaaaggtaagtgtttgggtcagtttgctttttctctaaattgtgtttgtcatccctcagtgtagtaagattttggtgtggttatgctgacattaaagtttccttttcttaaaataaaactaatgacttgaccttgatattgtataagagtacaggccctagggtcagtcatcctgggttcagaacccagcctaccacttctcagccatgtattgcgggagagttatttatggttccctacatttcagttctctcatctataaaatgggaacagtaataatcccattctcaaagggttgtttgtgtgagaattaaatgagctgatctatgcaaagtacttacacagtgactggaacatagtgaacactcaatgtagctaacagttattattattattactagaaaaaaattgaaaaataattttatgtaattgttacttacatgagtagcggggtctcagcttcccaacacaccatgagaatatgaaatttcatcaataaattcaaatagacactttatgtaaaaccctttgctcaaataatgtaacttagcaatgactgacttttagatactggggaaatgcattcatatgaaccagtgcgacattctgaaaactggttcattgaatcccaataatataggttcttactctcaagtaggaatcaataatgcacatcccctctgtacccacatgccccataaaaaagctgttcaggacaatcttgctttatatattatacacattcagggcacatttagagttctgaaatttgaggtgcaaagtaagcattttgatagggatatttttccaaagaatgtttttggccccagcataaaatgaaaaatctctaccacagacagttgcatttcatggtccaatatagtctctgcatgaaaaccaacagatcattctacatgtctcctgacacatttacaacaggcactctgtgtaaaacccattcgcatcactgggggttctcaccaattcttaggcccttgacttatttgtgactgggatacctttatcacaaagacatgctttacagatattttcacggacacaagctattccagtcttgtcctgcataattaagtttttacattcagtaagtagagttcacctcttcctcctaatggtaagtgtttattaaccataatgactaataaagaggttctggcctccgtcacctgagaagaacaaaacagtggggtttttctgcagctcggctggatcccagcttctatgacctctgctgctaacaggctctccacaggcaatgaatgggagacgccagctatgcaaattagagtactgatgttccttgtcagctgcaaagcccaaatggccctgaaggtgacccaagtgaggcttctgtgctgtgtgcctggttaggtggagaccctgattagtctgattatggcaacaaattttttaattgctttatggggtgcatgaaaattatatgtttatctccttttattgaataaagtgtgttggttgtatatgttcaatgttggtagggaggaaggtattcttatatataaagagaaaatctgttactctttatgtcagatcagttgatagatattaaacaaatcatgttgttttctcatattgagtatagatcactaatgaccagctggaacagaagtaaacttgtacattagccagtaatgaacaaaatgctaaagatataactagagaaattctagaggtaaggaaatagtccacatatattaatacattttttcccacagtcatcttggtagaaagttgaccgtgatgtcgatgatataactgggtcagacaaataccttttaatagtctgtattacttacacacgcatacgtggcaacagatttaccttagacataaacacgagtttatattcctggaggtgtcctagaagcatgctgactgttgtgtcctcagtattattcacttcaataaccgtaagagctggcgttctctccaagactctgttccttgaaggaaggaactatctactgttcccctagtaagacctggcctacaataggtgtctgtgatgctttttttttttttcatttttaaatgtccattttgtttattgatacataatatttgtgcatacttatggtacgtgtgatattttgatacatgtatagaatttgtaacaatcaagtttagaatatccatcacctcaaacatttatcatttctctgtgttgagaacatttcaagtcttctcctctagctattttgaaatatacaatatactgttgttaactacacagtagtcaccctactgggctaagggatggttaatgtgtctactcagctagatcacagtgcccagatatgtgatcaaacattattccagatgtttctgtgaggatgtttttggatgagactgctgttcacactggtagattttgagtgaagtagattactcttcctaatgtgggtgggcctcatccaatcaggtgaaggcctgagtagaacaaaggactgacctcccgcaagcaggagggaactctgccagcaggcagcctttgggatcaaactgcagattctggacttgccagcctccataactgcatgggccaattccttaaaacatacctttctatgtatgtatacttacatcctagtggttctgtttctctggagaaccctaatactgtgtccagtaaaaatctgttgtctgatgaaggaaagataattgcctgcctctttccatcccttcaacactcaccctgactctcagaacacacgctgtttggcctcatcctaatctccattccctcagtttctctgttacatccctgccatttatcccatttatgatatccctccttccttaggcaggataaacttgaagatactgttttcatcttcagcatactacctcctttgtctttcctctgctcgccttgtaaatcttcaacatctaatcaaatcatgtgccttctctaacctcactgttgttttctgctggagagaagccctgccaccagccagtacatattcataatggttgactgtatgtggctgggccctcagaccgctcagaacaccttttcatggtccttagtcagcccctactctctaccaccccaaatctttcttgctattcctctggtctcccatttctatcttcagactctcgatcttattgcctgacaaatgtttcaagcagaactcatcaccttccccacttcttgttcctcttgcttagtccctgttgtgataaattatgtccctcccctccccattcatctgcccaagctggaagaaaatttggcatcatccatgcctcttctttcatcttcaattccatcacccatccagttatttaacaagcgttagctgagtggctattatgttcctggcattattctagagcttgggatataagagtggacaaagtaaaacaaaaacactcctgccctcatggagcttatattctagcaggggagaaggatcatgaacataagaataattaaatttacagagtatattagaaagtgaataaacgagacagggaaaaatagagcatgaaaagggtgataagaatcgacgtgtgtgttggtggggaggtggagtgtgcagtgttaaacatggtggtcaggatatgcttcaatgagaagatggcactggagccaagacttgaggtgagggagggactcacacagatatctggggacaaatcactttgggtcaaggcaatagctggtatagagggcctgtcttaatccatttgggctgctataacaaaatgccattggctgggtagcttcaaaacaacaaaaatttatttctcacagttctggaggctgggaagtccaagatcaagatgctggcagattcggtatctggtgagggcatgcttcctaatagatggccgtcttctcactgtaacctcacgtgcaagtgttagaaaagttgggggagcctgagggtgtctctaggttgttgttgttcttgttaaggtactaagcccctcccaaaggccccacctcctaataccatcactttaggagttaggatttcaatatataaattctggggagacacaaacgttcatatctaaagcaaggccctaaagagggcctttttgagcgaagtaggccctaaagcaagagtgtccctggcatgttgctcgagcagtcacagcacttctgcgaatcttcagttacagcactcctgtgaatctccaactgtccatctcactgctactacctcaatctaggctctgggccttctcacctaaattaatatactgatttcctaagtggttttcttatatctggtcttgctgcatgcccacctacttcccacaccgagctagaatgacctttcaaaaacacagatgtcacctcatcagaattcttccatggctccccactgcccacaggctgacatgtgcacattgggagggcttagccctctcccacctggctccagcccactgctgcaatatcacaatatcacctcgcccatccttgacgcttatccagaggtctgtacataagattctctaaatgcaccaagttccctctggacccttcacctttgggacactgcttcctcctcataaaacacctatctcttttgctacccattgcaaccctcctcgtgctagaaagcatggcctggtcagctcagtctcatttccctttccctatacaacattgcttcctgcagaaagttcctcctgcccttcctctctctggcttaggtaccctccactatgcttccacaagagtgtggctatctctactgcagcaatttcatactgtatcttcacagtctctttattttttgggctcccctagtaggttttgaatatgggcaaggatcatgctttttaaatatcccagcacttggagccttacttgatacataaggagatactacataagttttggtcaaatgaataaacaaatacacaaataagccccatgtggaaaggtgaggattatatagatgcataaatagggaaaaactatatgcagaaactgtacatagcttcctctaaaaaggaatttcttatggaagcagaatctgtaaccatgaggcagccacccagaggagtagagtaatgatttgtgctgctccagtgactatgggttaggatgagtttccaggtcaactggattactctgatccctctttagagccattgcaagaaatcacatctcaaggaaagactcttctggcacctaatctcttttgtactttagtccagacagtgcgaggccatcttcaaataaaacaatctctttggcttcacagacaagaaaaatgtaatctatttcctacacgtgacaacaagagaaaatctaaaatggcacaaaaatgtaatggtaatatcctacagagaggaaagagctgaatcaaaatgaaatatgaccaaatgcaatcagcagctaacagcaggaaaaaggcagctgtcatcttcatttctttcataaacttcttagaacaaattatgtcttttagaatgtaagtcagtttgtcgggcgcagtggctcacgcctgtagtcccagcactttgggaggctgaggcgggcagatcacgagatcaggagatcaagaccatcctggcttcatcctggtgaaaccccgtctctactaaaaatacagaaaattagtggggtgtggtggcgggcacctgtagtcccagctacttgggaggctgaggcaggagaatggtgtggacccgggaggaggagcttgcagtgagccgagatcgcaccactacgctccagcctggcaacagagcaagactccatctcaaaaaaaaaaaaaaagaatataagtcagttttctttctggatactacttcgtaaagcttctgccgtttatgggaggtaaagcattctctgcatcacccaacttcgaagctggcctgcatttgcttagacatttcattcatgaaagcctgccctctcttagcagaggagcgatctaaacaccacagtcccaaacacctccatctgactgtctcctctgtttgtctatcaaaccactgattaaaacacattctgcattgattgattaataaacaggtttcagcagctctggacactcagagtctagaaggagaaaagtctagactcaaatagataaaaacccgtaattcaaggcagaacacaccctgggcccgagggggctggaggagaggtgccaagtgtgggctgcgcatggaacgggaacactggtgttaggtgtgggctgcttggaacgtcccaggagtagcttgcctcatgttgcagactaggaatccagctgtctggaggtggaagaatccatggatggtgcatattgcagagacacggtttcaaaatcttttgcaggatgcacatgttagaaaagagatcttaaaaaataaaaaatcctctaatggctttaaatgagcatgaagcattcagatgttaatgtttagctgtgtagacaaggtgtttcccaagttatctcaaaggttgatgacatgacgaattgccccctttaaagaaaataccaaatacacgaacaacaaacttccccgaatgtgttgactatcttttggaatgaagagaaaatctgggtcgagttgaaatcaccaaaagtcaatccacaaagtggaatgacattgctaacacacttagcatgagacctgaccccatctgattattgctcagcaaatgggggctgtcctgattgattactatttgtccagtctctcaccagctgagctctttcctctgttcctaaaataaagggtagggtgggggactttgtgccagataactaatctttactcagtaccttttctgtttcaggcattctgttagcagcttgatgtactgttctcatctatctcctcaagagtcctttgagagatatattttataactgttttgtagaaaaaaaccacgaaggatctggagatgttaggtgtatccaagggcacaagatgattgggaaggagtgaagatatggatgccagagcctgaaaacactccatgtgtcccatggtagcttgttctttggccaagtagcccttgcacacccccgccttgtcttgagacatgtcaccaaagacactcaaaccataagctccatgaggaaggaattttttattttcaccattaattataccccagttccttccacagtgcttgatgcatgcttggtattcaatacatatttattaagaagtgaatagacccaaggcctgggatgaagtttctgtctccaccaccactttccacccattcaagagtgagctgctcccctacgaggactgggcacgagtcaaaacactcctgggaaggatgaagtcttttggggagttcaagaactcctgagtccggacaagacttgtgccaacctgggtgacaaaggaactgtgagaccctggatggagttacaacccgaagatatgcctgaggcctgtcattcagcacttaattcctttttctggtgaaaattaaagtaactaaaatcctggaaccctagaggcttccagaattgtaacaactgtcttcagtagccatcaatctaattacatttttgcaatattctcattttgagctacaaaggtacaaattacacaaaattgtgtgtggaatgcatacatatgtatgtgtgtgtatgtgtgtatatatatgtatatatataaacgttaacatttagatgttaatgtttagccatgtagacaaggtatttcccaaattatctcaaaggttaatgacataattgtcccctttaaaaaaatactgaaaacatgaaaaacaaacttccctgaatgtgagcctcactttgttctgtacaatggagataataaaaccttctgtttcacatgaagagtacatgatggaatatggcaaaatgtcctgaaaaccagaaagtagtcttgtcaatagccaagatctgcctgactttttcacttggggtgcagtagttaagagggaatgtgctggagcccagctctggcatggccactagcaggtttgggagagcctgtgcttcagttgctttacctgtaacagggagatggaaatgtacccagctcctggaattgtttgaaagattcaatgtgaattcaatgatataacacatctaaagcacttagaagagcccagcacatgaacaatgcttaaacaaatgtttgctgtgattattactgtgctttcgggatcactgtgcaaatgacgattctggtcagctatgcattcccagagcagtggaagggttcactagcagctatcttcagtaatacactgcagtgaggggtagtcagatccaggcccacaatccaataaaggtggttggtcccagaagttattttgccagataggcagaaatcaaattgaagagaagagctttggggagcatgtgttctttacttccttttcctccctccctcacccttttcttttctttgctatttaaataaaccaccactttcaggcctgcctgggagaagatattagggcagcagggagtccagctgggagatgatgaggaaagcagctgagcccctgctattccacctcatccactccatcctccccaattaactggtaacgaggtggtgacgccctaaccacatttcacttcctgctaacaaagcttgtacaacaaatgcaaacacttggctgtcagcttctgtccagcacacagcctcgttatccatctcacccttctgcatctatgtcagcatccaggaggcaggcccaggacgacaaaccttctttgtgctacactcaatgccgtaccaggctctgatggtgcttacaaaatgcctttgcccgacagtaacaagaaaggtcccttatagatgattttgtaagaggagacatattctgtgcaggcttgtgtcattcctctgattattcagactgggagtaggggcagggaaggtgccaccatttcatttcttcctttctcatctgataaaaatttcttcccacctctttgaattgaggtcaggtctttttcccttttctaaatttgcctcaaagaagtctttttcatttttccttaagaatgactttaatggtctacattttaacctcttcctcatgtaatgtaagtgatctgcaaactttcttatatcttattccttttgaatttcaaattcctttttttctaaatcaatcccattatggcaagacattattactttctgctcacataaatactatcatccataattttctctcttccctcataaagcatgatttatgttgatatttaaaagtaaattctgatatttagtctaagtactgtcttacatattaattcaataacataatttctacgatagaaaagtacataagagtacaaaatatgaaataagcttgatatagacatagttatctgcatttgaccagtgaggaaacaaaagctcagaaaaattagataccttgcacaaatcacaaagaaatcagtggttcagctgaaaattagaaccaacatcttctgatgattacacaacttttctggttgactaccaaagaagatactagaaaaattactaatgagtgaaaataaaaagacatttcaaagtctttcatatttaacacaaaattatttttccatagaagatattcaagaagcagttacacatttgaggagctgtttttttttaattaaaaaaaccatattctttatctacatctagataatgtagattgatgatccatctaaatcaagaatttatcttctacagtgggaacaaattactggaatttaagcaacgtgaaatctcatcactttagcaatgacaatgaatgtgatgtagctttcaatgcagtactgaaaaagcttgtacactgtcacatgtcccaggcccttaggaacaaagtttagtatgcaatgagtgacgagctctataatattttcattcgaaacagagctacacaggaaatctaggatgtttataataatatttggaatatttggtataaatgtaaaacattgtaatagttttctgggcagataagagctcatcatatatccttttagttaagtcaagtgactctggagtccagttataccattagttcaaacactaccaaagactaaatacaagctcttacaggctgaattgcatctccccaaattcatatgttgaagccctaattcccaatacctatgaatgagactgtagttgaagacagggctttaaaagagctaattaatggctgggcatggtagctcacgcttgtaagcccagcactttgggaggccgaggagggcagattgcttgaggtcaggagtttgagaccagcctgggcaatacagtgaaaccctgtctctactaaaaatacaaaaattagctgggcatggtggcgtgtgcctgtaatctcagctactcgggacgctaaggcaggagaatcacttgagtccacgagttggaggttgcagtgagctgagattgtgccgctgcactccagtctgggtaacagagctagaacctatctcaaaaaaataaaaaagagagctaattaagttaacatgggggcattagggtaagccctaatcccataaaactggtgtcctattgagattaaaacacagacattacagagggttgaccttgtgagggtaaagtgaaaagggggccatcgccaagctaaggagagaggtctcagaagagacaaccgtgctgataccttgatcagctgacaccttgctgataccttgatcagggttctggaggcaggacttccagcctccagaactgtgagacaataaattacttctgttttagtcactgtggtactttgttatggaagccctagcaaaactaatgcacttaacaaacttaacacctactttcttcctccagcctctgtgcctgtgtttcatgccaacttttagtttctccttgatctgccagtaatacaaagatgagaaggtctggaaggaggatttaggataagctgagaggatccatcttgtaagactatactttcctatgaaatgctgtttcctccttgttgcctggaaaactcatcctcaatcttctagacctacagttgggttattcttcttcagaaccttaatctcttcaaggtggtgcctctgctacaccctataaacccacctctggcacagcacatatcacaccatgttagaattgcttccattggcaactccttcctgatcttgtgaatgatttgtgctgctccagtcactattaggatgagtttccaggtcaacctcctgttttgaaaggagggacttacctttgtggtcatgtatttgacacctaagacttactcgttaagtgtttgttgaatgaatgaatgaaataaaatgatctccattcctattcaaataagcctgtaaataacagtttaagcatggtcatatttgtttgttgagaaagagaagtattaagtgatataaggtttaaaaaagcaataaaatctgcaaaaagaaaagtgtctattgatgaatttattaacaggaaagaaagtaatcgaggataagaagatggaaaaggtggaagaagagaccttgacaacctgaaaaggttatacccttgtgcagatgtggtggacaaatcctcacctgagaggaggaatcaaaggggcaactgctctgaaaccggccctagagcatccaacctaaaaacaatgccttcatcatgaagttccagaaccaatgattcaaaggataccccactgaaaaaagacagtcgtcgtcctagaggtaaaaatcactttacttgccaataaacagaaacatgagcaaatgggaaataagcaaaaatgaaatgatgtgtgtgctctcttccaaagggcagcaaaagcagctgagttaatgctaatggctcacatatggtgggtggggggaaaggatgttataagtcacaaaaccctggaatggagcagaggcctgtcggcaagttaggtggtgatgatggagtcaggatgacttggaaacactgtgaaaagatggcttcagataatgggccattatctgtctgcctcttttcactttgactactgtcctctataaataatgtagctggctaatctaaaacatacagaatcaataggaagccaaatatttaggtaccacaaaatgaggcaaaaaaagagcccagattttcaaacaatgcaagtgaccctgaaaattgtaacttggcaagtctgcaatattgtgagagcaataacaatctgttaacatctagagggaataaacccaaaagaaataagaagccgagctttatgaagggaaaaaaaaaatggcacgccaaatttgattgcttttctgatggaattacaggattactagtttaagggagtggagcagatgtgatatatttgaattttattagggcatttgggagaacgtctcacacaatttccttcacaaaactaagtgactttagcttgaacatgaactgaggagataataaatgaagggtaataatacgttacagtcaatctcatcgggaggaaggtgtttaagaggtgacactaaggctcctgttgtttggggtggatagaacattgattttaatgatctgtaaaaaaggaagaataagagtgacagagaggaaacatggagatttattggacaaaaagactaggaacctggttaaaaatacctgaatatagggaaaatgcaagctaacaaatatatctgtatgtttagaaaagtaaatatatttggaaaaatatttgcagaaatgcacacatgaaaggagaaaaatgagaaattaataacactgaaaagtacacaggagaagctccttgtaataaacttgaactgcaatacagatataaaataagagatcttaataacttatactgtcataacaatgacacacatagcttgccccaaagtaaattttaggttcaaaaagctaattttactcctctttgaattgtatcattataaattttaaccttcaagtttagcaataaaatgacttaaacagtttaaacaaaagtgtaacttcctataatgacagcagcatccatcgaaatactgtaccatctgtggactagaaactacccttcttcatcctagactttgccctcttattcatctccactgaatcacaaatcttagacaattctgcctccttgcctctctttgggacctatccttgctccttgttccatagatgctaatttggttccagccctcattctttcttaccagcattattaccagagcccagtattgcagtatcacatctgctctctgtgctgtcagaacaatctttctggaaagctgaccatgtaaattctccctgtttaaaaacctccagtggctccccatgccctataagacaggcctaggcatagtgttcaagcccttgaggatctggtcccttctgatctctttagctccttctctttccaactctctcctccctttccacactctggcctgaagcccttccagttctcggcagctctgttgtctgtttgcctgtctacccctccttgcttcctccttcaggatgccatgcagatgccatattttgaaggaagccttcctggtttctttctttccactcttgtttctttagtttgtttatcatgcaattttttctactctatctataaatggtgggaggcaggggctgttttaatcctctatgttgctagcctgggacacacagtaggcccgtatgtacatgctgaataaatggacccaaaccaccaatataatcagggactgtgtctactggtaaggcaggcctgggtttgtgataaaaagtgcattggttttgtgggcagcatagtggaggcagaaataacctctaaaaggactacagtgatgacacaactgacacactgctgtaacaagccagggggtaactggggtgtgcacctgttggccggtggctcttgaattcagtcttcctcattcatctggcctacaaaataccatagtttagatcagaccctgcaggaaccataacaaaaactgaaggacaggctggtctttaagtacaacttagcagagcatgacaaatgcagattgaaccaaagtgacccttcccacctacaaatatagtcatactacacctctgcttaaagtcccttcaatggcttcccattgctaggaggctgatgtctaacagcctcatgtctctcctcttcctcacactcactcatattacattaccactggttgccacaggcaccacatgtgggatgctcccatgccttcatccgtgctgtttcctgtaactgctggaagtgccctttaccctcaaccctttctcaggtttcctggtgaattcctgatcatccttgaagtcatctcaagtatgaccttctctgagaagtctcccacaacctttctaggtagagctgagcatgcctactcagtgtcgccaatgcaccttgtaatctatcaattaatgtaattgaacagattacaaagtgcattggtgtctgttacatgcttgctcctgtcccacgttatgggccttacacgtctttgtattctgggattctagcaccatacctggcccagatcaaggactcaaattatgtgttgaattgaatttgttgaattcacatgaaagacaatacttatccaaagcctgaatggctaaagtggttatctttgggtttcttttgacaataggaagcatcatcagaatggactaaaatgatcaagaatgtgcagaaggacctccataatcagtaactatagagataccaaactttttagttacataaattgaagacaagagcaattacagaagattatatttaatggccttcaggtacaggtagaaatcacatgatattttagactgctttctttaaaaatgcatcaaagcactgtgaaaagccaaaaacatccttttggaagcagcattttataccaggtatttaaatctattttcactgtgagtttattcagagtaattgtataataaagaaaagcacttggcttcaggtcactatgcatatatagctaaattatgcaattagatgacatgtaattaaccagagtagcaacacagccaatctaatggggccagttggggtctgagtgactcataaaaacattatgtagttaagcgataggcacctacaagaacaatgaattttggtctacctgcagcctaatgagtccctcctgtgactaaagaggtaatgcaaagagaggtctcagagacagggcagtgtcaatggaaattctgtctaagaaggagccaaggtatcatcttgattcttattttccaaaacttctaatgagataagaaatctctccaaacgtactgctgccaacattaccagcttgactcttccattaccacaaataataaacaaaaaacattagttaaagcttattttgaatgaacttgaagaaatacttcctgacccattactcaggtagtatatacaacagattgactattcagtaagtgaaaactaacggcggaagaaatccaaattagctttcttccttttccttcaaggatgtatacatggcaagcatgcatgaattaacacagttatgaacaagaaatattatctcttgtgtaaagatcaaggtttactgtctcattgtgtttggttttgggaacgtagttttgattttgtttgcttaagagatggaagaattccagttctgaaagaattcaagctatgaacaggaaagtatacttcaataattgtcccagtgacccttatttttattaagaagaatctagcaactgtcatacttgctaatgtggcaataattcttctaatcttaaatttttaagtaaggaaaaaatgaatatgtagccatttaatcacaaactcatcctctatttcccaacaccacttattccatatatatatttactgaatataaatatactaggcctcagtggaaacacgaaggatgtgcaagactcagtacctgcctttaaatagcttacaatctactagaggaatgaaatctgtcgcccactcttttattttcttcttcgaaatggtttgagtatatacagtatactctaaaggtttaattaaaatggaatatataaaaatctgaaaggatacatactaaaatgtaatctgaaagaggggtagcaaattattctttttgctctctacattttctaattttttttttccctaatgaggacgtactacttgtgtaaaaaggagaagaaagttattttatgaaagatgaaaaaaaaaaaaacacctcactctggttagcctgatattttgtccttttgaacacttaaaaggccccattaccaggcagaggttgcaatgagctgagatggttccactgcactccagcctgggtgacagaatgagaccctgtctcaaaacaaacaaacaaacaaacaaacaaacaaaatgccccattgcctaaactctgaaaaagtcaatacggggttgttgacaaaatctattattactgcccatctggtgatctgctgctcccctaccagtgaggaagcttcttgaggtcggggactctgtcttgtttgctattttgtttgttcaattcctaacagggatcagaggacaccatagataggtaataaacgtgtggggaagatgggaggacaggagagcaggaagagagcagggaaagctgaaggtacacacacttctgaggcttttgttaaaattaagtatttaatgcgatcactttggggaaaccacattgattaaactgacgggaggcatgaaaatgacataattgatacaaccgataattttattcttcaacaaaatctactattggccagagtgcccctttgagagataatggttcatatcagggagcaatttgctttcaccccttgcatacaaagcgggtttcaaaacctatgtagtttcggaacaaaagaaaaactgtaatgtcttaatttttaagcttttttcaatgcagagactctaacaaagcagatctaatgaacagggcatcatattgcatactgtctgtgtgattggcgccttctggagttgtgcagaagacaacctgtgaggccatatttagccactctgggcttgcttcaggctttaagttcttgttgttaaacttaatttttcagatccatgtggtttggaagcattgtgcttatgcctaactttggtgatgtattgacctttgtggaccaaggatgaaagctggcatgaaataagtacaggaaacttcataaaataacagccagcattaattgagcacctacaaactgtcagagggctatccatctatgtgtctatctaatatttagtcttcagaataactgtgcaaggtagatatcatcaccattttacagatgagcaaaataagtcttagaaaggtttagtttagtaattttcccaaaagcacacacagctaataagtcatagagtgaggatgtaattttaggtctgatcagcaacctcaatatgtcattcatcctcgcctttcctctgaagaaaagcagcagcttgtcttatgtattttaataacactggcatgttataaaaagttaacctttttgttttgcagttcctcatttttctttatgtatttctcttgcttcttgttttttttcccctctcctccaatatcaattcctattcctcttacgtttttgtggcatttgagaaaccttcgttgaaaattctttgacagtgtctgcaagtcttctgagacaaagtgccacaaagataatgtttaaataaaataccacatagtacagataattatatttaggctttcagtcaccctgaatattggacaaataaattctcttggaatcttcatattgatgtacataggacacacacacatgcacacatatgattagaataattttttccaaccagaaatgacatttgcttttgaaatgattaaatattaccctcaccatcagccaagatttccatgacacttgaataaacaaaaaaggagttgattactgagattctttgtttttcctcttcctttgcacagtaggaaaagtaatgattaaaaaaagtataaaacacatattaatgatacaaaacagaactatctccaatgctttgaagaatgtattcttcatatccactagggtgctaaccttcggaaagctacaaaatcaatcctgaaagttttatctcccatggcgacagagcccttttttaagtcagtaaatactaaaagtgatacaataacagctcatatttaggattaccaagtttctctacaggagacaggctcaggtatcaagaggaaaacaaatattcattaaaataatttagcaacaacaaaagacacgtgatgatgaaagtctgttcaaataacaagtgactaaaataagagtgctgataaaaaggaaggtagcactgatatggaactgggttttggtaacaatatgccaatcaggaataaaaatataaatcaaacttaactggaatgcataagtatacccagctttacaagatgggtaggtttctggccgggcacggtggctcatgcctgtaatcccagcactttgggaggccgaggcgggtggatcacaaggtcaggagatcgagaccatcctggctaacatggtgaaaccccatctctactaaaaatacaaaaaaagttagctgggcgtggtggcgggcgcctgtagtcccagctactcaggagactgaggcaggagaatggcgtgaacccggaaggcggagcttgcagtgagccgagatcgcgccactgcactccagcctgggcgacacagcgagactccgtctcaaaaaaataaaaataaataaaaataaaaaataaaacaacaacaacaacaacaacaagatgggtaggttcctaaaaagctttgtataaatacagttgctccccaacccccataattactggaaggagagagagaaagaccctaatgaaatcttgcagtaaattctaaattacaaaccgaaaaaaaattttgaatggcaaacagacactgctttaattccctgcttggaaagttttttttaaaaaaaattttttaatgaatgatgatttgaatagcagtatattttttaaaaattaggcaaacacgtatatcactgcaaataatatggaaaatagtatggaaagtggagaaaacccccaaagagctaatttccattttatatttggtatttaaatgccacattgataactgaacactgtagtataaataaattattgttaaactgtcttataaattgctcagtccttcagtccatagtcaataaaatataggccttgcctgtggtttactcaagactatagaaattcagagtaatcaatcattccaggtggcttttatagctttccaggtagcaagagctatattttattgaatgaggcatttaattagtgggtattattaaagtgcaattttccatattaaactgttttctatataaattggcttcctggtatgctgacttgtaatgacaggattatcttgcattcactcttgtagagacaggtaataactcatctttgtgcctgttttttgattccacagaatgttattctttctgctgtcatcaaaaaatagtttctgaacaaatattatccaagatttttcttatgctattgtcctataaactcaatattttaagactaacctgaatgctaatattatatattgtgatatttcttatgttataaaggaaattgtaccataatttctaattgtagactaatcgcagccattctaccacaaaaatgccatattcaacactttttcctattacagtataaaacaccatttgaccttttattttaaaaagactgtgacaaataaatactaatttaatgcataaagtctaataatgatctagatttaccagtgtaagtgacaggaggtaaattaatatggaataagtatatacttcacatgtttcttggcatatatgaagaagcactgaagcaaatgaatctatctcatgtaaggcaaatattatggaaaaactccagaatcagtagaaagagatatttttgccttttcttactatggaaattcactgttataatacttaaagctgcagatcttttctttaataataacttctgtttaaaaatctgtaacaagagataccattgctgattacataacattggtgacatactactgtgattttttcagttctgtaccaaaagacaagaaaaaaacaaaaaacaaacaaaacgataaattctgccaatgtttttaaacaagaatgtcttctacaccaagtgctactttcagatacagggctacagtgcttgaacaatcaccgtattagaaacaataagtgatacaaagagtaaaaacaattttcaaaaaaatcaaacttttataacatttacatagacaccaaagaggacaaaatatccatttccagaagatgtgcagtataattagtcagaaaggtatcgcaatgcttttgattatgatcagccagttgcaaagattatcaaataaacaatctagctattgctgctttgctagaaaaatgatcatcttagtggcaaagattaataactgctttttaaaaagacaaaaactagctttgtgatttactgtgtactttctcaagaatgcacagtaagtaaatcaacagtttgtttaatcactatcaatgtggcatgctttaatatattggatataaataattgtcactaaaaaatcatctgctgcatgttcagataaagctgtagagatctctgccttgttacctagcaactgggcaagtaactgccatactgcaaaaaaaaaaaaaaattccttattatttaggtaaagagaatgatcataaaactccacattaagatgttaatgaagccaaaatgtatattaagatacaacagctaacgattttagatgcatttatggccttggttttgaaataccatgcagtaatgaaaactgtaaagatttaaatctattatttcagcttgtcacaaacaacaacgttctttagagtgtatttttaaaagaccactgttattattaattttttatttgtactctttcacagacaaaggaatttcaaccagatcttctgtactgagtctatttattgaaagggtgatgcttacttgtttaaatacaataaaactgttctgagtaattagttcactgcaagggatcccaaattatttcttatatttcatataacagcttaatgtattaattttataacatctggaggaatctggcttaagttctgtttcaattttgctaaaaatctggattccaagattgtgcataaaatctctcttaaaaagcaataggggattagggcaattataaaatttcacttctgaggtccaaaattcagcatatggccagtcttcaggcctcaatctgaaagtaattctttctggtgtgtgatgaaggctgactggtcagagcccatatgacgatggtcacatgagagtaaggaaaccactcatcattgcaacaaacagagactgttttgtgaacagacagagctgtgcttgatgaaggcttcacaggaatccaaaccccatagcttacatggcattcctctgttgatttaatgtacgatgcttttattcatagtcacttacaatgcagggacacaattcaagaaagctcttcaaattattgcatggaattaagtttcttgataaaactttacaatttaagataaattatgctgaaaagttaaagggaaggttggctttacaaattaggagccgaaagcccagagagattgagtagttggaagttgtgcaacgatataacttcttataaaagtaaatatatataaagtgcatagaacagtgcttgccacaccagaaggattatatgtgtttgatattgttattttttattagtgtaattattattagaagtattggatctagaatctgttttttcgtttccagaacaatgttcttttcactaagcacattacctcaaaataaagcactgttttaagatgcaccatgtacatcttctatgagccaaagctgtattttaatgataaaggtgtgtattaaatgaagatgtatacgtagattcacattaaaagcagaaaaaattgagtcttcataactagtaatttatagttatttgtttaaaatcaaatctgtatcaccttcaaatatatatcatttacaggctaatagctaaacgcaagtcaaaatggtatcccaaaggaaacactttactagtgttagtgtatagaccaagatgtataaactttcccatctttaaatattttctctgagttacattttcactaattcatatcaaccattaacctgttatttttatttttataacattaactttacatacatataacctgatacgtttgtactgaaagatttcagacatttgttggattaagaaaagtttactctgagcctaaagagttcatacatatgtacttcttgatcttgattagtatatattcatcatatgcttctctgtatttacattctctctccctagctggtctcatctaggcacgtggctttagaaactatctatttgggggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagctgagattgcgccactgcagtccgcagtccgacctgggcgacagagcgagactccgtctcaaaaaaaaaaaaaaaaaaaagaaactatctatttggggagtctctcagatgtgtatctagcatcctgatctttcccctgagttccagactagtagacccaatgatctgcttgacaattccatgtggatgtcaagtttctcaaacttaaaataccacaaaaaaactcttgcttccttctttcactagtagcctaatctgttcatcatccactcagttgcacaggccccaaatttagaagtcattcataactcctccctttttctcatctttcacattaattcattagcaagatctctaggttccatctctaaaatatacattccagaatctgatttaagatggaaaatttaaactgcttcacagaacttcccttcctcaatatctaaccaaaggagaaaaaaagagtaaacattagtaaaatgaaaaaaagaagttccaacagtaaccactcaaggaaaggaacattaacaactataataaacttcaaaactggcagccaaggaaagagaagattctggaacaggctaaagagacacagtgttccttggttcttaaccctgtgttcaaccctagagaggtaaacaaaattctgagactttttgctaataattctaaatttagagaaaaacacattcagtgaacatccttatgtttccttttactactaaggagtaataggaacatgtgcaatgaaagaagaagatcaaagggctgattcaacagaagtgaacactccagggctgcccactattttggggaaacccatcaagccccagattatctcgaggatagctactagctcttatggaaccctttagttaattataaaaaggctatccttggtatctctccctccaccaccccccttgcccgccccgtcaatttggtgaaataaaggctgataatggagacatttaacacaagttaaggaagcacggcccaggaaatctaacaaagattgcatacagcttgagttgagctgagctgtctacctccctctgcaatttctttaggttgcagaaaagtggatagatccaagcaataaaacatagctcaaagaggaagcaaactggtctccaagaaggtgggaagaaatttaagaagttactcacactatgtctggggaaagctgcccaggcaccagcaagatgaaaagaaatagcacggcagatatgcaagcattctaagggagggaggcaggaggagggaaaagagaggaaggaaagagggagggagggagagagagagagcaacaaagtgaagaaaaaatataaaatgaaagtatcacagcatataggaactaaatctagaattttattcaaataaacagaaagaaatcctcacacaaacttcctactgtagaataacgagttcaatgaaaattgaagtttaaagacagaataatgaagaaatctgaatgagatgaaaaaggatattgtggacctaaggaagcaaattaaggactaaagatcataattttagaatcaataaacaaatcagaacatcagaagcagagtagacacttctgatagttgaattactgacacagaagaaaggacccaggtaccatgaatggagacacttctgatagttgaattactgacacagaagaaaggactcatgtaccatgaatggagatgaaaatgacaacagattttcatcaaatgataaactaatagatatggaagagatgaaagatgatccaaaataaggataagtgatgttcctgaagtaggtaacaatgtaagtagaataaaaggtgttttcaaagatatgatacagtatctgatctaaataacacatcatattgtggaaaattcttaagcagaccatccaacacctccacatatcttagctatgttattaagctatgtggataaagaaagaattccttgggataaaggcagaaaaaaaatcacctacaaagggtggcctcagactatacagagatattcaatgctattaaacaatgaagtaatagctgcaaaattataatggaaagaatacatgacataagaatacaacgttcggccatgatatattgttcgactacaaaagcaataggaagacgttctccaaaaaacaaaacaaaataaaacaaaacaaaaaactcacaaatgcagaatccatgggtctttctcgaaaaaaagaaacaaaaagcagttggcaatgaaatctaggcaattcagtgatgaatcaaagaactcagtcagaatgaagaagatatactaaagggctgggaggcaatggatccatttgaacataggaatttatactaaataaccatagtaattatgattacagaatagaaagtaaatattataaacacaggcaatataaattagttaaaattgttagctgaggagaggatgggcaaaagcattacctttcaaagcaaggaaccaatctgatgtgtttaaaactggaatatgcagcttaaaaatgtgattccaactctgaggtggatttactgttaacgctaaggaagcttaagttccaaggttttttatctacacaggtgatttgcgttttcccatgccctggaaggggtcacagcagtgcattcatattgtcatatttttgtaaaatttgtaaaaatactccattttcttaaagagggcccccaaattatataaccttcccacagaaatcttgatccactcctgatcaaacctcttaacatttttcatcgtattttttcttaaccataagggaaaataataactcccataataaggagacacttattggaagttcaacaattatttagtttttctttattttttttctgctgttaaatacaataaaaccattttttttttgagacagtctcactctgtctcccaggctggagtgtagtggtgcgatcttggctcactgcaacctctgtctcctgggttcatgagattctcatgcctcagcctcctgagtagttgggattacaggtgtgtgccaccacactcagctaatttttaaaaaatatttttagtagagacaggatttggccgtgttggccagactggtcttgaacttctggcctcaagctctccaccggcctcagcctcccaaagtgctaggattacgggcatgatccaccaataaaataaattttaataatttttatttaaaaatagcatcagcattatgactccacagttataaagtctttctttctatccgcacagtcatgtatcaatccctttgcacatatttatagaaagatgccttaaatgatataagtctactgctaaaggtggttatttctgggcagtggtatttggggtaattaaaaaatttaatctttgtattacatgcattgtctgaattatttattgtgatcatataacaaatatttcaaaaataatacaatgacttttttccttcaaatgccaagatagtaacagatattattttggatggtgagaactatagggaactgttattttgtactttgtattttcctgtgtttttaaaatttcaaaaatgttttccaaaatttgatattctgaatcattccacatctctccctttttcttcttccagccaagtcactattatttctcacctggactactctcatagtcttctgtgtggtcccacctgtgtccatcctagccctggtattacccagtctttacacagcagccagggtgtgctcctcaaatgtaaaaggatcacacctctgctttacattccccagctgcttcatattgtctttagaataaaacccaaactctttgccacgaccagcaaggctgacctgagctgaccgggattcagtcacgctggactgctctctgtcccccacacactgcacttgttccccctgacagatattccatgagctgttcccctagcctggggtgttctttctccagcatctccgtatagctggttccttctattcaggtctctgttggagggccaccttctcagggatacccccaaattttctaatttctccctccatctccctctccagtgcttcaccctgctggatggccttcatggcctttatcaccatctgaaatgatcttctccatttatttatttacttcctttgtatcaatcctctcccactaaatatctgctctagaaaactaggaccttgtctatcttgttcatcattatatctcctgctcaaagaatgtgcccagaagatagcagacacttaataaatatttctccactcaatggatacacacagagattgtttctcagcttaaaaaggcttgtgtttgcaaagctgtcttttaagtcagttgtttagaattcagaatgcatgttctttaaaatgagtcacagtacaaattcaatatcaagcctagctcacaaagtctactggacccataatgagttaaacttctgtatatctgcaacaaaaatgctagaaaatcaacatgatgaattatcactgggaaaataggaaattaaaaagaaacatttcaactgatctaaatatgaacaaactatgactattatttctctctcatattggtgaagacttttgtgaatattctgaagggaacgtcagaaccttttttattttttttttttttgagacagtgtttcactcctgttgcccaggctggagtacaatggcactatctcggctcactgcaacctccacctcccgggctcaagcgattctcctgcctcagcctcctgagtagctgagattacaggcacccgccaccacatccggttaatctttgtattttttgtacagactggtttcaccatgttgccaagactggtttcaaactccggggctcaagtgatccacctgcctcagcatctaaagtgctgggattataggcgtgagccaccacacttggcttcagggcatttttaagagctgcagaagtttctggttttttattgtgtataacttcatccaaaaatgtgtagcttttggctcctttgataacagaccattaaattagaataatgtttgtaactatgagttttattatctgtttttggttttagttaaagcttgggaatgacttgcacgtagttgtaactgcaacaggtggtatgttttgtgaatgcttacctgtcattacttgagtcactgtttgtgtcaaaaatgtaaaagaggaacgagtttctgggaggtattaggaagagaggggctcagaaggaaaggaattaaagaggacgtgtgattggaaagatatctgagataagagcagcgaacgagaggaaagaagaaattagtgatgaatgatcagaagaagacagggaagacgacttcctcctgctagctactaggaaatgttatcttccaagacagcttggttcctgtctagagtagctctgggtgggtaaatggagggagggccagtttgtaaataacgctgaaatttaagagactatatattatctaatttgaggctttgtcccaaatttggtttggagtgagtttttatgactaatctaccagtagggtgaaataaatagcatcattcatatcaggagtaccaaccaaccccataagagatattgaagagacaatgccaaccttccattctggagtaaagctatagtgcaagaaaacaatttgaaccaattattttcatactaagttgacagttaagacagaaaaaaatatatatattaagagccaagagatactgcatatggtctgcaagtcttttctggagaaatgaatcatgaagataaagagaactggcttatttttacagttacattttatatttctagaaaaataactacaacatggtcttgatgtctaaacatagggaaatgagacttttatgaacgttacacaacacaaaacataccacttgttgcagttacaactacgtgcaagtcattctcaagccttaactaaaaccaaaaacagataataaaacatatagttacaaacattattctaattgaactatactttgaaaatgactgaatgctcaaatattcttaaaatacaatgttctcttgccaagaaaagagtgttggtcttaaaatggccacaaaacctagccccgtcccatgttactagagctacagaatcaagcaccctccaaatatatggccaagcagccttggaggcacctaatgagtccaacgcagtcttcccatgtgtctcagaggctgctgtctgtagtgacagaggtgatagaatatggtaaagttgcgtatctaggaaaatctcaatgtagtccctgatttcccagagaatgttcttgtggcttatcctctgaggttagtagtttcagtttagtacattaattccaaacactaaagagatgaatccattcaagtcatttacagaaaaattgttttgagatttacccaaaaaacaaacacactataaagaatttagtaacagagaagattagaacttgcacttttgcttctgctggttcaagttttgttctgatattctctgcatttcctatttccatatgagaaaaccaccagtacatctttgctgtgtgaataccaacactgagaaatattggccaaacataaagatttttagagaattaatttttgatattcatctaaacaagccaatatattctcacaattttttaaagaaaaaaaaaagaactcagcttaatcatatatttgacttctaaaaaatcatctcatgattccatgaagatagagaaaaaatcagatgaacaggaatggttttcatttcacactggaattataagaaaggttaatttttgcataaaaattacatctacataaaaataatttctggaacaatgcattattgacagttatgtgggaagataaatgcattcacgtaaatgttctttctcaagcaaattactaaatatattgacagcactgcactttgaaaacaaccattttaaggcaaccaaatacatatacaagagtaaaaacattacatataatagccaatgtaatgtttcactcaatgcatattcactcaaatatgcatactttttttcagtttattgatatatactgctattaaattaaatagcaaacacttatgctttgttgttggctattgcccacagaaggaaaaaaatgggtagtcaactggagcctattcacacttctgttaattactggtggtccatggaagatgttatagtttgattactagcacttgtaaatattaaccaagtctaagttactgctataaaatccaaaatgtgtaaaaaccaaacacacctatacaaatacaaatgttttactcatgatcgttaatgactttaatcaagcagatcttctaattaattttgctaattgttcattcctctcaggacatttattggtttgatggatattactatgacatatgttgatgccagcatctggtcagaaatgagggcatcaataaactctccttggtgtttctacagaatgtgccaatgctataaacactgtcaatgccacagcatttatttcaatataagattttgagaacatgtctgcctttcatttagagaaaggataaacctacttcgaaacacacggtgctcaaatatgcttattcaatgaatggtgcaatgagaatggcttgataacaaactggaaaacatctgccaacatttaaaatagaataataacatcataaacgattattaggaatggcttcccccacaatgtactctgtcaatttataccctatttcgaatatgtagactaactttaaacaaatatagtaccgctatcttaaaggaagtgatcccctaaacatttctgaccaaaggtaatcatatgcagtaaattaatagacaagaaatgcatcagaattcgattcatgtatagaaatttggctaaacttgcaaacttttatgttgttagtaactattcagagattatcactttaaactgctgacaaataagtgcacttatgcagttttatttttaaaaactagttatcccaaaatatcatattaaataatacaccatgctgtatctatatttcaaaattattttaatggagatttgatctccaggtagaggcaaaacactgttttctccttctggcccccattagggaaactgtaacagtatggttgtctcccgtttctacacatgaatctattgtcactctactgtcatggcttaagaaaaaaatattgcttctactcaaggtgccaaactgcaccaagcaaagtaactccaatgcagtaacattaagtttggcaactgcaggacaaggtttccatccttgaacaaggagcactgatacttcactattttgccccccaacatcatatttccccctgcattctgaaggtttttttaaaaaatatttgtaacaatgtttttgtatgacactggcatcaagtctcccaggcagcatgcatctgttttaatttcatttgtattcgttactcctttcttctctatctgagtccaagagaatcactgctaacacacccagcactactcaggatagacaacgacagaatgaaacacttctgaggaagcctttccggtggcataatgccagcactactcattatagcctattttatcacagagccgtcaacattacggactcgaataacccagataccagcggcatccccttgcacgagctcatctgcggagtacaaggaatacagatttggaagaaacctctgagaggttttctaatctttcctctcttccttctgacttctaactttaacgtgagcccaccccaaagaagagaactagactctcttagtaacttgtgcaaaccttcagaaaagtcttaggttgtacctaaattcctcatgttgccattccaacactatttcctgtagttttccctttccagatgcaggagtccacagagcaagtatccttataagtgtctaagaatcatcaagcaattccaaagttcccgtgtctctaatctactgatccaacgtgcccggcgcacataagcagcaccgcgactgaatttcaagtcttctcaaactcacacctcagttgctcagagaggagaaatgcagcgaggactcgccttcctggccagtctctgaaaacgcgaaaccttcctgagctgtccatttgttttaggggctgtttataaacggctggttttcttggaggaaaaataaacaaataaatacggggcgatggcagcatcctgataaacacaggaccttgtttggcttttggcaagttgtaacctggagtaaaatcacatccaagttacaagcacgcaaattggaatttcgctggaaacactgacccgaccttcaccgaagcagcaaatcgcagtctctgctgctctgctcctgctctccaaggcttaacattggaaagtccatgcccacgtccccctctaattaatcaatgtagaaagaaatacgagggaagagagagggagcacactccacaccaaccttgccagcttctattcttcctgctattccttaaaggcgatgcacagcgcacctggaaattacgtggacttggcatggctttttaatattaaagacaaacgacctttggaaaatatacactgttaaagtcaaaccatttggagagacacccagcaatttacctcctcaaactcctcggaaccccaagaatgaggaaaggaaatggaaaatgcgcttaacccgggggtggtgggggaatcgataaccagaacaggtttgaaaaaaaaagcccccctcccgccccctccgtagagaccgctagctgaggctgcaacacctgccccggcaaagcgtctccgcagccttcccggcttgcccgactcggcttcctccgcctctgccccggctgcggcaccacttcttggagccacgtctcggcgagcgggggccgcggagcgagggggccgctgtgccgctactcacccgagccgctcgggctggccgcgagccgggatccgcgagggctggcgggctctggcccccgaggacgcagacatgtggcttgaacctccgctcccctagccgttgcctctgtgcatctttctgggcgcccccagcgaatgcgagcggcgaggcgagggcgagcgcgccgaggaagggcgggagaggcgcggagcttggccgcgccgcgctgcgccgagcgccgggctctccccgcgagctccccgggcccgcgcgcgcgccccccactgcccccgccccccgcgcggcgcgtgccccccaccccccgccgcgcgccctcgcacccgcccggctccacgcggcgcgcgcctgccctggcggcagcggcggcggcggcggcgcgtcctcccccgaacgccgtctccagggctgctggctgcgctctccattgttccgcggctgctgcccggggtgggcggcgaggcgggggggaggtgtcggcttggccgccggggagggcttaccgctcgggcggaccctcactgcgagagcgatgcgggcccaggcgcggcgcgcgggggctgcagggcgcctagcactgggggttgccggcgcgcgggggcctcctcctggctcccaggcactcgctgctgctgggcgcccctcgcatcctcggttactatggatatctcgctcctccgccgccccctccgcgcactccgggaggccgccggggcggtagcagcggcgcggctccgcgggtgcccaggtgaccggctcggcagcggcagagcagtggcagcagccgccactgccgctgttactgcggtcgccgccgctggagagaggaggacgaggagggcaaggggcagaagcaggtcctgctctgtctgccccagaggccacctcgggtttcttctcactaaccaagcgacttcgtgtttacctcgcaggagacgcctcggcagtcctcaacttgtgtgcgccggtggccctctcctgtgggacttgcgttccagctgttctcagagcgggtatgatcggcctccagtagacttggagggtcacgggtgagattttgataaggttcaaatactcctcactcctgcctccggtttccaccaaagttaccattgtactactaccaacagttgtggaaatttactttggcaaaggttttgtgtttttgtttgtttgtttttccccccaaaaattatgccaattaaatccgaccttaaatgacaaggcttttctctcatgtttaaaatcccatttttttccccttgccataaataaataaaaataacttgtggcttacaggctgcttaataccacaacattttaatgagcatgtcaggtaacccacaggcttcagttctttgttgcttacaagttccatccgtaagtgtgagttgctcacttagtctggggtaacaaccgcagattcccacagagaagaatcagtgtcttaaaacaaggtaataccaacccaatggtctatgaataggttggaatggcggtactttaagtaaaagtataaagaaatggttaacattatgaggaacttccagcagtactaataatcaaccctgttgttcaggagacattcacttgctaaactttaaggctaggcatttactgccttgaaagcaaagcaaatgaagattttgaccaactgcaacattcaggctctaaaatagaaatatgaatgaattattaaataataggtaacatttactgagcacttacgattttccaggcatctgtgcattatctcatttaattcttacaactctatgaaggtttcattatattatcctcactttacagattaaaaaaaaggcttagatctgcaactggtagttttggaagaacattcttttccttaaacaggaaactctaaatgccctctgttttgtccacctttgtgccactgtctgcttctgtgagggtcaggataatagtatacctgaaaccgcccttttagcaagcggcagggccaggacataagctcagactagatgtctaattcacttgctatacatgtaacatgtaaaataaaaaagacctgcatcttgactggtgtactctttgataaatgggacctgattacttgatggaggcatgtttgactatctttgtttatgacattagcaaactttcaatgggtttggaagtgaggctatttagttctgtgtcttactctgcaatccagacacctgtgacttgaggtaaagtaagtgttttcttggtttcccaatcatgagagtgaccgaagaatgacattttccaggtcatcattctcttgtggatattgttctctgataacaatattgggcaatctcaaagagctgtcatttcttggcagtgaactacaggctatttggaaaggaggtgtaaatcactttttcatcatgtccagtcctctgcactctagagtcatttgggatgttttgtgtctgcactacctctagagaatgatggaaatctaattctctgtcagcttttctacctggctagtgaaaatgcttcttgggagagctgggaggggaagtcgctgtccatggtggtcgttactgaagccccattcagcaaaatcggttcatactctaaatactggaatcctgcttaattaaactaaggagcttctgcacagcaaaataataaacagagtaaacagacaaccttcagaatgggagaaaatatttgctagctatgcatctgaaaaaggactaatatccataatcgataaggaactccaatcaacaagaaaaaaaaaagcattaaaaaccgggcaaaggacatgagcagacatttctcaaacgaagacatacaagtggccaacaaacacatgaaaaatgctcaccattgctaatcatcagagaaatggaaattaacagcacaatgagatagtctcacaccagtcagaatgactattattaaaaagtcaaaaaataacagatgttggtgaggttgccgagaaaagggaatgcttatacacaattggtgggaatgtaaattagcacaacccctgtggaaaatagtatagggatttctcaaagagctataaacagaactaccattcgacccagcaatcccaatactgggtatctactcaaaggaaaataaattgttatatcaagaagacacctgcacttgtatgtttattgcagcactattcacagtagaaaagatatggaatcaacctgtgtctatcagtgaatgcttgggtaaagaaaatgtaaatatacaccatgggatactatgcagccataaaaaagaatgaaatcatgtcttttgcagcaacacggatggagcttgaagccattatcctaagtgaaataaaaccagaaaatcagtaccacatgttctcatttacaagtgggaactaaacaataggtacaaatggacatacagagggaaacagtagacactgggaactccaaaagcagggaggatgggaggggactgaaactgaaaaattacctattaggtataatgtccactctttgggggatgagtacactagaaacccaacctcaccgttatacaacatatccatgtaacaaacctgcatctataaaaataaaaataaaaaataaacagctgttaattttgcaaaataagtaaatattacagtctggaaattaacttcatcatggcactaatgaaatttggtgatattctccagtactgtatattaaaacataaagatcttatcagtataatctactggttggagtaaaaacattaaataattcacaggagaatgactttttactctatggcactaaaatagcccctattcattgtcaaattttagatatttttaggtaccagaacagcataaaggggataaatcatttcctgaaaccctctcaccttacagcaaagaaaatagctacctatagaggttaaccaccataattagaagcaggcgtaaaaccatgaattcttgccacagaatcacttatcatgattctgtgatgcaccaggatattgaatgtcagaatcattctttcttcagtaatttcatttttttgcttaaaaacaatttccaatttatgtcatttgaaaaacagataatatatagtctgatgtaatatgtagctcatgttcatttatgtggagtgtatctaaatcttataatattctagctgtattaagtaatattgtttcctgcaaagtgagacagtagaaaaaactcttatggtaccaatttctgaccactgtaacccagtgaaaagcaaagcattaatttcattacaggtcatcaagaatgcaaccgtcaacataaactgcttatttaagagcagccattttctatcagaaaggactaatattaaaattccccactttcctatattctccctttgtattaaaaaattatccaggggaccatgttgaatattccagtctcaaaaatccaaagatggtggtaatttttctaagagatatgtaaggccctttgtaagatttagaggaataggattttaagagtttattcatttgtttagtagtagtataatgcaatagttaatctcctgactttggaataagacctgtggattcaagtcatgggtatttaacttaattgttttgtgatcttgagtaagttacttttttgagccatgctgttctaatttgtgatatgaatgtgataataatgtaagctacttcacaagagttgtggttggaaataaattagattaccaatatgtagtacttttcactaagtaccacactacttttcactaagtaccacacattggtaatatcatttggccaggttaaagtttccatttactcaatcaaagactaatctaggtgtttctgtgaaggtattttgtagatgcaattaaagtctatagtcagttgactttaactaaaggagattatcttagataatgtcattcaactagttgaaagtccttaagagcggcttccctgaagaagaaattccacctgtggacggcagtttcggctcatccacaagagttttcacctgcccttcctaatggcttgccttagctcagtcttgtccagccagtctccacaatcatgtaagccaattccttgcaataaatctttttgtatatgtctcctactggttctgcttctctgactgaaccccaactaacacaccatgtaaagcattaactatagtatctgtgacataataaacactccaaaatattagttaattttttaaattaacccttattgaacatctctcacatttatagcactgaggtatacactctgataaaaatgtctgagagctctgaaatagaatagggatagatagatacttattgtctccaatgatagtaacctcaaccaggaagggatttaatgttttagtaaaatttccaggaaaacaagggaaaagtgccaatgggttgattattccatctggagctatgtaggggaattatgcaaattcagtatgaggccagtttcctgggttaggaagacaatgaacaaaaaggcagttactgttttctcaacagatccatatagatgtagcacctgaaactagacacaccagtttccatggatcaaccatggaattccattctgtaagaaaaatttatttacgacttggtcttaagccaattggaattatatacttgataactgccttgagattcttggaggaagaaatacgctcatatttaagagtattaaagtaaaagatctttcttatttcaatgttagcttatcttagtattctacattgttagatctttgaatttgttttgtgcatttttaagcaaggaaaaaatacttatatcactaaaaagcaggcatagcacaaacctacttaaatagaatctgcctccgtccttcagaattataatgccaaacttacaaaacttaaggctggaaatatctcagatgagtaaacaaacctcagggaggtagtctcagatataaataggattaaaaggtgatgagaaagtaagagagagtgagagcatgccttttggttttatattaaagctctgataatttagagtgaatcttagaaatagaaatgttttaaattgtgtgtttgcaggtgtgtatgtgtgtattcactaaagacagctgtcccatgatcctttatgccataatagtaattttctcaaaggcagtgctattgctgtaaaaatacttttactcattatgcaaagatttattgaatacctgtgatgtcatatgtcgagctggttgctaagggataggaaagtaaattagagatggactctaatcttgtggaactctctctgggcaactctaatttatccttatggatttcaactaacacgtgactttctctaggaaatttttgtacttcccttgctctgcactggcctaggcagttctcttttgctctcacagtaactttgcttccactaatattgcatttatcattttttttagtaattagtcaattgcttataaatctccctataagactgcatgaggtcaaggaccttgtttatgtgaacctctatttttgctcggctcttgtcctcaaataggcattaggtaaatatttacagaacgagtgaaagaaagcttgggacatgttgaattttaattgctttccaaatagaaatatgcaggaagcagaaaatatataaacctggagctgaggacagagatgggtgcaagggatacaaatttgtattagctgattcctggtagttggaaggcctgggtggattatcttcaatgaggctcacatgtagaattatgaacgagaaagtctgaggtcaggactctggacagcgtccacactctccattttatctgtgggatgaaacatggcccacatggctaggatggaaatgttttgggaaacccaaagcccaaataaatcttttcaaccatgtgagtaagtttctaatagatatttcagaactaagttactgtagagacaggagcactataaatatggatttataatcatgacattgtggaactttacctcccaatatgtagagagcagggttttcaatttcgcaaaataaataaatgaataaatgttagcatatgttaatagagggcacaaaatagaagtcagagagagaaagagtgtctgtggggactcaacagactctgtgggaatcagactctctgattttctctctcaatggaatcaaggagtcccacgagttaggcattgggaaaggctctctgggtggtgaacagacatgtgtggctattggtggtgaatgtccaccacagaagcagcgtggctcttccttatactcaaggcttttttttgccattaatgagaagtaagacacagactgactcccagcacttaccaattttattattcttattgcctcctcatactttgccatgggaaaatccctgtttggatcacaaatttaaaacaatagactgcctgttaaccatgggcatatttacagatctgactatgagctaatacaacccagagtgagcagaagggacttatactttttcctgaaggcaagcaggcttggaatccaaggggaatgaatataaacactgagacccatctgccccagtcttctgaattaaaacctagggacttcttttgttaactctgttcaaggcccaaaccacatacagctccattgagccacagctaagatttttgcttgcagcctttgcttagaactggcccctgagagtcagtttcatctgtacagcacagttggtaagtacctcatccttcccacacctttaagcaacagaacagccacagtcaacacttacagcaactttcaaggttagcaatgaaagaagaaggctgcagtaacctcatctggatgcctgttttactaagtaattatacatcccaaatttcacaggacaaccttctttaaatgaatcagatcataaaatctgatttttcacttaggaaaatatggttaaatcatattagagactcatacttggagtcttcaaggaggtagcataatatacagaaaaaaagtccatggactccgaccgtggttcaagttcagctctatcatatttactggttgtagaccctgagcaacttgcttaacctgactgcacctcagtttctgcatctgtaaaatgaggataagtgttctttaaagatgttgtttaaggattaaatataagtacactcatataaaaatctagcacaatgcctggaccacaataattattcaaccagagaatcaagttcaccctagtacaaattcataagcattcagaatcaagaagttattccagcttatcaacagaactaaataataaagctcattcccacagcaccttctagtgtgcttatcagctgtgtaagtgaggaggagcccatgaacttgggaggggacagtaactttttatattgtagactcataaaaatgattttatttttttctctacaggatttttagaggacaaaatagtctctcatttgatggtgattatgtacattattatgataattctctaggaatgcacattaaggattttgaaatatattagaaggacaaaggaagaaagaatgacataataaatattaaaacataatttggggttgggataattgaatcttaggataaaatatggctgatggccattgttttttcctgctcaacacccggtgctctatttctgttaccaatagtctgatttgttactggggacccaactctcccacacttagctatgaaatcctagataatcaaccttaaaagagctggccatggagtggacccatgagccactggccaagcagaagattccatcatgcagccacagtggtttgttcagagacggtcagaaccaagactgttggaactactgggaaaaaggggaactcttctcactggggcttctgatgatgagcttggtattaccagggtgccaggtgtaatgcctggagctgccaagggccatcttgtggagagggtctacccaagagtgaagccagcgcagagaaaagcagagcagagatatggattggagtccagtgatagtttttgaggctctggatccagtcatgcctgaaacctttggactttatctcttatatgagccaataaatttttcattttacttcagccacttggagttggatttttggcagttgtaactgtaaagtgtcctgatttcttcagcagggaacttaagtataatttatctcaacctcccctctgatgtttgaatcttctctacaacttctaatgaaagagtcactcaatcaaggcttggactcctccagtgatagggagctcattaccaactgaagaagcccatccatctttgagacttatattactgcaaaattttttcttatatcaagtgaaggtttctgaaacctttgtaattaccacttattttgtacccagtagaggccagagaccctgtgctatgttatacttaaaaatatacattgtgatttaattctcaaattaaaaatttgaaaattttatttttgaaataatttaataaattaaattaataaaaattaatatctaatgatattaaaattattttagaagctgctgcacaaatccaagtgagaaatgatgagaggctgaagcaagggctatgggggtggggataaagaagatgaggagggatccagtgatgtacagatgtagcatacaggtgactgagtggagggtgagggcaagagtgaaacaggagacttggagggcctccagaaaatagacaggtgttgaaaagcagggagaaacaacctggatgggaaagatgaaggttctgctgtttatcccaagagttaccataagtcgaaggggtcactacttccaaggacacatgatagctctacaaatttctttaaaattttaactgaatctggtttagtgttaagaaataatcatgaacagaattggatgtgcatcaaaagcaaagttttagaaagacctgcaatttttgcacagacctttaatcacatgagtgcaagtcagaataacacttttatgttcagcccttaagactggtttctcccttctctcctcctgccagtgccccagaaggcagaggagaggatccagagaactcagcacgaagatgcagcagagtttgcctgagccacaggggatgggagtctgaccgtgaggtccaggaaccaaagagaagtgcattccagtggaatatgtttctaggaatgggaaagagggagaaagggaagaaacattttatgtatacctactatgtgccaggtcctttttatgtaggattattattattatttcagtatcactttttttttttcccaaatgtaaaaactgtggaggtctgcaaagttaagtaattttccaagatcaagcagcattagaattaagtccaggatgtatgtatgcctctgagatctgtaatttcttcattatgctatgctgtctccttaaataattagcagttataagacgcaagttataaggtgacaaaatacattgacatggtatctggattaacaacaacccagaaggctagtatttctaatattgtttctattttatagatgaggaaactgagtccctaagaggttcattgactagctcaaggccacacagctagtaagtagaaccatagctggaactaaaaattcccatctccaagatctgtgtattttcccatgacactgcagctactacgctgggcaagctactatgaagctggactttgtcagaacagtgacagataacagctttgctctgaaacgttctttccttcaaaggaacgcacccaacctaatgcttgtggtggcgcctgctttcacccacattggctcacaagagaaagactccaaggaaaaaaggaatgagggtccctagagtttctgatgagggtagggcggaggtgctttcaaggatggttaaccctctctcagggctgggcgcaaaggctcctgcctgtgatcccagcactttgcggggccgaggtgggaggactgcttgagttcaggagtttgagaccatcctggacaacatagcgagaccccatatctacaaaaaatttttaaaaattagcctggcatggtggtgcacacctgtagtcccagctgtccgggagggtgaggcaagaggatcacttgcgcccaggaagttgaggctgtagtgagccaagatcgtaccattgcactccagcctgggtgacaaagcaagaacctgtctcaaaaaaagagaagaaaaagaaaaaagacatgagacgtaggagccaggcatttttcagccacaaataccaagtggataaaaaaaaataatgaaaagaatagaagaatggttagcccactctctttctagtgaaccctgggataaggtctatggtgcagtgctgtgaaaattcactcaatccacgagatctatacactttgttgggacctgggatagaatgaaccagtgttcccttagaatggaaatgactgagtagaaataatgtgggaagccacattaactctttcaggccattaggctatcatttagtaaattactacattgttctaaatgggtccctagtgggtatggagggtgagaatgttctaatttgcttttctctcctttctctcagctgctttctcctactatgatgtagaacaagaagtggtttaataactgctctattccaaatcactgaatgctcttataactactgcataaaagtgcccctgcaggtctgctatattgaaatgtgtggaatcaaatctatgcatatgatatgaggggtgggggctgcaatctggtacccacaggatctagaagtaactcgaggaaccaggatatccctgattttaaattctaggttaatggagggcgtgtgaccgagagccccatgttcctggggagggaacagatgccactggaagctgcagggcaggagtttctccacctaaaagggaggatccacaactctgatctgaggaggagtccgtgtctctgccttggcatgtatattacaagagaaaatcataggaagggcaaggatgttccctgacgactggcttccctctgtcactcaggatgcatggccactgttggttgaaggaactatcatttttctccctgattgaaaaacaaaagaatcaaagctctcccttgtgcttacaaatctggggatattaattaaatacctagtagagatgctggggcctaatattattgcataatggtgattacagcaacaatgcattatatagcattaaatgtttttgaagcactttcatattcatttgttttttaaataatttttgtttttatttttttccagtttcattgaggtagaattaacaagcaaaacatgtacacctgtatgtattcaaggtgtatgatatgttgttttgacatacatacacactgtgaaatgatttccacaatcaagctaatgaacatatcatcccctcacatagttactctgtgtgtgtgtgtgtgtgtgtgtgtgtgtgtgtgtgtgtgtgtatgtatggtgagaatacttaagatctgctctcttagtgaatttcaagtatacaatacattattattaactatagttaccatgctatattattaggtctcctgaacttattcataactgcaagtttgtaccctttgtccaacatctcccctttgcatattcgttgttggtcagggctatcttgatggacatatgaagatgggctccatgcttggtttaattctctgcagtcacagtcttgtaattccaaataactttaacttggaattagtattttgtaagcaaggtctgatgggactgtggagcatgtgctgggcttggaacctcagcttgatgccgtcctgccttcctgggatgggtttttggctgccagctccctgtctcatgctggtcctgctcagggccctgcccactccacccccttaccccacaaccactgctgcaatcaggtggcactggcagggggaggaaagagaccagcttggattcagtccttgaccactctcttcccccaatggtggtggtgggggagtctcgacatggacggtcatccacctcatggctttttggggtaggcaaggcagcagccatccttgtccctaattgcaacatcatggcttgtttggtgggtgatatagtttggctatgtccccacccaaatctcatcttgaattgtagctcccataattcccacgtgctgtgggagggacccagtgggagataattgaaccaaactgtttaccccatactgttcttatgctagtgaatcagtctcacaagatctgatgattttataaggggtttccacttttgcttggctctcattctttctcttgcctgctgccatgtaagatgtgcctttgcttctcctttgccttctgccaggattgtgaggcctccccagccacatggaactgtgagtccattaaacctctttttctttataaattacccggtctcaggtatgtctttattagcagtgtgagaacagactgatacagggggcaatacagttggtgactctgcatgagtctttcacccatctctgactcaagtaccaagcacatcctggcctagggattgtaatctgttgggtagtcacctgtctgctgtgggttgggagtggtgggcctgtaggaaagggagattgacttccctgtccctggccaggcctcacagtttcattttataccaggccttgcaaaatatatagccagacctgtagttgacatttattgtaatatccatgcaagctggataggacaagaatgttgctactgttatgtctgcttccattatttctactgctggggaggctaccattaccttctctgtgacttgcacttgggcaagcacttaacaatatatcatcccatttaatcttcacaaccaatatacaaggtagggtttatacactggggtggttccctaacttctctgagttttagtttcctcatctggaaaactggtatcataatgcctacttggtaaggatattgtgagaattaaataagatgacatgtatattaagagatggaggtaattttatctacctgcattcctctaattctatatttgttaggaagaaatcttttggtaagctgcttgaggagaagagtcaccatggacagactaaaataacccaataagcttgcttaacttttgcacttatgacaaggagtagtgtttgttccttgccattgttcccaagaggaaggtggcaaagaaagagttggtgagggcgaagcatttgcaggggaagagaacaggagtgacagtatgtcctttagaaagtggaaatattgaatggggttctaaacaaattgtttggttgggtttatgctataaacagcccaacctacccaccgtcatgaaatcttcagtaaaggctgtgtagctgactaacgcttttgtgtgtgattagataaatgcgggagaggggctcagtgtctgttctcaaagaggcattgaaattcacatccacgttggcacaagtgaaaacagacagcttgtgccagaagatgagtgcagagctggtgtgtggttctaatactattcttggaatgcttcctctgagtgacctccctctctgttcaggccacgcatttctggagggtataacagcagtatattgttatattgtatatatatgtatattctgtttggtttctattcttccacaggccccaccatcaggttccgcacagagtgaacactcaaatgttgagggctgataaatgtgagtagcaactactaaatgaaggagatgaatatgcttttgtatagtaacttcaacgatgctttgatatagaaattagtttacctagtgtactgatgaggtacatgaggctcagagaggctaagaaacttgcctggcgtcacacagctagtaagcagcaaaaacagacattcatgttccatacacaatgccttcctggtcagtgacactttagcagactatctagagttctggcatcgtataaaccaggcattatccacatatgtatattttaaaacctcactgaaagcagaaggataagatgaattgactttaagcattcctggggaacaaaaagtcaaaatggaaaaggagaacaggagcataagaaaaaaatatatagcataactcgttatcccttagataactgtagggtcatgctgatattagtcattgtactgtgatgacaccaaaaagggaaagtgtaccagctagccaggtagatgcaattcattgtgcaagaaaaggctgcctcaaatgtgtctaaaagcgtggttcttcattcagccaagtcaagaccaaaggagcacatgaataattggctacagctcccctttcagcaagtaccagctttctctgctgaggctgatacagctccatacctcagggggccgggaatcagctgccagcagccaatgggcttctgagcattcataagcagaccaggtgctgatccatcaggctaattagcagcctgtgggccacagttagctgggaaggtggagggttttaactcttttcctgacagactccaagcctatctgggctttttgagcaatgttctatcagtcaaaccacaaagaaaagtattagaattcaaaaggagggaagctaaaaggaaatatagttttgctttaaataagacaagggagactaacaacacaaaggaagtgaactttgactctcaaatatacatatatatagatgtatatatgtgtctgtacgcatctcagtctacgtatcttcatgttactgactgtaatgtcatcaccacagcagacattcaatacatgtttgcttttgttgaggatgatatagtgatatttaaaacagaaataataaacaagggaagaaaataggacaggattgcaagggagggggatatttagcttgttggcacctgaaatgtatttaattatcaggctcccaaaagagcagaggaaacagaattagcttcaatgaaaaatacagagaacatgctgaaagttcagaaaaaatgcaaaacttactttaattaggagatggagatggaatacatcagaaatagtgtcactgcaaattaccagacttataaaccaatatgtaaatcagcagaggaaacaatcccatgaattttagtaaatttgtagaaacttgttgtaaatagtgcatttaaaattagttttaatgtgaaatagaatcaacaatcaatgaagccaacaccatccaaatgtcttcattgacataaaaggagcattctatagtcaattggttctatatttttgactttagtgtggttttgttgatcatggatccaataatctccagtgaagcagtgccaatatatgatctagcgataggaaataacaaacaagcatcctaatccttaaagtagccaaatctgacaatcatagaaaatggcaaggcaggatactggcaaaagtcttaaaacacagaggtaacatttatggagatgtctgcacgggctctctgtcaacatatggagaattgaggaagagctacgggatttcaatgacaagcccatcaccaccatctggagataaaaattctgtggtagattttttttttaaactgtgatattttactgataaattttatattagtgacaagatcctaaccaaagtttccttggactgcttactataaaactgtgtactattgactctggggttaaaaaaatggatttatgcctcactgagaaacagctgtcattgcatttgtagaatcatagtgtcaagatgatgaaactgagctaattccagagtcttcagggacctaaagaaagcattatacagccctgaggaggtttgggtgtactggcagtaatgtcaactgtatggccctgagaaactaatctccatgttgagattatgaacacaaatctttccccaaatatttactgagtaaaaacatagtgagtggtccattagggagagcaggagcatgagttggattgtttttgttctaagaaatgaatgcactaccttggactataatcaatttggggattgtggtcttttaaacagaccatagcagatgattcagtgtcagtgggccactggattcatgccaagtgataattctccataacgcttcctacagtctggtgtgtgcaaaacaggcaaggtcacaagtctgttctacagccaccgggtgtgctggtccttttattgtcctggcaaagtaacaaccctgtgtatgcacccctacaaactatctccccatggtttggtcagagctgacccccaagctcaccctgcctaagtcatttattactagcagaggaagaaataagcatataatcatgaccttatctacttctctagcctcaaatctagtctctcctcaatcaaaccctttcctatccctcagggacaccttgactgggtgcctttgcctgtgggactctctgcccttagcatctttcaattagttctctgcctggaaggctgttcttctttcatgtgttacctcctcctgaaatggtttcttgataataacagcaaacacataggatttgcttcataccaggcgcacttctaaatgctttattaaatgtacttacttctcaccagaaccctttgaaataggtactgttatagtctctactttagatataaagaaacttaaaggcagagttgttaagaaatttactcagggtcactggtaaatggtagagctgaggttatgaaccatggcagcctggctccagagtgtctgttcttcatcacgactctgagcataatgatccctagactttgctgttagtatcctgagcactcgctaccagagaagtagctgcactgcactctagtcatgtttgtaagcttcctctctttccatgctaactccagttaatccaacaacactcagccaaagcatcaactttttcccccttaagtcttcctgatcctgctcccctaacctgtgggaggtgaatcctccactgcccacaccatgcttctctctgctagactccttatcacaccacgtgtcttgtttacctgtctgcctccctcattaatctgtgaactctgaagttttgaaggcacgaatggtctcagtaacacagtatctggcatatagaactgttgcttaataaatatttgtctgtttgatggatggagactggtgctaacaagtcttcattttgcaactctggtttctagcttttaccggcagattaagaacaaaagggattccatcacaaatcctgggagaatcatgacaaatgcttagcttcagttcagaaagaagcaagactatttatagctcagggactcaacattaaatgacccggacttaatttttccttgtgacctagatttgcacaactttagatggaaagtgcccttggagatcattttacccaggtattgcaaactggtggcctagagttgtttttatttgacatatattatttgtttctatttttattagaatacctttagacaggacatgtgctttttatttctccacattttacatcatatcctatcatacaccactttactcatttgtattatccacctgaccattcaaagcatttgaatatgaaatgtctgaattagtctaactcattttttttggtctttgtttacagtaaagctcccaagtctgtacttagggtctccaattttctcattaattcattccagtcagatgttctcccaccctctactgatgtgtagactgatttccatgtaacaatgtaccaatcatgtaccagtgatttccacctagctaaatccagttcctagcttggacctcaacccctcctccttgacattcaggaccatactctcctggttttcctcctacttctctggcctccccttctctgtcttcttgctgattcctcctcatactctcgacctctaaatgttggatcctccaaggtgcagctcgtggcctgcttctcttctggatctactctcatccccttggggatcttgtacaggctcatgagtttaaacactgcccacatgttgacacttcctcagtgtacatctccagctcacttggttgtctagtgggcctgtcaaacttaatatgtctaaaaacaaactgccaatttcttcatattttttttgttgttgttgagatggagtcttgctctgttgcccaggctggagtgcagtggtgcaatctcagctcactacaacttccacctcctgggttaaagtgattctcctgcctcagcctcccgagtagctacgatgacagacgcgtgccactaccacacccatctaatttttgtatttttagtagagacaaggttttgccatgttggccaggctggtcttgaactcttgacctcaggtgatttgcccgccttggcctcccacaaactgtcaatttctaccccaaacctgctcttcttagcagttttctttatgtcagttaggggtatatccgggccaccagttgctcaggccaaaatccatgggcttatctctcattgcttcctttctatgtgatatggtttggatatttttcctcttcaaatatcacgctgaattgtaatccccggtgttggaggtggaatctggtgggaggtgtttggatcatggcggcggatcccttatagacggcttagctctatcctcttggtgatgagtgagccatgagatctggttgattaaaagtatggtacctccccactctctcttgatcctattactatgtgacatgctggctccttgtcaccttttcagccatgattgtaagcttcctgaggcctcaggagaagcacatgccagcaccattcttcctataaagcctgctgaaccatgagccagacaaacctcttttctttataaattacccagcctcaggcatttctttatagcaacacaagaacagtctaacacactttcatatgccatatacaagtcctcagcagtcatgtctactccaatcttccagtgcctcccttgttctttaagagtaaaagccaaagaaagtccttagagtggtctctaggagccttgatattctaccttccttccttattcctatccctacctttatttctcagacccccattcccaccactatcccccttattgacctgcctccagctcactggcctcccttcactgttgagtgaacactccaggcatttttctacatcggggtgtttgcatttgctgttccttctgcctggaatacccccacccttcccttccccatccccaggtatctgcatgtatctgcatgggttgcttcctcatttccttcatgactactcaaatgaacctcctcactgaagctttccttgaccactctatttgaaatagacttccctaagccaggatgatttttcatccctcctttctgcttttctctagagcactttattaccctctaatatcctatatattttacttacctattttgtttctcttcctactagaatgtaagctaaatgagggcaggcttgtttgtcttctttgtttactgctacatcctcagcatcagaataaggctgagaacttgttatgggttgaattatgttccccccaccacccccagtaagtcccagtgaccttatttgggaacgaggtcattacagatgtaattagttaagatgaggtcacactggagcaggctggacccctaatccaatatgactagcgtccttctagaaagaatggcatgtgaagagaaggagatatccatagagggaagatgatgtgaagatgtacagggagaagatggccatctacaagccaaggagagagatctggagcagatctttcagacttgatttcagacttctaagacttctagcctccagaactgtgagacagaatttttttttagacagagtctcactctgttgcccaggcaggagtacagtggtgtgatctcagcttactgcaacctccgcctcccaggttcaagcgatcctcctgcctcagtgccctgagtagctgggactacaggcatgtatcatcacacccagctaattttttgcatatttagtagggacgggctttcaccatgctggccaggctgatctcgaactcctgatctcaagtgatccacctgccttggcctctcatagtgctgggattacaggcatgagccatcgtgcctggccaagacaatacatttctattgtttggaccaacctgggtgtgttactttatcactacagccctagcaaactaatactcaaaaaaattctcaagaaaaatgtatgggtgaataaacaagtgaattaatcctttcaatgaagaaactgaaggccagtgaagttgattaacttgccagaaacacaccatggtgaacgggcagaaccaagactcaaatccagctttcctgccgccccatctagctctcagccaccacatctggatgccacgtcagtctgtctcatgagcactaacaatggtgggctgaggttgagggggatctccggagccccttcaccatctcctaggtcttgcctatcctgccttcctgcttaacgctcccaccaccatcacataacctggatatgttgtggccagacaattattgacgtatgtttgttaagtgttctgatctcctctcagaggaaaaccctgtgtttgactcttctattattcaggaagtaataaaagttatagtcataatatataagaaaaaagaatgattcactgctgagctactgagctacagggagcaatccaaggtttagaacagacaattggctaagatcagtcacgatgatgtcacagcggaatatacaaatacctcagtgggctgatccaagagaacatcacaattaaatcagcttactgctgagcactcttccacatctgtgaagagctgctctccattctgacagccacgtttaaggaggtggtggaggcggcagtctatccaacaccctccacacaggaagaaaggattgcaaagtgctactgagtaaatgaacatcattcacatggaaatgcactggacgagatcatacatgttaagacagttaacagacaggttaggaacaatgttttcttttcagaatggaattacagtatgacattgggcatgggaaactgatgagagccatcagagatgatattcaaaatgtttaacaaaatatcgacagcataagccatcaatggccaatgcagccttatcaatgcagagtggttgaacatggtgctggtgaaactcacttggctagaatagcagagatgccattaacctctctgacccttagtttagtttcttcattgcagagtgaggcaccaccacttatttcctagtgttgttacaaaggttaagaaaaaaatctgtgccacaattcctggtacatatcagatccccaataataagagcaaacatttatgtgtctttattatatataaggtattagcaaatgctaatttacttaacccttatagcagccctagtattcaactattttttttttttttttgagacaggatctcactctgtcaccctggctggagtgcagtggcacaatcacagctcactgcagcctccacctcccgggctcaagtggtcctcctgtctcagcttcctaagtagctggtgctacagatgtataccaccatgcccagttaatttttaaatttttcgtagagacagggtctcactatgccacccaggctggtcaagaactcctgggctcaagcaattattattagcattttcccgttggagaaattgatatagagagcggttaagcaactttctcaatgtcacactgctggtgaatggcaagacagggtcttaggacccaggtagaatgaatcccaggggctccttccccaccctatgctaccctcaggaaatgtcggggcccatccctcccactttatgctccagagagccagtgtccctgcaaacctaacatctcattgcctcaaagtcccagctaaagcctagtggagaggacatcactctttggtccttcagtgccctagcccttctttctaggtttactcaatttccatttgcatgaagacagacaagaaaaacagtccaattaatacgaagcgtaagaccacaagatgagaaggcttttgctttgctttttattttgtatcagctgaagtgctgtgagtattcgggatgaaaaattatttatcccagttaatgaatctcatgataataaaaatgcctgacagctctgagattagtgagtagcccttatctggggaccacttagtgaagcaaatcctgcgtgaacaaaggacaaatgggatttgggagaatgaggaggaagggaggctaagaacgaacatgtgttttgcagctatctcatgccaggcatcacacaaggtactcaaccctcattctttcttttaattcttttgagaactcagtctttatacaaacacttatggcagtgccaggtaccataataagtgttggggttacaaaattaaataaatcatggcccctgtccttttaagtagaatggatacagaaaataagtagagaggctatttatgttcactgcaatattagtttgatatgagtatacacaggcagtggaactatgctatacaggccaagatgatacctaccatgtcaatagttcctgcataaggactatttcctgcatacgcagctgtgttctgggctgggtgatatacccctgcacctccccatggcccctcaggcccttcacggaggttagttggctagaggagtgagattctcttaggagtttacacttggaagcagaaagagaatcaggcaattggttgtgggaacagaaactgagaagatgatctaaaaggagtgatgaagtacagtagaatggggctgggtgggaccatgtgtaagcggaagctatgaatacacagaagatacaaggcacagaaaacgctgagcagaatgtgaggaagctaggtcgtagcaggaaatgaatagaagcagaggatactctaaccaacgtatgccccacaatttaatcctttccctaatgttagatcattctcattttttcctgtattacaaggaatcctatgatgaatatcattgcacatcagtatttgtagcatttctgatgagtttctctaatatattcttggattaaatggtatgcacattttaatgctcttgagacaagtatgcatctttatttccaggaagatagcactaatttcccacgcccttcagtattatatgagtgagtctactttaacacattgtctcacactgagtccttgtcacttaaacagggaacggtagtaactacctttttaattgtttaattatttaatttttaattgtttgcatatttttcatatgttatgggacatttgtatttcctcttttgtgactccagcttgtttatgtctttttgtccatttgcctataaggccatttataatgctcttattgatgtatgagaaatcaataaaatttatataacaagaccaatactcactgacatatttagcaaacacttacccataattagttgttttccttttcatttttatttgaggcacggaagttttatatttttcaatatattgatattttcctttgtaatttgtttcaaagggtttctttttgcggaaaaaaatctttttctgttttctagatcaggaaaatacttggctctgtttcttttcctacttttggaaaatgtttttgcttttatatttaacttttctgttcacttacaatttattttggtgtatttgaacctttatgaaggaagattttgtactaaattaaaaaagaggatggtgtgatcctgtttcagaaaaatctaatctgtgttaatgtttgttccccagcagaatcaaccatggattacttccaatgaccagtgcaatgacttgagcacacacagacccatttaaatacataatgagggagaacatatgatcaagggcggagatgccatcatttgtgctctgtatacaacctacttttattaaatggaaattatggtcactgaataactcaatctacctaaactcttacaaggaatcagaagccctcagttcttaagctgggtctgtactgatttacaatgggacacaaacacactgtacctccttaaccctaacacccactttccaattgcctgtctttcaaaactatctaattagatttctttaaaaagaacatttttgtcatttgtgaggaatttttcttttcttttttagtttgctcttactgaaaaaccaaggcaacttcaactttatcttttcatagggtccctttccaagtgttatgactgaatggaagctgtgtggttggtgaagtacttcggctatatttccaaaaatatgcaattgttaggggctgcaatgcaacagccagttccagagactagcaaaaggcagggggatactctcaagagtgactacactcgagactttccatttcagcaacttcaggaattggggaaaactcactaattcaacactgagttctctgaaagtgatggtgtattagtttgctaggtctaccataacaaagtacagcaaattgggtggcttaaacaacagacatttgttttctcagaactctggaggccagatattcaagatggcagcactggggagaaaatctagcttctggtggtttgcaggcaatctttgacatttctttgcttgcagaaacatgaccacaatatctgtcttactcttcacatggcattctctgtaaagccacactatttgcttagattgtttgaagaaggcactttcagatgtgttccagaggctgggcaccttgatctggatcaaacgctgccaattgttggttgaaggtgagtgtagaaatgtatctacttccaaagccaaaatattactgtattagtccgttttcatgctgctgataaagacatacctgagactgggtaatttatacaggaaaaagggtttaacggacttacagttccacgtggctgggaggcctcacaatcatggtggaaggaaaggaggagcaagtcacatcttatgtggatagcagcaggcaaagagagagcttgtgcaggaaaactccaccttataaagccatcagatcttgtgacatttattcactatcacgagaacagcacgggaaggacctgcacccatgattcagttacctcccacctggtccctcccacaacatgtgggaattcaagatgagatttgggtggggacacagccaaaccatatcaattactaagtacacagaaaaatttataagtcttggtccatgtacctcatcaacttcttctagcaagaagcagctggctgacttgcaatgaaatctccttagagttttatctttaaatcattgatctcaatggatatcttatacctgaaaatttgctgttttactaagggtgaagtaaattaaattccacaagagttagaaaataatttaatcagctggcaaaagctaaggatgaaagcaagttaatacaaatttcaattttcaaacaagattcaatacatgtatataatttatttggctagattcaatacatgtatataatttatttggctattacagggagagaaaacataattactaggtcttattaaaagtatgtctttcttcttttccctgtcatcctttcttccctttcttctttcatttttaaattcccttcccctcttcctcattccttcctcctttcttttcttcttccctcccttgatgttttccatttactcagaaaacatttagggagcaattaccacaagttagagtatacaccatatgccaaggatgcacccaaaatgtacaggtgataaagcagcagttcctgccctcagcaagttcatagcctaatagaatctgagttatgtaagggtgaaggccctacagtacattctctataatattgtagtaagaggaataatctcagatctcatgcatgcattccatgatttttctctttacttttgccactgtttttctacctgatattaatcttaatactataatcttatactactccttcaagcagctccgtgtgttttctataggcccaccaattattgccatgttctaataaggttttaaagaaaatatgtgaccctttagaacatcaccccacttccatgcctgtcttccatcctctgtataaagagcagagggtgtgaagaatggactagaagggttcctgggtggctcattgttgtgatctgtttgcctgctttggcatgctttgattataataaatatcttctctgaggggagcattttgaggaaagtgattgtaaaagaagatggaaatccatctataaagatggtaaccacaggaactaatttgaagaggtttttcatatttattaatagcatagaattgtccttccagaaagcataaagttctaaatttgaacaaagtccacagtctgaaccaaaattctgtacctttcagaatggatcataaaagaaaaaaagtctacagcacaaaaatagtttcctcctataacctcaaacaaatgtgagggcgatctgcccttgcaattttcattacttcaagataacaacaaggaaactatgattcagttagttctttcctttcacacattcagagttactctgcaattgctgagtgctagtgtatctatcctcaagtggcatttctgtttgagaactgtatttttcattatttagagttttctgtaatttttactggtaatattaatatttaacaatatcatacccccagaggtatctttgtgcaactttagaatatacgtactttgtttctttttatgactctaaccttttattctttcattcctctagtactctgaatataagagagtctacacgctttttagtgaggattttttgatccctgcttcataagtgtcactcattgtaggctttcctttgacaacaaaaattcctgctctctttacgttgactctaattacttcaccagaaaaggtaaacctgtcattgtgtaagaaaaggaattaagttaatgtaactgtttcttaaggtcttattattattttatttttatttttttgagacagagtcttgctgtgtggcccaggctggagtgcagtggcacaatctcggctcactgcaacctctgcctcctgggttcaagcgattctcctgcctcagcctcccgagtagctggaattataggcatgcaccaccacgcctggctaatttttctatttttagtagagatggggtttcaccatgttggccaggctggtcttgaactcccgacctcaggcgatccacccacctcagcctcccaaagtgctgggatgacaggcatgagccactgtgcctggctcttaagggcttaatgtgaatgttgcatacacatgtaatttctgattcatttgtggacctttgcgtaaaaataaaattttcttagaaattcatagaaaaacatggcagttcttaccatgcatcacagtcaatttcctgagggttctgttctttggagtctggggaggggaggtgctgtggtttggatgtgtttttttcccaccaaagcccatggtgaaattcaatcctcagtgtggcagtgtggggagatagggcctagtgagaggtgtctgggtcatagaggtatatccctcatgaatagattaatgccttcctgctagggtgagtgagttctagctctcaggggaatgggttagttcccttgaaagtgagaatgggttgttaaaaggagtctggcttccttggttttgctcttttgcttcctttctcagcctgtgatctctgcacactttggctctctgtcactttccaccatcagtagaagcagcatgaggccctcaccagacacagctgcctaagcttggggtttccaggatcatgagccaaataaacctcttttctttataaactacccgtctcaggtagtctgttctagcaacataaaacagactaagacagaggtcttcaataccaaaagatagtctacttgatgtgtgaagggaggctttggtttgcctgctataaaataattttagttgatgaacccgaagttccctgaaggtttagtttctggtgactttcattctgcaattcttgcacaaatggaaaaaaatccatcctagttgaatggagtacctacactacaaatgtagagtgaatctgtagaaaccactttttagataactgataaaccagctagttgctaatcacttcattgctgcttcccaccaccagtcaatgtttaaaaaaaataaagaattctccacctaactttgacaactggggaaaggtaggactttgtttcagcatcaaaaggaagtagagccacgtagaattatcatttagttccctcagtcatagccatttctcatttttcatcttccctacttttctcagggccatttattgtcctctaatgcctcccttctcttcattcttttttgctcttaatatctctggagggacaccaaagaagtgatttctttctgcattcattaaaaataggtttatgttttgccttcctgttcaattcccacttgggctgtaagcaagtaactaaagcaagggaagggttgggcatgtgggcgccagacttagatgcctctatttatgcctagattcttcctatttctcccattcttccctcaggataggagaaaaaggaggtggcagaggtctgattaaagcagggatgagcaactgagccaccactgcagtgctgagattgggtgaagcccccagcttcacagaaaggcctgcaacatcattgcaagattaaatgtgccaatattcttgctaagttactactttttgcacattaccagagaatagacttcccgggcctaaaggaatggcaatgttttcattgtcatttatttctctgttcagtaaggtagatagtacaggttttaagagtcttcttttttttcctcatgagactctatttcttttcccctctattttcttctatgctaaatggctgtatctactcttgaaaatacattctaactctaagtgtcctttgtggatttgactttaggaaaccaaagtagcttcccccaagccaccctctgtctctcttttttgtttttttgcccattggtcgattttaccttctttttgtataccatcaacccaaagacacagcatactagggacgtaagtgtggaactgataccgttagttttatttcggggtgatgcaatccctctgctaattcttagatggtcttatggtgtcagaagaaaatttccttctgtcagaaagccttaagtacgtttggaaaataattcagaatcaaggctgtcttcttctgttttttaatcaattcactaaatagtcttcatcatacagagaaattattccttctactccactccaaactaagacattattttgaaatagattatcaaataatagtgcagactaatttccatagctcaatgagtagaaggcaaagtacattatttgctaatgcaaatgctgagccttctccaaaaaatttaatattcaaagtccagacgggataaggagacaaaaaaagattgcttaacaattttccaaaccaaagtgacctataacacacaaaatatggttctattatgtgcaactgatattttctttgttgagaataatgagctacagcagaatggcataatgtagaactccacagctgataagctttctgcataagaacaggaagaggacatttcttaaagagttctgtgttcattgcttaccttgaggaggcagtgaatggaattactgttaatagtaacaatatgaagctaattggtttaaaatgaagcagcaggaaatgctgatgatgagactggggtatatgaaggaagaatgaaaaatctatactccggctacacaaaaatgatgcttaaaatgtaacttaatcttgatattttattcataaatgacaaatctgctcactacactgattccctaggtgactcatcaaatcccatctctaggtttatgaatctcaaaattttgtagctagttctgactgttttcactggcaaaatttgtcaaaatcaacttcttaagaatttggaaattaacccaaagtttgcaataatacaaaaagcatttacttttttaaaaaatggctgaatcccagtaaaaacagtgagctttgtggcattttaacttgcacttataaccatctgcctctccacagcttcacagtatccttgaaaatcaacagctttgcagccatgatagctatgaaaactagcagcctagcagccactggaggggacaggtcaggtatgaagctcccccaaaattcccattcccagagaatggtcactatttaacctgtctgaaagttccttaagaaagctccattcttatagtttgtctttatttgccttgacttaaagctcatttggtgggaatagccctgaccccagctaattttttgaaataatcagcaaaaaagctttcagaatagtgacactaattgaaactaaaaaaagaatgaccaaaaatttcacaggaaagactggataatgagatgtgtttaggggggtttgaaaagctctgatagatttctggtaatctagaaggccatgcacatatacagggctgtgcacgttcccagaaaagacctgagaagcccctattctctcatctctagttgactttgaggttctgtgcaagctggatgtgaaggctaaggcagagttgtaaactgcctggtagagcattgaagacacaccttaatacacacacatagtcctttggcagtggctgggagacttactggctcaaggcatttaaggaaatctgttcaatcattaggtaattggtaagctaactgagcacagacttctgtggatgcagtgagagataacacagaatttacagaattagtccaggaaagtcactaaacaaacagcagctgcaataataaagggcatcaacaacagaccttagagaggagggaggaatatgaattccagaattgccacactatattccttaaaatgtatagcattcaacaagaagttaggagacatgtaaataaaaagcaaagtatggcccatacacaggaaaaaaggaagtcaatagaaactgtccatggatgttggacttcctagacgaagactttaaaccatctatcataaatatgttcaagttactataggagacatgtctaaagaattaagggaaagtatgaaaataacgttttggcaaatagagaatgttaacaaaggatataaatgatttaaacgtacaaaatcggaattgtggagctgagcagtgtaatagctgtgataaaaatatagtggggctcaacagaagaaagaataagcaaacttgaataaaggccaattgagatgaataaatagaagaacagaggaaaaaagaatgaagaaaaacagtatcaaagacctgtgcagtgccatcaaatgtaacaacacatgcatagtgagagtcccagacagataagagaaaaaaaggggatgaagaatatttgaagaaataacagctgggaactctccaaacttgatgaaaactattaatccacacatgcaagaagcccagtgaactccaagtagggcaaactcaaagagatccttactttactacattacagccaaactttctacagctaaagacaaaaagagaatcttgagaatgccaagagaaaagtgactcattgagttcaagggatcctaaataacattaacagccagcttctcaacaaaaaccatgaaatccagaagaaaaaggaatgacctattcaaagtgccaagaattttacatccagcaaaaccaccagttaaaaacaaaggagaaattaagacatcctcagataaactgagggaatcttatcactagcagatcttgctccacagcagatagtaaggggaaaccttccgggggaaatgaaaggatgctggacagtaactcaaatccacatgaaaaaataaagagtaccagtacaagtaactgcatttgtaaatataaaagacaatataaacacatttttgcttgtaactctttctaatttaaaagacgaatgcaaagcaatgatgacaagctgtttgataggcttataatttataaatatatacttttttaattgaaatttttttcttttatcatccagcccaaaatgtcataaagatataatttctatgacaataataacacaaaggaggagaaagggaatgaagctatattgaagcagttttacatataattgacggtaaattggtattaatccaaactagattattttaagttaagatgttaattgtaatctctaaggcaaccactaagaaaataaagatatagtaagagaaacaagaaaattaaaatagtatactagaaaatttatatgttaaaaagaagaaaacctcaagtcaataactaaaacacacctcaaggcactggaaaaagaagagcaaattaaacctaaagcaagaagaagaaaggaaataataaaaataagagtagaaataaataatttagagaacagtaaaacaatagaggaaatcaacaaaaccaaaagtgtattctttgaaaagatcaagaaagttaaattaacaaatctttacctagactgaccaagaaaaaaaaaagactcgaatttcaaattattaaaattaggactgtaagaggggatattggctgtgcagaaataaaacaaaagattataagggaatgccatgaacaactgtatgccaacaaattaaataatcttggtgaactgaacaaatacctaaaaaaccacaaactgttgaaaccaactcaagaaaaattcaaaaatcttaatataacaaggatagagattggattcgtaattaaaaaaaaaaaacttcccacaaagagaagtctaggccaaaatggccttattaatgaattctaccaaatacttaaagaattaacaccaatttcataagttctaccaaaaaatagaaagggaaggaatacttctgaactgattctatgaggccagtatacactgacaccataatgagacaatgacatcacaagaaaataaaattaaagatcaatatatcttatgcatattgatgcaacaattctctagaaaatatcagcaatctgaatccagaaacatattaaaagaattataaccatgatcaagtgggatgcatcctgggaatgcaagatgtatttaacatacaaacataaatcataaatcaatgcaatactttaaattaatatataaaatgacaaaaattacgttatgagcacaatagatgcaggaatctcctttaacacagcccaatactcttttatgataaaaatcattcaacaaaccaggaaaaaaacacagaacttcctcaatctgataaagcccagccatatatagaacccatacggctaaaataatacttaatggcgaaagaccagatgtttttccctttcccaagacaaagctagctactctggtcacttctattcaatatagtattgggggtgctagccaggctaattaggcaagaaaaagaaatcaatgcatctagcttgaaaaggaagaagtgaaactatctctatttgcagattacgtgatcgttatatagaaaaccctaatacacacacacacacacacacacacacacacaagttcagcgaggtttcctgatacaagatcaatacacaagcattagttgtatttctgtgtattgacaatgaacaatttggaagtgaaattaagacaaaaattccttatagaatagtatcaaaaagaaaatgcctagtaatagatttaaaaaagaaatgcaatactttcacactgaaaactaaaatatcattgcaagaagttaaagaaaaactaaataaatggaaagaaaactcatgttcatgtatcagaagactgaatacgtgaagatggtaatactcccccaaattgatctacagattcaatccaatacctattagtatctcagctgccttatttgtagaaattaatgagctgatcctaaaattcacatggaaatgcaaaggacccaagatagccacaaaaatcttgagtaagaagaacaaagatgaagaactcatacttcctgatttcaaaacctgatacaaagctacagttatcaagacagtataaagcataagaacagtattggtataaggagagacatataaatcaatgaaaataatttatattttcagtagttcagtagcaggcttttacagggttaactgattttcagtaagagtgccaaggtaatccaatggaggggaaacaggctcttcaacaaaagttctggacaactgaatatccacattcaaaggaatgaagttgtaccagctcacatgattcacaaaaattaactcaaaatgaatcataggcctaaatgaaaatgctaacactataaaactcagaagaaaacatagaagaaaatcttcagaatcttggatcaggcatgacttcttagcaatgacactgaaagcacaagtgacacaagaaaaaatatataatggacatcatcaaaattaaaaactttttgtgattcaaatgatattatgaagaaagtaaaaatacaatccacaaaaatggagaaaatatttgtaaatcaaatatctgataagggttttctattccaggtatataattaattgttatagctcaacaataaaagataagtgacccaattttaaaatgggcaaaagatttgaatagacatttctccaaaaaatatatgcaaataaccaataaacacatgaaaagttacacagcctcactagtcatcagggaaatgcaaataaaaaccacaatgaaataccacttcattcctactaagatggctaaaataaaaaagaccataacaaatgctgacaaaggtgtggagaaattgtaactctcatatgttactggtgggattataaaatggtgaagccactttggaaaacagttcagcagttcctcagaaagttaaatttagagttaccatatgatccagcaattccactcctaggtatacacccaagagaattgaaaacatatgtggatacaaaatttgtacataaatgtttctagcagcattattaaaaatagccccaaagtctaaacaattcaaatgtccatgaaatgatgaatggatacataactgtggtgtatctatatgatgggataaaaatttgtcaataaaatgaagtacttatacatactataatctggtgaaccttgaaaacactctaattgaaaaaaactaatgaaaaaaagaccacatattgtacgattctgtttatatgaaatgtccagtgtaggggctggggaaagtgggggcggggtagtgactgctcatggttatggggtgtcttttggggatggtgagaatgttctaaagttaagacagttgtgatggtcacacaactctgtgagtacacgaaaaccactgaattgtacatattaaaggagcaaatttaatggtgtgtgaattatatctcaataaaaaataatgtggtgtaaatctggccactcatggttttcacctcccttttttttttctcccctattgggacaattcataagttaccatgctgctggcagctctggcagaaaatgatggtgacagaaaatgacatttcaggaatggcttttaaggcacgaggagcaatagcctgaggataatcagagttgttaggctactctcctgtcctggaaagtgaaatcaacctgattctgtccatcatggacactggtgacttgagttgttgacgaatgttctgtaaagtttaatatcccctgctacactttaaatacagagcccaatccaccatatctttcaaactcaggctatttcaaacataactgaagtagaacttcaaattagagaaacttgaggccttctgatcactggccagaggggaaaaattgttttttatgacctgaaaatgtatttagtatgaaaagaaaatgacttcttaagatgagaataagaaaggggggaaataaccaaatttgaagttctaggtaaatacaataaggcaactgaatagacactcctttctcctgttttctattaggattataattggggattctatctccatccaatagtgtttctgtacacttcaaaggtaggctaactatttaaaccagagacagaacactctgtattactctttttatattgatgtcctgttacaaccatgttttgtttcgttttgtactagagaaaaaagaggactcaaacttatgttgtcaaatatttcctagacacttttgtgtgtgacaggaaggaaacttgttaatactgctgtctcaggtaatactgcttttttagttaatactgcccttcatccctgtgtttaccccctcgagcttatcctccctgttatctgattggtttgtcaacattctgaaccaaaactctattttttaatggaaagcctaaggaggcactttttcctgaaagagattggtgtccctgattatacttactcagagccttctctggattactgggaaggaacacacctgtgcatttgatcttaacaagctctaaatctatattgtgttgctcaggggttgcctgacagagctcagtcccatggtggaagaaacctaccaacctcggtcttctcagctttcaaaggcgacacctgcctctggcctctctctgcattctccccattatgatgtggttctccagaccagggaagagaccagggggaaacacaaactaacacaacaagctccttctggttctgtgtgtagctctttgcaatttccctgctctggtaggcagcactttccaatcagccctgcagctccacctctgagaattcttcatgaggaacaagctttctttagtcatagtcacttgtataagaagagatgttttccttcatgagttgtttgaaatgcagtacagtcattccttgtgttctgaaaagctcccactaaatgacatcatttaattccaggatgctcagaatacttaataatacctttggttttgtctttgcaaaacaagttttgtgtttgtggaagggaacaaatctgaggagtggcaagcggcgaagaccaaaagcttatctgtgtggaattgctgctgtagacaagaacaatataatcctccctgttctgtacctactaaatcttacaaagggttagaaaaatagtatttcatctgtctttgggtttttgataataccaaataacatcaaatggaagcagtctcatggtttcttcattgctaaactaattgttattacatacttgttcctgtgtgatgttaatatatattcctggaaccagaaaggtctacatggtcaaataaatttgaaacttgcattaaataagaataaattgatttttttctccttcagggtttcacagaatctttaataccaatgtgcttttttgaacctcttaatgcagctctggtaggctgactttctgtgtgtgtgtgattattttatttactgccaatctccttaaagttagtttttatttaaaaattatttgtataaacacctgaactatttgactttttaaaaattccattctattgtgttaatagcacttaacatgcgatctacctctgtaaaccatttttaagtgtacattattgttgactgtaaggacaatgtggcacagtagacctctagagcatatttatcttggttgactgaaactttatggctgttgattagtaactccccatttagtaactccccaattagtaactctccctagccctggaaaccacaattgcactctttgattctatgagtttgacaatttcagatgccttacacaagtagcattatgtagtatttgaatttctgcgactaacttacttcacttagcataatgtcctcaaggttcatctgtgttgtcacatattgcagagtttccttctttttaaagactgaatagtattccattgtatgcaactgtgtatgcatacaccacattttctttatccatttgttgatggatatttaggttgtttctatgtcttggctgtagtgaatagtgctgctgtgaatataagagtgctaatacctctttagatcctgatttcaattttggtgggggatacatacccagaagtagattgctggatcatgtggtagacatatgtttgttttttttaagaaacatctatactgcttttcatagcagctataccattttacgttcccaccaacagtgtggagcggtctcaatttctccacattcttgacatttggtgtctttttaaaaaaataatactcatccagacaggtgtgaggtgagctctcatagtgcttttgacttgcatttccctgatgattagtgatgttaagtattttctcatatacctgttgtcatttgcatgtcctctttggagaaatgtctattcaagtccttagcccattaaaaaaaatcatgttactaggtttttttttcttttttactattgagtagtaggaattccttgtataggttggagaataacctcgtatctgatatatggtttgcaaatattttgtcccattcagtaagttgccttttcactcagttgactgtttcttttgttgtgcatgaactttttattttgatgtagtcctacttatttttgtttttgttccctgtgccttttgtgtcatacccatgaaatcatggccaagacgactgtcaagtggtttttcatgtatgttttcttctagcaggtttacagtttcagatctttaaatgtaaaataataatattgaattgatattttgtgtatgccataaggtccagtttcattgctttgtatgtcacgtccagtcttctcaatatcattagttgaagagactatcctttcccattgtgtattcttggcaccgtttgtgatgaccagttgaccatgtatgcatggatttatttctgggctctttattctactccattagcctatatgtctgtttttatgccagtatcatactattttgattactgtggctttgtgatatatattgaaataggacgtgtgaggcctccagcttttttcttctttctcaagattgacttggctaagaattttagcattttgtctatttatgtaaaaaaatgccattggaactttgataggaattgcatttaatctgtagattgctttgagaagtatgaacatttcaataatattagatcttccaatccatgaacatttgatatcttttcatttgtttgtttcttgttttatttctttttactatattttgtagttttcagtctgctttcaacttcttagttgagtttatttctagatattttatttttttggtgctattgtaaatagaatttttttcctaatttcttttttcagatagttcattgttagtgtatagaaatgcaagtaatttttatatattgatttggtatatatcaatatataccaactttactgaattcattttttagttctaacagttttttttttaaatggagtctttagaattttcaaatatataagatcatgtcatctgcaaacaatgtggacaatttcacttcttccctttcaatttgggcaccttttttccttgcctgactgctctggctaggactcccagtattatgttgaatagaagtggcaagagtaggcattcttgccttgactctaatcttagagaaaaagctttcagtttttcatcattgagtatgaggttggctgtgggctaaccacatatcaccttaattataatatgttgaagtaatttctttctgtttctagtttgttgagagtttttatcatcaaaggatgttgaattttgtcaattgatttttcagcatctattgagatgatcatatgatttttatcttttattctgttaatgtggtgctaattggttttcatatgttgagccatccttgaattctacagataaatcccacttggttatggtgtatgatccttttaatgtgcttttagattcagctttctagtattttgttgaagatttctgcatctatgcatatcagggatattggctgcagttttctcttcttttgtactgtctttatctggctttggtatcagcataatgctggtctcataaaataaatttggaagtattcttccctcttcaagtttttggaagagtttgagaaagatcgacattaattcttctttaaatgtttggtagaactcaccagtgaagtaatttggtcctgggattttctttgttaggaggtttttatgatagacagtcttgcctcttgaatgaatatttatatctcaagaagctagtgttctgtgaaagtttgtgaatgaagttttagattcataccctttaacctaatgtaataattaagagaggagactttggacaaaaagtactggattctatttgtgggtctctaccaattaacttcatttacagaattagcatagtaatacttgctacaaatcgagttgtgaaaatttagtgaaatatatgtatactaacaaacaaaaccccaggcacttaggtggccttaaataaatggtagctattattgtgtataaaaaagttagtttagtcaacaccttttccagcaagaagcaagaatttctttcgtttataataataatttaataaaatttcctaaaatgccttctgcatgatgcaagaatgatgaaattatatgcaatgttcagttcgattttagtggttagcacaatttatggtattttattgtttaggaaagggagagtaaagaacatctattgagagtttatttagtactcataccagtcttagggagtaaaaattatctaaccccacttcactgatgagtatgcttcagtaaattgctaaagttcatggaaagcatattctgtggcaatgttagaattcaaacccaggtcccctgactccaaagccaatgctgtctccatactgccataccaccttctttaaaaatgaacaatttggctgggcatggtggctcatgcctgtaatcccagcactttgggaggctgaggtgggcggatcatgaggtcaagaggttgagaccatcctggccaacatgttgaaacctcgtctctactaaaaatacaaaaattagccgggcgtggtggcagttgcctgtaatcccagctactcaggaggctgaggcaggagaatcacttgaacccaggaggtggaggttgcagtgagccgagatcgcaccactgcactccagcctggtgacagagtgagactctgttaaaaaaaaaaagaacaattaattcttgtgtgtacataatagctctctgttaactaaggctattctattcttcacttgtttcaaataaatatctcccctactagatctcaatacagtggtcttaagtcaatttaatcccagtaatgttttatagtcattttctcagaatttctctcatgttcaggtaaggattacataattgaacacaaaattttatcttgtctaagtacttctgacttcacagggaattgtgataaggagtataactcagtggagatgatgtgggatggtaggtggaatgctggccgtggccttagtagtgatcttagtccttcccctgctttaagtccctgtgtgacccagtgagttactctgtatctttaggtcttagttttcttactatttgctctatctacctcatgggagttctgtgaagagtagattaactcacttttccaactctccctatctgtagttgtctcaaagtggagaatgcatactccagggatgagcaggatggttcattcgggtagaggaggatgacatcaaggaacacttataggtgctttaaaatttgttcttttaaaatttacgtttttagcatatgttttataatgtatggacatagcattacatttatgaaaaccataaacacacaaacatatattggagatatgtgctttttttttaattaataggggtaggtgataaaaatgtcgagggcctggtggcctccaggataaagtccaaattctttagtatggcatttatgtcctctggggaccctccagcttcatttcctcccccattgcttctccttctacttaatgaactgaacatactagtatgttttgtagcttcactgtctttgcttatactactctttttgccagagactcctgaaacctctctcagcctcccaccttccacttgaaagactaatttctcaagactcagcaaaggagttatctcctgaataagccctttcctgaacctctcaggtatgccagatcactccttccttgggcttccactgtactgtacacatgccacctataagctgtgtggaagtgtgcttgtttgatttcatttactagtctgtagatctctgtattactctacactgctataaagatactatctgaaactgggcaatttatgaagaaaagaggtttaattgactcaaagttccaaatggctggggaggcctcaggaaatgtacaatcacagtggaaggtgaagcagaagcaaggcacatcttacatggcagcaggagagagagagagagagagtgcaggggaaactggcaattttaaaccatcagatcttgtgagaactccctcacgatcactagagcagcatgggggaaactgcccccatgatccaatcacctcttaccaggttcttcccttgacatgtggggattacaattcgagatgatatttgggtggggacacagagccaaaccatattaagggcaactgccatggcttcttaaatcttttttgttttagaacctaaaatggtccctggtatgtatttcataaatattgattagctatgcaaatagcaaataagctctgagagtactatagcatgttaaaatctccaggcaaatgttaatagttattattattaacctacgttaaattctcataggtttcagtggaatatctttattaaaaatcttaatcaagtgacgtgagcaaaacaatcctaattgacacctgtagacactggttttcaaccccgggagctttcaaaaatatcagtgcccaggctctgctcataggggttttgattcaattggtatgggatatgggtcaggcatctgtggtttttaaaagctccccagatgattttcatgtgcaggcagggctgagaaccattgtttcaaatgtcatggataggaaaagaaaggtgcttgggaaaacctaaggcagagtgctcttcctgaaaatgcaactgcagttgtgaaagcttctgtctttgtaaggttaagatgtgtccttgggggaagacacacacacacaaattgcagttatttattgagaccagactactaagtcacttcgatgaaaacttgagagcttaagactcgccagcatgggctaagaatagatcacattgcagaaaccagaacagtttcttggaaggaatggctgaagacattgacaaaggctgagcagaggatgaaattgggaagtcacccatcaactatgggggttgggcaacgtgaaaatgtgcttaccatttgcaatgaaatggaaaaggccttggtgagaaggcagtggagattaatgataataagtcatgttgagttttaacaagataacatacaggataacaaaaaggcaaaagtttattaagtcagatcctgattttgcaactaacaccttttttcctccctctctttttcaccttgagactgttacagatagctgagtaaggtgccaaattagactcgaactgcatctcagggtgaaaactgtgagtgagcatcagctaatgttatcctaaagtgtatggaattacaagtttctatgaagatgtttttgagaaaccttattaggattagtgcgtatgttgtcaacattggattttctagagaatcagagtgaatatagctggtacataagcattgttaatttgcatcatggatatcaaagccttcttgatagaaattacctatttgcactgcatactaatttgggcattgctgctctggaattgataaaagtttagcctataaattggctgaagttccttttgtgctaagaaagaatttgctaagcagatgcataatgtgccattggccattgcggttaatttttttaagagaataaatatttccaagcacttaagtgccatgtgttacaaatcacaccactcagggactagttgaggcttcttttttccttgaagtcgggcaggcaggacctctagtggcaatggctagttagcagttagatttagtgctaatgttttagaaagtacaaactgcacttcttttaaattctggttgatagacttcaggttgatattccccccaataatttaagctttgcacattctaattccctggtgttcaaattgtcacaagttcttgctgtgtacatatttcttggaggaacacttttaaagaaaatggcttcaaagattcccaggcaaagtggacacctggacctgtaaaaggaacgctgcccctaagatgtggaaagaggccaacaaatgttttaattggttcttgacttcagtactactgactttttctcacatggcacactgatgcccctaaatacccatttgtcctctgaatttggtctttcaaacaagggtgagagatgattttgagagtgagaagagagctgttctactggggaaaagggcacagggagggagttttgacaggtatttgtggtggccacagccagtgataaagcaaacactgcagctgagttcaggccccactgtgaacgggcctgcagttacatctcactcctctcttctgtcagttgggtcccatggggtccactggcaggacccactccaggcaggtgtccctgagcctctcctaaccacctctttctcctccatgtctttgctctctatgtggcgggggcaagaggggagcaaagggcagtagtggcttgtgtgcaggcagccagatgggagcctgaccttgggtcacaggcacacgaaaggcacagcctactgatgcactatttggcctgtgctgtgaggaggggggtgcagagggagagaggaagagagaagaaaactcctttcttctatctctaacctaggcatctagtgcatttcagtcctgaattctttcagggctcagctgaaactgttacttcagaacccttccctgatcaaggtcaggccttccacgggctttttgtagcttcctgtgcttgtctctaccagcacttattattattaccatgaattacttgtgtaaatatttattatctgtgtcagtggatgataagcttcatgagagcagagattggtgtctgtactatttatttttgtattcttatgcaggaggcctgagacaaagtgctaaataaatatttgttgaatgagtgagtgaggcaacaaatgaatcaatgagatacacaagaacatatgtataagaatgttctttggaaataacctagagtctagcaagagggaaacaaatcatggagatccatttgtttgaatatgtcattgaaaggcatatctcaaaaaatatttactaacattgaaaaattctcagaatgtaaggttaagagaaaaaagtagggacacaaaaattgacatatggtatgattcctttttctttttttgacataaagaaaatacagagaattcttactattcatggtagttatattctataaggtcactacaaacactgaattgcaaatactgaatgattgcacctaggggaaatacagagttaggctcctgcaagcctctggtcacaatatttttgtcaactgatcaatttataaccttgttttatatgtgtttctgtttaaagacaccttcttttaatatatattattgattacttaacattgaaatcatgaccaacagcactgtcacttatgcctgaaagaagcttatctaataacacacgtattttctcaagacacatcacagtcttgctatgctttggacaccagacagtgcttcagctccatgctgcaggcgattttaaaccacaagaccactaacaaaaagcatataaatatgaaaaatatagcactaagtagatcttagaaaagatacttgtttacagtatgagagctgaaacaagaaggagaggcatcaccttgtttgacttcgcctgggcatgtatgcatcagccaactcaacctttttgctgctctgagcatgtgcatgcccacaaataactgaaatgcactgtgagtattgatttgcggttacaattcaattttagcaagtaggggaatttgcaaatacaaaatctgtgactaatgaagattgactgtatgtccttaaaacaaaaaaaatctcagggcaaatctgcccctcgtggtagcgggactatggtgacataaacatttaaagatgtatccttttctttaattcctcaaatttctaaaattaacttgtattattgtataagtaggaaaataaatattatttttcttttattaggaaatggcaaaatgtgatgggcagaatatatatagagaaagggtagcaaaaatttctttggccagctgtggcacagtaagtttaaacgtaaacagccaaaactgtcagtagagtagtttcaaaaacatattgagccataactttgaaatatattttgagccgggcacagtggctcacgcctgtaatcccagaactttgggaggctgaggcgggtagattgcaaggtcaagagtttgagactagcctggccaacatggtgaaacctcacctctatcaaaaatacaaaaattagccgggcatggtggtatgtgcctgtaatcccagctactcggaaggctgagacaggagaatcacttgaacccaggaggcagaggttgcagtgagctgagatcgcgccactgtactccagcctgggtgacagagtgagaccctgtcttggtgggaggtgggggagcggggggagggggaagaaaaaaagaaagatattttgaattctctcttatatgacttttgtgaatggccaaagtatcattctgtagtcaggaacaggctgactttttgagccagggcttcaagctgaacaggagaaagagacataagcatgaacaagacctatctctgcaagcagaggtcagccacttgacaaaggcagtgcaaaggggatggctttctccggaaatccctcgcttcagctactcatcctccacctcctgccaagtctaggttaggttcccctcagcagaatgtccttctctgttctagcactccccacactgtgttgtcattacctgtatatgtctgtgttcccaactagactttaagctctatgagggcaagggctgaatgtagcttgctcactattgaattacattgcctgacacattgctttgcacgcagtgagggtgaagtaaatatttgttcaatatataacggaatgattatgcatcaaacaccccaactgatagcgactcctgtgagaatcgtcctctttaaatataagtcggtgtcagaaacaacgccaaacctcaaaaaagaatattgaagagttcaaatgagaaaattcaaacaccccaacagacagtgcctcctgtcagaatcgtcctctttaaatacgaagctcagtgtcggaaacaacaccaaatacaagaatagtgaggagttcaaatgagaaaatttcagtcttaaaaaatagacaagatttcatatactcaggcaaaaagagatagaaataagaatctgcctacgtgtgaaaggcaaatacaattcctgtttcctttatcttcttacgattgtacaccctgttcaaccatctttgggcttgtgattactgggtagtacactgctatttcttgaagtgtccataaacacagatagcagagctcaattcctgaaatgtgctcctgtttgataaggtggattggactggatcttgttcagcctttaatctacttccttaagcatctgaggatgttccaaactcaaggctatttcagtacctttgtatttgcaatgtatgatgctttaaaatgataactgtattaactttctatggcctttataacaaattgctgcaaacctaatggcttaaaacattgtaaatttattatcttatagttctatttatcagatatttgcccagatcttactggacaaagattaaggtgttggcagggtacattctcttctggaggctctaggagagagtccatttccttgcatgtttcatctgtagaaggggggctgctttcattgtcttgtgcccaccttcctccatcttcaagaccatcaggctgagttcttcccatgctaccatctctctggttccctcttttcattcccccttccactttcaaagacctttgtgtgattaagcccagcaaaataatccagaataaaaaatcttattttaaggccaaccgtttggcaaccttaattccatctgcaactttaacccacctttgccgtctaccctaatatattcacaaattctggggagtgggatgtagacatctttgggagttgatatagtttggatgtttgactactccaaatctcatgttgaaatgtaatctccagcgttgcaggtaggacctcctgggaggtgttgggttattggggtggatccctcgtgaatggcttagcgccatccccttggtgatgaatgagttctcagtctattagttcacacaaatgggggttgtttaaaagagcctgggctgggcacggtggctcatgcctgtaattccagcactctgggaggccgaggcggttggaacaactgaggtcaggaatttgagaccagcctggccaacatggtgaaactccatctctactacaaatacaaaaactagctgggtgtgggggcacgtgcctgtaatcccagctactggggaggctgaggcaggagaatcgcttgaacccgggaggcagaggttgcagtgagctgagatcacaccattgcactccagcctgggtgacaagagcgaaactccacctcacaaaaaaaaaaaaaaaaaaagcctagcatctctcttgccacatgacacgctggctccttttcaccttctgccatgattgaaagcttcctgaggccctcaccagaagcagatgctggcgccatgcttcctgtatagctttagaaccataagccaaaataaatctcttttcttaataagttactcagcctcaggcattcctttagagcaatgcaaatggaagaacacaggggcaattgctctgcctaccaaaataaatgtacacactattatatatgcatacaaactaggaaatatagtcatttatatttatcaggattcaaaatatcatgtccctatcccaactgtctactgtctgtcccctcactgcccctgaaaaaaagaaaaatatcctaagatgcaaacactcaaaccatggaatgaaatactcttggagataaaaaagtcaaatacttctcttgctatgcggatttaagagaaacatctccacagtatcagttgtgtgggagtttatgtgtaggaatctaactgctcatgagttatctccatgaagtcccgctcacagtatgaatagatgggatcctgttataatctgcttactgtttgccttgcagttgtgcatataaattatgtctaaacccttttcttcttaatcattcttctttcagaaattttgtttatctttctaatttgattagacaaggctctcctatcccccactgcttttttaacagcacagagatagcaggaggattgatcagtgactggagatccacaggggtgataagcttttctgtatatttatgtagaaggcaaaacacagcagaatgagaaatatcagattccagatttcatgtcccatatgtccccatccaaccctgtatcatgcattaaacaaataaaaagtaacagaagggcccagcatgttggcttctgcctataatcccagtactttgggagatcgagatgggcagatcacttgagctcaggagttcgagaccagcctcggcaacatggtgaaaccccatctctacaaaaatacaaaaattaggcgggcgtagtggtgtgcacctgttgccccagctacttgggaggctgaggtagaaggattgcctgagcccggaaggtggagtttgcagtgagctgagattgtgtcaatgcacaccagcctgggcagcagagccagaccctgtctcaacaaacaaacaaaaaaaaaaaaaaaaaaaaaaaaaaaaagggagagagagagaggaaataagtaacagaactagcagcatttcatattccagctaccttttccccatttacaaactcctgagtctgaaacatttgttatatttggttttgagtgaaaccagaatcaataacaaatttgttttgcattcattcctcaatatatttactgcgtgaatatggatcagcagggatggtgtgagactgccacactcaagctgggcgtttgtgcaatccacatcaacacttccaatactctcaagcaaggccaataaatcataaagctcatgtgctactgaattcagcacttcaccatcggcaaaatcaatggagatgcttccagaattttcagttttacagcttcttgaacaaatcttttcccctagtccctctctttgtctgtctggctaaggttgaggcatggacactgggtttgcctcctctccatccaccttctccatccccttttgagaaatgaccacgtggttgaggtcgatcttgtagtcaagccaattgtggtttttccatccctattcccagtgaggcaacttgttgcatgtcattcccctggcaaccaagactggttcagtttgggttgattcgatgctagcagaagttttttggggcttctaggtaaagcgtcctcatccttaagtgaaagtctcaaagagtcatctttccccatcccaaactgattctagaacttctgcaggcatcttattatagatctgatgaagtaactgtcctagaagaatcacagggaggtggagctccttccctatccctgcactcacctctccagttatgcaggaatatatgcattattcttttgtttgtttaatcctgtttgagttggagttttttgttatatttcctcattcattcaacaaataattacaactgtctgctgtgtacaggcactgctttaagcaatgtggattaaaagaacaaaaagggttcctgccttccagtaggaagagtttaaaaagcaaataataaatctaataaatcaggaaactcaacaagaacaagataaagaactagagagtgacaggagctattgggggaaagatgagagcagctgactaattttaaatagggtggtcaggtttcacctcattgaaaaatgtgatttggctcacacttggaatcccagcactttgggaggctgaggcaggaggattgcttgagcctaggagttcaagaccagcctgggaaacatagcgataccttatctctactgaaaaaagcaaaaaagaaagtacaggcatggtggcacacacctgtagtcctagctactcaggaggctgaggcaggaggaccacttgagcccaggagttcgagacggcagtgagctatgattgagccactgcactccagcctgggtgacaaagcaagatcttttctcaaaaaaaaaaaaaaaaaaaaaaaaaaaagtgtgttttgagtagacttttgagtgaatgagcatttgtggatatttggagaagagttttctaggcagaggatactgccaacacaaattccctaagttggaagcttgcttgggaatgtgagaggagaaaggagtggtgggagtgaagtgagggagggcaggggttaacagggagccctgtgggtcttttagcccagtgcagaagcattttgtttggctttgactctgattcaaatggggaaccacagaaggcttttgagtagagtgaaaaagatcactctagctactgtgttgggaaaggattttggagcagtaaaggaaggtgcagggagctgacttagaaggccacagtcccatgccaggctggagatgctgcagcagtggtccagggttgtagtgatgaaggtggtgagcagtggtttggattctggatatgttctgaaggcagagccaacaggatttcctgagtataggggaatgtgggagaaaagcaaggagtcaaggatgactccagctgaaagcaacctaaatcattaactctcaaatttacctgacttgattatcagctatttacaactcatgaatgttacataccatggagaagtccaacccaaacacagggttcacacgcaaaccagtaatttgatattgagggctctacatgttccattaatcacatccccctacttaaaatattttccttggctgccttttaagaataaagttattttccatagtctttgagagttaactcaggtaggaccgaagtgatgaccgttctgtcctctgcagcaacgccattgccctttatccttgttgtgatgtggttttcctgtgtcttctgctgctagatgtgatgacgatatccctcctttgttgatggactcagcatctgtacatgggatattttgactccaattttcctgatgcatcatcctaattgtctggtagttactgactgtcacttaccaaccggtgtgagatattcttcagctcttcatcaggaacagaattacagcctctatctttagaaatgatatatgctgaggattattcatgtttgtaattacaaatctagcagaagtgcaattattaaaaaaaaaacccttggaaaggacattttgttgtataacgcagaacctgctgttagcctcttgtgctggtattacttttgttgctgtaattgccacctgcatttcagttgtaatttaacattatctgtcttctctgtatctttctacctgattgtaattgttaggactcctgccatttattcttaaatactttcttgtctttctgaattactgggctattttctatgattataacctaagaaacagctgcagcaacccttgttgcattgtaaaaacttcagagggctggtttatctctagtttaaaaccagtgaagcaaacagtggggggaccttcggaggtcattcacataaaaccatcattttaagaatgaagaaactgaagcttttgagtgattaactaagttgctcatgatcatttacattcttattgttatgctgtactctggagtagcaagtatggatatatattcagagataggatcttttaagtcctagcactttgcaatttatgctgattaaccaacgacctgccaaacagagctcaagatgggaagggaagcgacactaaatcctttttttgagccagatactgctaggtgctttgtatcatggaccacattgatatgcacaataatctgatgaggtaggaataattatgccaatttctctctctctctctctctctctgtctctcacacacccacacccccccccacacacacacatgctgggatttttgggagattaagcaacaggctcaagagcacacgggtagtaactctcaaatagtaagaactgcttgactttccaccctttctctttctaccaaatcaggaacagaataatggatatcttccaaaggggtgagatatgagcatgagctactttttttttttttttttttttttgagatggagtcttgctctgtcgcccaggctggagtgcagtggcgtgatctcggctcactgcaacctccctctcctgggttcaagggattctcctgcctcagcctcccaagtagctgggactacaggcacgtgccaacacacccagctaattttttgtatttttagtagagtcagggtttcactgtgttagccaggacggtctcgatctcctgacctcgtgatctgcccgccttggcctcccaaagtgctgggattacaggcacgagccaccgcacacggccaggtatgagctacttttaaggcagttggaagcccaaagagcttgggaaaccatgaagactaggcctcacaactgcagttttctcaggcctatgcagctgcctccatccttttgctctgagcaaaactggacctagttaagcaatgttgcccaactgttaaaaaaggaagctcaaaactaggaggtaggatgccagataatttgtttaaatttttgatctttaaaatcttgactctttgagcttgttttgagcctcattggtccaaagtggctcaatctgactgaggaaggggttggaggaggaaggaatgtaaaaatgaaagatcggtgggaaaaggatactgccttaggttgtctgtaggtaaataaaggtttgactctataaaaactctcttcctgaaataatcaagaatgcttcacatcagaagcatcaattaaatggctgccttctttttgttaattctttagtctttagctatttctgctgttgctgcagaggcagagagatggtgaaagaatcaacctcaggaaatagtatggaggtcaagggtcagctaagaggatctactgattttctgatctgcggagctttctgagtgagtctcccttgaattgcaggagggcatccaataggaaacccagtatgcaacaatctcaagagatagcctctagaacactgggattagcattaatccatgaaaatgaggtgctataatgatgatgatgatgagactagaacctatagttacatgcattgtgggaaaggtttgaattgaaaggctgaaggagggagtggttgtcttccaagagggtatgatggtcatgctgaatgaagaatgaagtgaaagaagtcagtgaagatgcattaagaccgtaggtcaggttcaagtagtaactcccaagggttcaaccacataatgacgcattgaaggatgtctattacaatcataagaaacagcaaagtggttgagtatagtggctcatgcctgtaatcccagcactttgggaggccaaggtgggcagatcacttgaggtcaggagttcgagaccagcctggccaacatggtgaaaccccatctctaccaaaaatacaaaaactagcagggcatggtggtgcccgcctgtaatcccagctacttaggaggctgaggcaggagaataacttgaacctgggaggcggatgttgcagtgagttgagattgtgtcactgcactccagcctgggtaacagagtgagactctgtctcaaagaaaagaaagaagaaaagaaacagcagagtgtcccatctgtcctgcgagtcctaaggaaactgattaatggcttcaaaagtttatttctcatcaaaatgaacttgattaattacaaatccagattttttagtcctgccccccaaaagtctgattttaccaatgaaaataacccccaggtaattcctgcaagcagcctcactggaaacatctggggtaggtgaccccaacttctgtcattgtgagtttctgtgtgctacctttcttttttggtttttgtttttaataaacagggtgttgctctcttgcccaagctacggtgcagtggtgcaattatagctcacttcagccttaaactcctgggttcaaggaatcctcctgcattgctgggattacagatgtgagccactgtgtcaggctctctgtgtgttccttctaatagtacttctagaacatctcttatttttttcttttccagctcggagattcttaatttgagtttctggggctcaatgaatagggcccaggggatctacaacccccctgaaattacatgcagaatttcacatatatatgagctatgtgaagagtctcaaaggaatctgtggtttccaaagggtttagaacaattgctccaactgttctatttatctcctttctgccctgacccctggagctggttcacagctttttatcctggccagtcttcctggctttagtggacagtacatttgtctttgactttgaaactttacattaactatgagacatagcgtgaaactttggaaagagaggggatcacttctatgtttctattaaaattaatttcctttggaagaatatgcctgtgacagttttcatagaacactgctgtccccattttaatgagaaacaaaaaaattcatccacgtcaccaatattctattgtgtctcttttctcccagaagccgatctctttgctaaaccatcttcagcacagctccagttgaagtcctttgcttgtctgggtcctttgttgccctcccggtgttctgctgtccacagaatatagccctgactcggtagcctggcatctgtgccctttgcaatctgactacctcctgctgctctcctaattgttccatgttccaagctaactgtgctcctcgccattgcccaagccctgtctgtgccctcttccctctgggcctacaggggatgccctccctctcctctccatctgtcaccgtgtacccttgttcaaggccttcatcccatctctccgtcagccagaaatttcctcttctgtgaacatcaattgtacttggttcatacgggtcttatggcatttgttacatattgatttttgtttgattatgcatgatttgtgtttctcttttttcttattagattccaagacctttcatcacagggcctttgttgatttaactgtgtatctggtcaattgcctgtcacagtacctagcatacaaaaagccctcaataaaatctggtgaatgtatttaaaaacctagatagggctattttaattcagaaaaataaatctgtttgccttttttcctggtaatctaagttgggcagttgcacgagaactgcatataaactgcattcaactcttgataaattagaaaagtcatctgatggcttcattaaaatgtgggctttaaaattatttatgatttcatttttcataacatctttgtgagacttgtagtagtgtagtattccccccgtcttttggatggtgatttcactgaggtgagaggttaaagtgggtcattcaaggccacagagcaggcaggtaacaaaactggcactggaaccttggcctcctggggccacgttagcagagcgtagcattgactgcactaaggatggaatacaaatgtgcttacacattgtcaaatcctgtgggtcaaaaagtttgttttagtgaaagcatcacagataatgaagtatttgaaattttctcttttcaccttttggcatgcaggctcctctctctctgttccctaaataaggacacgtctgtaggtctgatcctcagccctgtctgtctgtgaccttctccagtatccaggaccctcggcgatcaatacctgcctcgtggtttcaatgatcatcactctgctgacttacctaacgtctttgcctatggtgatgacccctgcctgctctccacctcacatctcttgtggtttaccagaagtttccacttagaattctgccatcacttcaaaatccagatatctaaatccaaactcatcatctgctctctgaacaaacttactcctttctcaatctacatttttctaccataattctcctagtcatccaagttcaaaatcattgttatctttaacttcctttatttttttaagagacagcttctcatcccactgcccatgctggagtgaagtggtgcgatcatggctcactatagtttcaaactccggggctcaagtgatcctcctgcctcagcctcccaagtagctaggactacaagcacacatctctgcactcagctattttttttttttttgagacagaatctcactctgttgcccaggctggagtgcagtgctgtgatcttggctcactgcaacctctgcctcctgagttcaaacgattctcctgcctcagcctcctgagtagctgggattagaggtacctgctaccacacacaactaatttttgtatttgtagtagagatggggtttcaccatgttggccaggctggtcttgaactcctgatctcaagtgatccacccaccttggcctcccaaagtgctgggactacaggtgtgagccactgcgctaggcctaatttttaaatttttgtagaaatggggtcttatgttgaccaggctggtcttgaactcctagcttcaagtgatcctcctgtcttggcctcccaaaatgctgaaattacagaaatgagccactatgcctggcctgttattttcagctttttaattggctttgtcttattgatacttccttcaaaatgtttatcatgtccatttgagaatctagagtggtttttttttttttttttttttttttttttgccaaggattacctctttctctagagccctccacctcatgcacattcctttctttctattttcattaccacattgtgatctaggtcttctcttcctcttccttaaatttcactggtgttcattttgttacaggatgaaatccatagtcttcaacctggcatacaaaacctcccacaagctgactccagttgatctttccaactttctagtctaatacttgcctctggtaattttttttccaattcttctgttgactgtcctggaatgcatcttacatggccttgctttggtcctcagtttagttcttttattttccagtttactcctttggatacttctcatcttcaaggtccagctcatgtctcatctttttgatatgaccattcctaattatttaaatccatattctgaagttcttggcccttgttgtctacatctttgctgctcaaagtgtcattaaatgagcagcagcattgtcaccacctggaagatggttagaaatgaatcttggggctctgcctcagacctgctgaattcaaatctgcattttagcatgatccttgaagtgatgcatgaaacacttgtctgtcccatttagatacttagataatactcaatccaaacaccaacttatgtacttatctgcactcctcaagatccttgaaatctgcgaacctgttttatttttctttagtatctctgaaacacaatttcatggtaaagtaggtgcttactaaatagattttagtgtccttctctttctttttctatttaaaggaggaaaaaactcccaagactcctagaaagtgagcatgagctgctatagtttgaatgtaacctcttcaaaattcaggtattgccaatgagatactgttaagaagtgaagcctttaggatgcgattgagccattagggctcctcccttgcaaatggaacaaggtcagcaaaccaataggagtgctaaggtaaatgactgtagaacaaaatggtgtttatgtagcttgatggtacatgtaatttcacaattgcattttgtgtctgaaaaacatatgaggttttgctaagcttagtagagaaatgcctgctttgtggcaatgttgtccattagttaaccagagagaaatatgagaacagatgatgtcactatattcttccactagcctaggttcttaaaagctctaagactacaagtgttatagatgactccagcatgcactcatactgctacttaactttcttcatggaaatgtgtcttattctgtcaacagactaaaagaggggcaaggacatatattatataattttgtatatactcgataatgctcaggacatagagcttcagttccttccctccctccctccctcctgcccaccctccatttctttattcctgcctttcatcctttaagtgtttgttgagtgattgagatcaaatattgatatattgtatctatagaatagaatattctattctagtgctattatatatgctggggataaatcacgcattaaaatgaatgtccttctctttatggaacttgcattccagtggagcaaaaagataaacaaaatcataagaggaatttatacttagaggacgataagtactgcagaaaaagattagagaagagggcttggaattggggaggtatactttaaaataaaaagccagagaagaccacctttgagaacataatttaagaaaagacttgaaggaggtaaattatgtagctatctgagggaagaccttcccagagagtggaacagcaggtacagggctgaggtgggcatgaacagggaagagtaagaacggtcttttgggtttgaagtagaaggagcttgcaggagaatgacaggagagatgaggtcagatattacatctcaataggatctctctggctgcaatattgagaaaagccagaagggggacaaggtggaggtgggaagacgaattagaaggccactgcaataatacagacaggagatggtggtggcttagaccagggaggcagccgtggaagaggtgagaggcagttacattctgcatatattccgagagtacagccaacaggatttgctgaaagattgaatttggcatatgagagacagagaggcatccaggatccaggcatttaagatttttggcctaagcaactagaaagatgcagctgccatcaagtgagatgggggaaggctgcggtggagaagtcttttttagggaagattaggaacttagctttggcaatgttgagtttgacatatcttttagacaagtggagatattgaggaggcagttgaatattggtggaatgaacgaataaccaggatcttaatcaagtgtttaactcccttaaacataaatcaactttttgtctacttcctcataatgtgaagcactttgggatgtgacattggaaatcagactcttctgaccaaggcccaggtctgcctgaattccaggcctagagatctgacaatgtgctggccatcttcccttaaatgttctctagagccacaccatgtctaaaatggaacgcactctctttatcccaagcctggtctccctctttgtgactgtggtgagtgggcaccactaggcatgtaagctggcagtcacacttcattccttccatttcctcatctccatatctaattggtcaccaaatcttaccaaccccacttccaaaccatctctagaacccatctcccccctccgtcttcactgctgcttttttggatttatgctctcattgtctctcacctggattatatgtaaatcttctcctacctggtttcccagtctccaatcgatccttcacatagctcccagagtgattttctaaaatgtaaatgtggccatgttactcttctgcttaaaacatttccaaaggctttcttctgtccataaaacccaaaacttgagtttggcctgcaaggatcatcaagatctggctcctgcttatctcttagatttattatcccccccatcccccccgtcactcctatccattggccagattatactacctgtagttagttaacttattcattcaattttcagatataaataggatgcttcatatgttacaagcactatgctaagctgtgggggatacaaagctagacattgaaaaagcctgaaataaacctggttgtcttccttcctacttacttacagtcgtcatacagtaagctgtggggatacaatgctgcattgtacgcagacttggttcctgccctcatgaaagtatactttctcaatttccatgcctttgctctctgaaccccctgccttgaatttaccaccatctgctcctccctccatctcactgccatgtcctccttctcctaccagctacttaaagaataccatctcaacttttaagaatcagcttacatcattcccttgtattaagctctttactctatctccttttctcttctaaaaatgtttcctccctcaaaaggtatcattgaaaaacttaatagctctagaagtgaggatatctctaaatacattccaggttcagttcagaatattgttttatcttatactagaagatcatagctcaaggaatgggatttccttctttatcccaaaagggaaaaaagcctccttttcctggatttttcccatgctccttgggctccacaagtgggataagcaattgttaacttgctgcagagtgagtgaacccaattgcattggattcacacacagtggatgctccaggattttttttaaatatttatttatttatttatttatttatttatttatttatttatttatttattttgagacggagtctctctctgttgcccaggctggagtgcagtggcgtgatctcggttcactgcaagctccgcctcctgggttcacgccatgctcctgccttagccttctgagtagctgggactacaggtgcccaccaccacatccagttaatttttgtatttttagtagagacgggttttcaccatattggccaggatggtctcaaactcctgaccttgtgatccacctgcctgagcctcccaaagtgctgggattacaggcgtgagctgccatgcccggccttcaggatttttaaatagtaaagcgttaggggtggtgagctgattggtaggggtgctaggaaacttgtcttaaagctaagtttgcatagctagcttacaattttcacttagattaatatacatagatttatagtagcttgtgggggactgataaagatgtgggttaaagattccttttaaagccatcccttaatgctaccactgtacagaaagatggcagagtgactgcctttatagacacctgcccacacttcctaatctgccctcagttgcaactcctagagagtaggcacacagcttagggtggaaaatacatgaaaattcagtacttgtaaatagatgggaggtgggtaatgaggatgagcgacagaagaaaaaaccttctatatttgtctgttctcaccacctaaggggttcttcagaaaaccagtgagctttacgctcaggttgagaaatccttgttacagtcactttaattgcaatctctatttcttctctctttttctttctctctctgtgtctctacacctctccctcaccactttctggatatgcacacatatttacattcagatgattttagaaagctccattggggaataactataaattatgaatatgcaacagcactaaaaccaactattatagtcaaaaatcctgaaataaacctcctggttctcttccttcctacttacttacagtcagcacacagcaatatatcttagagtgaggctaaatggatatctgatactcactcgaatgtgataggcagtcaacaacccagttatcactgttgaagcattttaaggactacttccatgtcactctggctatgataaaaaccatagtctccaaattggtacagtaggatgaaccttccatgacgactggtagcatgtgtttgattacacatatgtatacatacatgtacacacaatacacatacctaaacattataaccagattagtatattccttttgcattgtactgaatactttaaaataatgtttcatcagtgattgtcagagttataaaatcatttgaatatattaataagctataaacattttaattttaaaggataaaatatgctgcacaaaagagccagtacagccactgcttatgtgtttaatttatttaaagagatgcctgttctgttattacttcaaatatagttatatctacatgtaagtgattttaatttgctacaacatttagatgtatcaatgagacatttcataaattaaaattgtatcacgtagggagactatcttgattatgaagctttattaggtgatgattataagtgccttgtttaataattataacagcttaatggctcctgtagttatactttataataaaaatttcacatttaataatatggaaagggatggtacacagtgaactgacaaaaaagtattgattctgaacctttaaattggattcctattgatctgatgtatgaatattttattggtgtaaatgttttcagggttgccagtttctattactgcatgttagcaattttactggctatgtataatggacaaattaaatgccaggatatgggcatatccagcaccccacactgattattttgattcacttatcactatacactactagggccttccctttctctgtcccatctctgttctggaaggtgagccacagacttcttctgtacatgcctcagatacatgacaagccagtgatgggtggtctggcttgttatctggtagaggctgggtgggcatgtgtctcttcctgctaaggcccacagccccttagctaagacttacacatttgctccaaggccagtcatttgggcccgagtacctaatggataataacaggggctctgggattaggtagagcaagatggctgaacaaaagcttcaaccaattgtcctccccacaggaacaccaaactgaacaactatgcacacaaaaaagcaccttcataagaaccaaaaatcagcttaggtaccagcttggccacagtggagtagagcaccaagcaggctcttggggtccctgattccaggcctagctcttagatggcatttctggacttgccctgggccagaacggagcccattgcccttctgggagagtcccagtcctgccagcattcatcacaagctgactgaagagctcttgtgccttgagtgaacactggtggtacccaggaagtactcaccatggacctagggtagtggtgatcacagggagagactcctctgtttgtggaaaggggagggaagagtagaagaactttgtgttgaggtatgtgttccagctcagccacaatcgagtaaggcaccaggtatattcctaaggtttctgactgtaggacctggctcctggatggcacctctggacccacccagggtttggggaattcactgccctgaagggaaggacacaagcctggctggctttgccacctgctgattgtagaaccctagggctatgagcaaagataagcaatagccaggcagtggttaccacaggtgttgggtgagacccaatgctgtgctgacttcaggtctgacctagcacagtcccaagggcaatggccacaagggtgcttgtgtgatcccacccacagttctaggcagctcagcacagagagagagagagagagatgccatttgtttgggagaaagtaagggaagagaacaagagcctatgtctggaaatccaaagaattcttccagatcttatccaagaccaccaagtacctctaagagaccgcaagagtcacagtgttactagactcgaggtgccccctaatgcagttatggctacagtgaccaaaaacttagatcacaacactcaagtccctttgaatacctggaaggcccttcccaagaagaatgggtacaaacgagcccagacttagaagactacaataaatatctagctcttcaatgcccagatactgacaaacatccataagcatcaagaccatccaggaaaaataatcttaccaaacaaactaaataaatcaccagggaccaatcccagagagacagagatatgtaacctttcagacagagaattcaaaataactgttttgaggaaatgcaatgaaattcaagataacatagagaaggaattcagaattctatcagatacatttaacaaagagattggaataattaaaaagaatcaagcagaaattctggagttgaaaaatgcaattaacatactgaagaatgcatcagagtctcttagcagaattgatcaagtagaagaaagaattagtgagcttgatgacaggctatttgaaaatacacagtcggaggagacaaaagaaaaaaagaatgaataagaatgaaggatgcctccaagatgtggaaaatatcctcaaaagggcaagtgtaagtgttattggccctaaagaggaagtacaaagagaaataggtgcaggaagtttattcaaaaagataataacagagaacttaacaaacctagagaaaggtgtaaatattcaagtgtaaaaacaccaagcagatttaacccaaataagactacctcaagacgtttaataatcaaactcccaaagatcaaggataaagaaaggttcggaagaaataatataaatagagttccaatatgcctggtagcagacttttcagcggaaaccttacaggccaggagaaactggcatgacatatttaatgtgctgaaggaaaaaaaccttttatcttagaatagtatatccaacaaaaatatcctttaaatatgaaggagaaataataactttcctggacaaacaaaggttgagggatttcatcaacaccagacctgtcctacaaaaaaatgctaaagggagttttcaatctgaaagaaaaggacattaatgagaaataagaaaacatctgaaggtgcaaaaaactcacaggtaatagcacagagaaaatcacagaatattataacactgtaattgtagggtataaactattcatatctcaagtagaaagactaaaagatcaaccaatcaaaaataataactacagccacttctcaagaaatagacagtacaataagatagaaatagaaacaacaaaaagttaaaaagtatgcagtgggggggaatgaagttaaagtgtacagtttttattagttttctctttgcttgtttgttagtctatgcaatcagtattaagttgtcatccatttaaaataatgggttataagatagtattttcaaacctcatggtaacttcaaatcaaaaatcatacaacagagaaaaaatatgcaaaaaataaaaagcaagacattaaaacataccaccagagaaaatcacctttactaaaaggaagaaagaaagaaaagaaagaaggaaggaaggaagagaagaccgcaaaacaaccaggaaacaaatatcaaaatggcaggagtaagtccttacttatcagtaataacattgaatgtaaatgaactaaactctccaatcaaaagacagagagtggctgaatggataaaaaaaaaaaacaagattcaacaatctgttgcctacaagaaacccgcttcacctataaagacacacatagactgaaaataaagggatggaaaaaatatactatgcaaatgtaaactgaaaaagagcaagaatagctatacatatatcagacaaaatagatttcaagacaaaaactataagaagagacaaagaaggtccatatatgatgataaaggggttacttcagcaagaggatataacaattatatatatatataatatataatatatattttcacccagtgctagagcactcaggtatataaagcaaaaattactagagctaaagagaaagatagacctgaatacaataatagctggagacttcaacagtttcagcattgaacaaatgatccagacagaaaatcaacaaagaaatatcagatgtaatctgcaatacagaccaaatgcccttaatagatatttacagaacatttcatccaacagcctcagagtacgcattcttctcggcacatggattattctcaaggatagactgtatgttaggccacaaaacaagtctaaaaaattcaacaaaattgaaattatatcagtatcttctctgaccacaatggaataaaactataataaatcagtatcaagaggaattttggaaaatataaaaacacacggaaattaaatagtatgctcctgaatgaccagtgggtcaatgaagagattaaaaaggaaataaaaaaatttcttgaagcaggtaataatggaaacacaacataccaaaacctacgggatacagcgaagccagtactaaagagaagtttatagctataagtgcctacatcaaaatagaagaaaaatttcaaataaacaatgtaacaatgcatcttaaagaactagagaagcaagagcaaaccaaacccaaaattagtggaagaaaataaataaagatcagagaagaaataaataaaattaaaatggagaaaacaatatgaaagatcaatgaaacaaaaagttgggtttttctttttctttttttcctttctttttttttttctgagacagagtttggctctgtcacccaggctggagtgcagtggcatgatctcagctcactacaacctgaacctcctgggttcaagcaattctcatgtctcagcctcctgggtaactgggattacaggtgtgccaacatgcctggctaatttttgtattttttgtagagatggggtttcaccatgtaggctaggctggtcccaaactcctggtctcaagtgagccacctgctatggcctcccaaagtgctgggattacagggatgagctactgtgcccggccaaaaaaatgattttcttaaaaagataaacaaaatttttgtcagttgacaagacttaaatctaagacttcaagctatgaaactattaaaagcaaacattgggaaaactctccaggcaagtgatttcttgagtaataccttacaagcacaggcaaccaaagcaaaaatggacagatgggatcacatcaagttaaaaagcttctgcatagtaaaagaaacaatcaataaagtgaagagacagcccatttaatgggagaaaatatttgccaacgatccacctgacaaaggattaataaccagaacgtataaggaacccaagaaactctataggaaaaaaatctaggccaggcgtggtggctcatgcctgtaatcctagcactttgggaggccgaagcaggtgaatcacctgaggtcaggagatggagaccagcctgaccaacatggagaaaccctgtctctactaaaaatacaaaattagctgggtatggtggcccatgcctgtaatccagatcttcgggaggctgaggcaagagaattgcttgaacctgggaggtggaggttgcggtgagtcgagatcgtgccattgcactccagcctgggcaacaaaagcaaaactccgcctcaaaaaaaaaaatctaataatcccattaaaaactgggtgaaatgtctgaatagacatttctcaaaagacatacaaatgaccaacaggcatatgaaaaggtgctcaacatcactgatcatcagagaaatgcaaatcaaaactgcaatgagatatcatttcatcccagttaaaaaggcttttattcaaaagacaggcaataacaaatgctggtgaggatgtggagaaaagggaactctcgtacactgttggtgggaatgtaagttggtacaaccactatggagaacagtttggaggttccttaaaaaattaaaatggaactatcatgtaatccagtaatcccactgctaggtatatacccaaaagaaaggaaatcagtatattgaagatatgtcttatctctgtactcccatatttgttgcagcactattcacaatggccaagatttggaagcaacccaaatgttcatcaacagatgaatggataaagaaaatatggtacatatatgcaatggagtgctatccagccataaaaaggaattagctcttgtcattgtcaacaacgtggatggaacacgaggtcattatgttaagtgaaataaaccaggcacaaaaagacaaacttcacatgtcctcacttatttgtgaaagctaaaaattaaaacaattgaacacatgaagatagagagtagaatgatggttaccagaggttgggaagggtattgagggtgcggggaagggacggtgagacagtggggatggtaaatacgtataaaaatatagttagatatttagaattaataagatctagtatttgatagcacaacaggttaactatagtcaacaataatttattgtacatttaaaaataatcatttgtaacacaaagaaaggataaatacttgaggtgatgcatacccatttgcccatgcaataatgcctgtatcatgcctgtatcaaaacatctcatgtaccccataaatatatacacctactacatacctacaaaaataaaaaaaaaacccctggactctggagtcagattcattcaattcaaataatatttattgagagccaaatagcagacattgttccaggtgctaggaacagaatcgtgatcctggcttcatggacttccattctcatgattgcctaggttcaaatcctaactctacctcataacctcaggaaatatgttttactgtctgaacttatctcttaatttgtaccagattcatgtttgttgcaagaatttacagaggcaatgtatataaagcatccaatatcatgcctagctcattgcaagtgtcacttatttttatttttgggtgaaagtctgatgcaagccatatttatgccataaatttaattggatgtgaatatgatctactagttgaaatgactctgatttctatgctttttaatctagtctgagcagcatttatgatacagtaatggccaaaagacaatgaaaacactattatttatcttaataagacaatcctaagccaaaagaacaaagctggaggcatcacgctacctgacttctaactatactacaaggctacagtaaccaaaacagcatggtgctggtaccaaaacagagatagagaccaatggaacagaacagagccctcagaaataataccacatatctacaaccatctgatctttgacaaacctgacaaaaacaagaaatggggaaaggattccttatttaataaatggtgctgggaaaactggctagccatatgtagaaagctgaaactggatcccttccttacacctcatacgaaaattaattcaagatggattaaagacttaaatgttagacctaataccataaaaaccctagaagaaaacctaggcaatactattcaggacacaggcatgggcaaggacttcatgtctaaaacaccaaaagcaatggcaacaaaagccaaaattgacaaataggatctaattagactaaagagcttctgcatggcaaaagaaactaccatcagagtgaacaggcaacctacagaatgggagaaaatttttgcaatctactcatctgacaaagggctaatatccagaatctacaaagaactcaaacaaacttacaagaaaaaaacaaacaaccccatcaaaaagtgggcaaaggatctgaacagacaatcctcaaaagaagacatttatgcagcccacagacacatgaaaaaatgctcatcatcactggccatcagagaaatgcaaatcaaaaccataatgagataccatctcacaccagttagaatggcaatcattaaaaaatcaggaaacaacaggtgccggagaggctgtggagaaataggaacacttttacactgttggtgggactgtaaactagttcaaccattgtggaagacagtgtggcgattcctcaaggatctagaactagaaataccatttgacccagccatcacattactgggtatatacccaaaggattataaatcatgctgctataaagacacatgcacacatatgtgtattgtggcactattcacaatagcaaagacttggaaccaaccaaaatgtccaacaatgatagattggattaagaaaatgtggcacttatacaccatggaatactatgcagccatgagttcatgtcctttgtagggacatagatgaagctggaaaccatcattctcagcaaactatcgcaaggataaaaaaccaaacaccgcatgttctcactcacaggtgggaattgaacaatgaaaacacttggacacaggaaggggaacatcacacaccggggcctgtcgtggggtggggggaggggggagggataacagtaggagatatacctaatgtaaatgacgagtaaatgggtgtagcacaccaacatggcacatgtatacatatgtaacaaacctgcacgttgtgcacatgtaccctagaacttaaagtataagaataaaaaaaaatgtagtcaattgtggtgagtcataggagggatgccaagtgtggaatcaccacagatgccagtcaaggctcaacgtgaccagctgttcagggtgctttgacaatcccaagccttgaaactacctaaaggctccttctgagtcaaatatcaaaaaaatggatcccaaatgactcctaatatgatttctcccagatgctctttctgataactttgtttccgacgttgatatctgatgctctcctaattactttggaccactttcttcctggaagactctatatggctcttatcattgagcagctctttgcaatgaagatgggaaaagacctccactatcttctgttatgatctaaggccctcgatgaggtacccattgcctccatgtatcttcctgggaaggcctttctgaggctttggctggtatcttaatttcttgtggaatatacatactggtgttctggtgctgtgatgtctggatatgttgaggtattgaccataccctggccagtggttttccttttgtttatatggagagagtccctgctctggcaagggaagagatgaagggaagagagggtagaagaggggaggggagggaagaggaggggagaggaggggaggggaggggagggaacaatttactgtgcctttttaaaaagagatcagccaataaaaaggtagattttggagacagacaaatctaaaaaaaaaaaaaaaaaaaagaaatgaaggttccaaattgatcacctaaatcatacagtcctttatcaaaatgcctggaagcctgtctaggctggaggttggctaacagcatacactcagctgacccggggagtactgatttattttcctatgttagaagttaggcctcatctgaaaggcagagagaagggcatcatcacactctatgccctatggactgggattggggtgggcactggagactattcaagagggcatttttgggaaaataggaagagagctcatggtggaagacagggaaagtaccagtagaagccgcattctgacaacattccacaaggagagaagctaattaaaaatgggaacctgacataggccaactaaatgagtatctctggggctgggatctggcagtgatctttcataagaaaaactcccctagataattctaacatagccagaggtaaaaacaacaacaaaaaaccccactactgctccagactagtagttctcaaagtgtaattcgcagaccagcacacgtgggtatttgtagaagtgcaaattaacaggaccccccaccaccccagatctactgaaacagaaactctgagggtgggactcaggaatctgtgtcttaacaagctctccagtgattctgatgcttgctcaagttggagaactactgctctagataagtcataccagaccaaaaaaacaaacaaacaaaaaaattaggaaggtcaggaaggcaggcagggtaaaatggatcagggtggaagtccactgtggtttccttttgtactttagagaagaatgaaaaacgcacattgctcacttccatacaactttggagaggggaaggtatctaacccttcacctttctctctcctaaagctccttcctaggagccattaaatgacagaggcctcttggttccaagtgggttttaggatttttaaataaaatgcagagactaataatgaaatttgttggaccatcagaaaggacagcagatggcccttgtgcctaggagggagggagggagggtaaccgctttccagaccaggaaaaaataaactaagaataaaaagaaaaccaaatgattaaaactgaactttgctttacttttcccttttatttcatgaaagcagtgtttgggcacagtagagatatgttaataaaattgaataatgtctcttgcactaagttttcagtacaagatgaaaactgcataagaacatgttctaatgatgcgttggttttctcacagtaacatccagcccccagaacattctctggcagcacccacactctcctgtcctagtgaataaacctggaacaaagctgaaaatctgaggagctgccgcctggatggggaaggatatgcttgtgaaatgtagcttggctctgttgctgacttagatgggagtacaggaaagtcattagtttctctggccctcaattttctcaagtaggaaatgacagaaaccacccaaatgaactgaaatgtcaaagtgatctccacaggcccaggaagagggccaggtgccatagccaaacaggatagcagaaaatcgcacaggctcatggtgtcacattctggtaaatgggcatgatgaaatttaactaagctgaaaaactgagaagtttagtgatcaaatgtgggccaaacattctatgggcatttttgttgttgcttattttaatggtcttttcctcctcatactcacatgctgtgcaaaaattatataattatataaaaaatatgaattatataagtaaagaaccccaaccaaatctcaactgattttgtgaaaaagaaatatcttttttttgcttactcttaagttctttttatcagaaaacaaataccacatgggattattattttaaacacaagctgcatttaagagaaagtgtctagtaaaccttctggggctgtaaattagctgctaattttgtttgactaaaggctgtaaaatgcatttctgggaattattgtgcacagagaacatcctcctaatacttcagtgggcttgaacagagaaatggaatcctattcagtatacctgttactaaactgaggctactccacgacccaggctcattctatctaactacatagccagcttttctggatttgtgaaagatgagattttgggaaagaacatgagaaacaatgagtcattcacagacacataagtagagatttgaaattggtgttcagaccatctaatcttcacatttcctcctttgttcaatctcattccagtctctgaaattttccaagggcctgtttattactctgttctattcacctactgctatgttcagttactgccccctgtttctctaatggagttttgctttcaagactgggcacaactcttctcaatatgtatttacatttttcatttccttatacaagttccatcattttttctttatgatagttttctttaacctgtttattcatttgtttcatttgttatattttcatgttttttatcctggtccttattttcctccatgacacctcttcttatacttgatgttgttctctagaatgctgttaaatttgctacctgtctctttcaaaatttacctgggcaatggtagcacacaaagggccatgcagacttgccaatattaggctggtttggcctagcatagtacctggcacacagcaggcattcaatcaatatctgttcagtgactgcctgaatgaaaatagaaatgatatcagtagttttttgcaataatcttaagcaaaattataaactaataacttccactcctttaaatgtgtgtcaacttttctgtactaattggaaaaacatctagttcatgtggatcaaaattgagtctatatgctacgtagggcaaaggcatgcctggattttaacatctcatcctcagtgactctaatggtgcctggcacagaggagatgcccaataagtttatatgaaatggcttagaatggactaccttctccatgcgactaatgatctgttactacttcctgaaaggttagccattattgatataccacttctagatgctgtgacaaatggcacagctcagcagcaaaagtactttttaaagtctatgggcctccacaggttgagtttgaaaaggatctgttaatcctctgaaattacatgtgatttatggggagaaagtttacaaaattattaatactcttgaaggggaatatgacctccccccaccccaaatttcagaaccacagtggataatgaaagtttctatgctgtaagagcaattaggaagtcctgaaaaacagggaatttagtcaggagacttgagttgaaatcctaactctgccccttgctggctgggtgaccttggccaagttttaaactctttcttatcttcagtttccttattatgacatggtgatgttaatgacaagtctctagacatagtggttaaacttcaacttgaacccaaatttttctggctctaaagcccaggctcttaacatctatcatcctacattaattaaatgagataactgatgtgaaaatgcctgatgtaaatatttgttaaagcaacaacaaaaaatgtcatttgtcaaagtaacaaagtattttttaaagtaacaacaaaagagacagataaccacaaagaaaaggccactttagaaattcctctttgacctattaaagaatgttcaagttcaaaatatgtttgtcattatgattaaaaatccaaccccaaaacttgggtgaagacggcataatctgttagtttggatatatacagactaaggggattctttggaataccctttgtctagagtgatcttatgacatggtacggataactagactcacctaacattcaaatgaagggctgtgtgtcttctatactttgtagacagaggtggcagatcatctgcttttaaatatagagggctcccattctgctaggatccagagggaatgagggtcctatgttacagatgtccctctgcctgcacaaaaggctgaagaacaagccatcatggagtgtgggagatccagctgttgtccatttccagaagaggagtgaatagtggcttaacagagaggacccttgcctggttctctttggaaatttcacagtagtgaggccaggtgcggtggctcatacctgtaattctggcactctgggaggctgaggcaggtggatcacttgaggtcaggagttcaagactagcctggccaacatggtcaaaccccgtctctactaaaaatacaaaaattagccgggcgtggtggcgtgcacttgtaagcccagctactagggaggctgaggcaagagaattgcttgaacccaggaggcagaggttgcagtgagccaagattgtgccactgcactccagcctgggcaacacagcgagactctgtctcaaactaacaaacaaaaaatttcacagtcgttatgaacagataatatgctcaggtattagccatttcattgcattgttttgacaagtgacaggaattaggtttgctaatgttggaagaaaaatctcacttgttgcttttaacttaaaccttttatggttttgagataggtttattcactgggctggagaatgaaggatttatctgtattagtcggatttgatcagttttcaagtagctactcagtgtcaggcctatacattatctcgtttaactctcttaacaccatggtaaggttgactgtatcataatctccatttatcagataaggaaacaaagattcagagaagtcaccaagttgagatcattgcccagctgcacacagctagtgagtggtgaagctgagacacaaatcagggcttccgacgccactttctattacactttactatgctgtgcattcgtgtaaaagcatgatatttttaaagtggcattccagctgccagaaggatatcaaatcaagtactaaagacaatattattagaaatggaaatctggactcaccaagaaatgtcttcagttctatataataggaagactggtattttgcttgatatgggtgtttcaatatcatctgctcctaaaatgcagtctagacacctcttgtgacctgctcaggtgatactaatgaagtttgggtcatttttagcatctacagagaacagagtaagagtgctgtgtgttcaatactattgcagacttatgggataaactggattttcttgctttactttataaagctaatgcctgattacaaatataagtttaaaacaaacctcaaaatttcttggcacccactctttgtggttggtaacatggacatctgtataaaatacccaagaccttcatagagcaaaagtgagtgggaaattaatttttattgggtatataatcatcactagccatgttcaaatactttttctctaaatcctttacaaagatcttgtaagttgggtattattacattcagtttagactaaacgaaatgcaaaaaaaaaaaataataaagaaaatagactcacaaggtaaagttgcatacttgagacataacaaaattaaatttcattctatgatgctgccacatagcagatgatacaagcagtatagaatacccataaacattatgttttaaggtatttccacctgtatctttcttggggcaggtaaatgaaactcactataaaccagttacaggtcctcctttatctgaggttttgctttctgaagtttcagttacctgcagtcaaccatggtctaaaaatattaaatgaaaaattccagaaataaacagtttattacgttttaaaatggatgtccttctgagttgtgtgatgaaatctcatgccatcctgctccatccctccagggatgtgagtcatccctttgtctagtgtatccatgctgtctgcccttagtcagccttcttggttgtcagattgattggtacaatggacacaaggtattaccgtgcttgtgtctaagtaacctgtgttttactattattacagtctattgttatagtttctattttaatataagttattgttggtaatctcttactgtgcttagctgataaattaaactttattatagatatctatctatatctatcacagatatatctatagatacgtacctgcgatatgtatctatatgcgatatgtatagatacatatcacaggtatgtatctatagatacatcggtatatatatgaaaaaacagtacatatagggtttggtactaaccacagtttcaggcatccactgggtggggatgcgggtcttaaaacacaacccttgtggataagagaggactactatatggaaagtcagagttagagagcttttgtaggttatgtagttcaatcttttgttttgctggtaaggagaagaatacaccttaattttgacttcttaactcgaaaagttaagaaacttgtctaaggtcacagagctagtggcagagcaagccaagcatcagtgtctccaaaatccagctcagtgttgtttgtgttatatcagaatgagtaagagttaagataagaacatgagtcttacagctccactatccatgttcaaattcttgctgaatgattggggaaacttacccaacctctctggacctcaggttattcacaagtaatacgaatataacagtatttgatagagccaattaaatgagttaatatttgcaaaatgctgaaatcagtgcttgccccataatgaatactcaataggtatttagatatttttattcttatctttcctcccaagcccaacctagtgtagaaacttctggaatggttgaattgaaggagaaatagtataaacagtataaaaaggtaaactttttaaaaagagaatcatgaagtagtgcttctacagagattgggggatggcaaacaacccatggagtaaattcacaagacttgacacttaagaatccaagagggctgcatgagatgagtccaggtaggcctcgtagacaaatcttagatggagttaactcaggaagccaaggagtatgagccagtagtcatcctgagcaaggataataatttttctttctgcctgccttcttgccttcttgtctccttgcctaccttccttcctttcttccagctttccctccctcttttccttccttccctatctccatccctcccttcctttcctacctccctcccttctttcttcttccctttcctccttctttccttccttcatttcttccttctttcctttcttcctccctctctcctacccttcttccttgcttccttcctccctccctcccctcccttccttccttttccttccttcctttccttccctccttcttcctccctctctccctccttccctacttccctccctcctactttcttctgtttcctctttccttcctctcttcttctttcctccctctcttccttccctccctcccaccttcctccctttcctcttccttcctctttcttccttctttccttcctccctcccatctccttccttccttccttctttctttccttcattcctccctccctcccttccttttttctctacctccctccctccttccttcttccttttcctccttctttcctttcctttctccttccttccctccctcccttcctgccttccacccttcctaccttcctgccttcctgcctgacttcctttcttccctcccccttccttctttcttgccttcctgccttgcagtcaccgaatgttttttgagtgactatgatgtgccaagacccggtataagggtgcacgaaataaagtctctaccctcaggagcttacttcctagtgggggagacagattataaacaaagacacaaataggtaatatactattatgtggtgaaaaatgctacgaagggaaagtcacagggagcatttttgtttggtttttttttgttgttttatatagaatggtcacaggtgcctctctgaggagcccttggagcagacacctgaatgaagtgaagccacatgcctggagaacaaatattcagactgagataagagtgaacacacacctgcagtgagagagagagagagttgggtgtgatttgcagacctgtaggaaggccagtgtggttgggcagagggagcagggaatgtaggcaggggccagatcacccagtatttgtaaactgaggcatggactgaatgatagggcggcttcattcatccaccaaaccacgtgctgagtaatctaccccaattccaaagcatgaacttgacaactgcttcttcatagtaatagatgaaggataaaaaaatttaaaaagcatatagatgagccaacttttatgtgcttaaagtgaaaacaatcatgtctataagacaaaagaaggaaagacatttgacatgctccatgtacctgagattcatctcgtgttaataaaatgttgaacatattacactattggccggtgtttagtttcagctgaggaactaattcctaaagctgcagcctgggggatggggagatagggtggacactgagacagggcatggaggaattcagatggtatttaccccagaaatatttactgaaattgggaatgctgagtcaagcctagccatgctagagggccttgggaaggcagttactagaatctccttgatttttttccaatttcagaagaagcaacaagaagaaagtgtcttgactaatccttctagtgaaagatattcacttttataataaggtgcttgtctacacagaggtttctgagtcaaaggaggagaacgtacaaaatagaccgaaagaagagcctgcctagctgctctttttcttttgtaattaccaagatcccgacggtttatacccactcaactgcaggtgctgggagaggagaggctactgtgacaaaaattatataaagaagagcccagcagatgcatttccagataaacaatgtaaaacatagtctatgtaagtgccataaaatttcactaataaaaaacacacatggctcagggaaacatttattatcaaaatggaagcaggaaagggcatatgctaagtcttattcatttcaataaatagcagaacgtgaattgataaaagttcttaattgaaaaacagttgctcatttgtagtttgatatttaaaagctttctaaacatgtatttattttgttttgccttgaagtaattagctattagactaactattttcttttcatgtcaggtacacagtggctccaaagtcaaaacaaggttagattggaaggaagcaaacaatgaaattgaagggaaatatcgacacttctcaatcaatgaaaatgcatcagcatgtatgagcatctttagctggcaataatacatcagaaataaataatgttagcaaaagagacagcatcattggctattcatagtatgtattcacggttgtacaataaaattctaaaggctgaggttgaaagtgaataaaaattattagttctaaacacttgaaaattccagcagcttagacatatttttgtatgctttcagtgccccaaatgtaaaacttaaatcattttatgaaaaaaccttgttcaatcttttaagaaatttgcatttcattgcaaagatggaacatagcatccttggctgagttattttctatagaagtcagtgccattttgtggtatatgattagcacattctaaaggcaaagattccagaacgtttaaatttagttgtgaaaaactgaaggcatttatccattcatatataagcatgaaaatgcaagcttcactttctcagtatgtttaaatgccacatattataatgggaattctagaagatgtgatcatcaaactctgatttcacgcttagaaatcaaataaaaaagagactggcctataattagaaaattagtcaagtcagatctaatatcaacacatggttgtcacagaacaaaaaatttttgctttgagaaaaatgagatatcattctggatgaatattctgggtcagtagaaaatagggaatcaaagtatagaaataaagtgtttatgtcactgtaaaacttctagttttctaaaataaaatttaaatatctgaaatagcagtttatacttcatactcatacagtcaatagacattggtagcttaagaaagaacttggtaagtgatgatttaaagagtgatatagattcagtagtattcaatatacagttgtaattgatgagctcatcaaactatggaatttgggatatttacataatatttacattatataatatgggagagatagcaagtatctataaagagtttaaattcccatactaggaaatgtatagtttgttttaatctatgtctacatttaaagtagatttttttttcagagacagcatatagttgggtattgctttttaaatttttaaatctaatctttgtcttttaaattatatttaacgtagttgttgatatggttgaatttatgtctattaccttgctacttgttttctatttatcccatttattcttgtttttttccctcaatgtctgccttcttttggattatttgttttagtattccattttatttccattagtggtttattagttatacctccttttaaatttatttacctaattttagttggtgccacaaggcttaaagtataaatctgtagtttatttttggaggatctttgccccacagattccagtcttaccatgctatttattttttagcgatttgattacgctctggtcaatatgtgattatgtgcaaactgtgtgtgtgtgcgtgtgtgtgtttatcttgcttgaggtttgttgaatttcttggatctgtgggcttagagtactcacataaaacttaaaataaatttctatattcttttttctggtatactgtctatgcactcttaattcatatagtcatgtttttatgtcagatattccattttttgtctttaaataatataccaattaatgtataacgtgatccttacaatagttatacttctatttccccatttttcctgctattgtgataatacattttacttctatatatgacaaaaaaccccatgatatacataacagtgtatataataataacatatttttgctttaaatagctaagtcttttaaataaatttttaaaacgagggccgggcgcggtggctcacacctgtaatcccagcattttgggaggccgagacaggcagatcatgaggtcaggagattgagaacatcctggctaacacggtgaaacccatctctactaaaaatgcaaaaaattagccaggcgtggtggcgggcgcctgtagtcccagctactcgggaggctgaggcaggagaatggcgtgaacccgggaggcggagcttgcagtgagctgagattgcgccactgcactctagcctgggcaacagagcgagactctgtctcaaaaaaaagaaatttttttttaaatgagaaaaagtattttatatttatccataaatttaccacttacatcacttcatttctttgtgtagacctgagtttttatgtggtatcattttctattttttaattaattaatttttttttgagatggagtctcgctctgtcgcccaggctggagtgcagtggcgcaatcttggctcactgcaacccccgcctcccgggttcaagcaattctcctgcctcagcctcccaagaagctgggactacaggtgcatgccaccatgcccagctaattttttttttgtatttttagtagagacggggtttcaccatgttagccaggatggtctcgatctcctgaactcgtgatccacccgcctcggcctcccaaagtgctgggattacaggcgtgagccactgcgcccagctatctttctctggttttcatagtttatggcaagaaacctgcagaatttcttacctttgttactttgtgaagtgtcttttttctctggatgcttttagattttttttttttagcaatttaattatgctgtggttaatatgtgtaattatgtgtaagctgcatatgtgtgtatgtgtgtgcgtgcgcttatcttgcttgaggtttgttgaatttcttggatctgtgggtttgtagtcacaccaaatttacataatttggtagccattatttcttgagatattatcccccatccattttttaatgtgtccttttttcccccaaatatacatgttagactgcttgatattattccacaggtcacttaggctctgctaattttttcactactctttttttctacatacttcattttggatgattctcttactatgtcttcaagttcatgggctttttcttttaatccaaatggtcacattttcatgtcagatattcttaatccaaatagtcacgttttcatgtcagatattctgttttatttttgtctgtagaaatcacatttgggctttaaaaaatatcctcaatttctctcctcatttcatgttttcctttaaatacttgcaaataggtttttttgtttgtttgtttgttttgagacggagtctcgctctgtcccccaggctggagtgcagtggcgcaatctcggctcactgcaagctccgcctcccaggtacccgccattctcctacctcagcctcccgagtagctgggactacaggcacccgccaccacgcccagctaatttttcattttcgtatttttagtagagacggggtttcaccgtgttagccaggatggtctagatctcctgacctcgtgatctgcccgcctcggcctcccgaagtgctgggattacaggtgtgagccaccgcgcccggccgcacataggtattttaacattcttgtatgctagttccattatctctgtcatttctgaatctatttctatttaatgcttttttcctcctcataatatgtcacattttcttgtatcttgtctagtaatttttgatagaatgctgaagattataaatgccaggtcatctggattttgacttccttaaaaaatattaattttggttttggcaggaagccaaacaaaaatccagatctaaagtccaagtttctagatatttgcccctcagcttctagcctgagcctctccaaactccagtctctgtcttctgagtcagccaggaagtaaatccaagctgttttgggttacccttccctctgcttatggaccataaattgcctcctggaagaaacctggggcaattgtagaaatcactttttttgtcttcttcctctcagagatcacagccctaagctgcctacaatctgatgtttgaaaacagctgcaccatatattttgttcagttaaattttttttttttaggccaggcatggtggctcatatctgtaatcccagcactttgggaggctgaggagggaggactgcttgagctcaggagtttgagaccagcctaggcaacatagtgagactctgtctctactaaaaataaaaaaaattagctgggcatggtggcacatgcctgtggtcccagctactcaggagccatctcaccgcagcctcgaattcctggcctcaagcgatcctcccacctcagcctcctaaagtgctgggattacaggcaaacaccactatgcccggctattgttcagtttttttttcttttgttttttgttgtttgcttttgcttttttgaggcagagtctcactctgtcgcccaggctggagtgcaatggcacgatgtcagctcactgcaacatccgcctcctgggttcaagggattctgctgcctcagcctcccgagtagctgcaactacaggcgcataccaccacgcctggctcatttttgtatttttagtggagacggggtttcaccatgttggccaggctggtctcaaactcctgacctcaggtgacccacccgccttggcctcccaaagtgctgggattacaggcgtgagccactgtgcccagcatattgttcagtttttaatgggaggttagggacaaattttgatactccattaacagcccaaagcctatttcccaaatctgttttagatacccttagatgaaataattcttacagaaaccatgagaccttaaatgattaatcataattatcaaagaaaactcctgagcagttaatgtcaaatgtaatatgatgtaagtaagttgattgataatattcgtgtcttgttaaaagaggctactttagtctgctgagatactgaacggattttcctaagggaaggagtatctgatatgaaataccagttaatcatcagtcaccaaccattaattaaatggctactttataaaggacattaaactgagcgctagatggagtatgttgttgcagtcatttcatagaaaagtctacaggggtaattataagaaaaagaaattgggtatttcaaagatctagtcactgatataagtggaatgtgatatcaaatgtgaatcaatactttaaaataatttttattaaatgcttattagatacagaagaatgctataaaaatatatgtaaacttaaaagtagtgcttctgaaactttaatgtgcaaacaaatcacctgagatcttgttaagatgcagattctgattcaggagtctggggtggggcctacctctgtagttctaaaaaaaaaaaatccaggtgaggacaatgtttctgctctgcagactatctttggagtagcaagagtaagagaagtgaaactacaatgatcatctgtgtgcccaccactggtgtaagaaaaataactttatttttatctctaatgtcttctgggtaccccctcctgatcccttccctccctcttagaaatgactacttccctccctcttagaaatgactactctcttgaattttgtttttatcatccttttgcttttcttaaaagttttaacacatttgcttgtcacttcaatatatattgttagggtttgcatatttttgaatgcatgaacctaatataaatggaatcatttgcatatatccttcttcaatttttcataccacattatgttcctgaggttaattcatatcattgtaatcatagtttgtataaacttaatttattttcatcactgtatggaattctattgtatgaatatacataattcattttaccgttgttgaattttgaaatttaggttttatactgccatgaaaattcttgcataagttcctggtgcacacatgcaacacttagtcagattatatacataggtgatgaattgctggctcataaggtatacacattttaaactttagtagattatgccaaattgttttctagagtggttatattgacttgttctgccaccaactgtgtgtacaaatgttctggttgttcctcatctgtattagttttatattgctgcacagcaaattgtcacaaatttactggcttaaaacaatatccacatattagatcatagctctataggtcagaaatccaggtgggcctggatgggttctctacttggggtctcaccagtctaaaatcaaagtttcagctgggctgactcttatctagaggcgctgtggaaaaatctgcttccaggctttttcaggctgttggaaacattcagttattggcagttacagactgaagccccttttcctgctgtctgttagctgctaaggaccactctcagctcctggaggccactctcagatccttgtcccatagccccctccacttatcaatggagaccctcctttgcatcaaattcctctcatgcttaaaatctctctgagttggataaaagtcaatatataaagagctaatgtgattagattaagcatatccaggcaatctcccttttgtcatataatgcaccatagtcacaagaataattccagcgattaaagttatgagggtcatctatagaattctgcctactctagtttactgatagccagactggccccatgattcactactgtttcataggtaaaatatattcaccacttcccaaggttcctagtgctttgattccattacagcatcagttcaaagtctaaaatctcaataaatcatctgaataatctaaaccagatggaatataaaaaggagtcagcaatccaaagcagtgttgaaatccagtggagcaaaactggttgggaaaactccactgagtttcaaggcctgggaataattctctttagctctcagctcctccctctccacttttggtttcaccctctgagtcaactttcttttttcataaagagtagatgaatagttttatctccctgcttctcgcagtagaatttgagcagatgtaagagtctcttttcattttatactctctctgtcccttttggtccagctggtagtatttctgctgatacaattttctcaagaactttctggatctcctgtggatatcacagtgattcactgcatcatacagaacacatgctgacaagtcttttgagataatcccttctctatttttggcttctactgaaatggttgagggacagaacccttaagcccagaggtcctctggtttaactgagaagatctgtgagaaacacccttaatctcctggaagggtagtttgtgtggtaaaatactctggccttttgatatttctgagttttcaacaaagaactgtatagtatacactcagacttttctttatgccactgttttagcagccatttatgacttttagcatccttttgccatctggagaggctgtgaattttctaaattatctactctggtttctgtttaaaagttcttccctcaatttatctctctcctttcacaatttactataagcaacaaggagaaatcaggctgtagctttaacacctttcttggaaatctccttagctatatattaaagttcattgtttacaaattctgctttccacataactgcaagatgcaactttgctagctatttggccactacataacaagactctcccttcctgcatttctaataatatgtttctcacttctttcttagtccgcactgacagcattctcaaagcccagatttttttaacctatttccttatattttaatgggttttctgtggctcatggtggctcatgcctgtaataccagcactttaggaggctgagtcaggaggactgcttgaacccaggagtttaagaccagcctgggcaacatagtgagaccccaacactgcaaaaaattaaaaaaattagctgggcatggtggtgtgtgcctatagtctcagctacctgggaggctgaggtagaaggattgcttgagcttgggaggtcaaggctgcagtgaactatgattgtgccactgtacttcaacctgggtgacaaagtgagactgtctcaatcaatcaatgaatagataaacaaaaaatgaatggaagttcttgtagacaaatatatgtggtttggcttttatttatccaatatgacaagccctaaattttattttatttattattttattttgagacagtctcactctgttgcccaggttggaatgcagtggtgacatcgtggctcactgcagcctcaacctcttgggctcaagtggtcttcccacctcagcttcctaaatagctggaactacagttatgtaccactgctcctggctaattaaaaaatttttttttgcagagaagagatcttgctatattgaccatactgaagccttgctttttaagatgatatttagatcatttacatttaatgtaattatcaatatttttagtttagtttcccaactttctatgtctttttatccaatttattttctcttcttttccttattcctgcgttttttgataagtatttttatgattacattttatttttcaggattggattattagttacacatttttgttttattatttttagtggttgctctagggtttacattattcatcttaacaaataacaccctacttcaaataatataataatatatattatttcacatatagtataaaactcataacttccattttcctcttttatcctttgaatgatactattgtctttcattttacttctaagatgttgtaaacctctcaacaaattgtttacatattttctttagacattcaattatcttttaaaatctttaaaaataagtaagaaaacatgtctcatatttatctacacttttaacatttccagtgctcctcatttctttgtgtaaatcccaatttctatgtagtgtcatttgtactgcctgaagaattccctctaatgtttcatttagcacagatctgccatcaattcatgttctctgcttttgtttgtctgaaaaagccttttttccttcagctctgagatattttttgctggttatagaattcagagttgacagttcttttttcttttagcactttaaaatgctattccattgttttttggcttacttatttttaacaagaagtttgtaataattcttttgttgttctgtgtataatatttctatttttttggctgtatgaaagattttctctttatctttggttttaagcaatttgtctatgatatgtcaaacagtgtttttaaaatattaattctgcttggtgttctctgtggtctgttatctttattaattttagaaattctcagtcattacctgttcaggcatttcttctgtgcatttctctctctttcctttttctacatgttaaaccaggtgatattttaccacagcttgtggatgctctgctcttgtttttctcattttttgtctctttgtattttagtttagataatttttattgtcttatcttcaagtcctctgacatattcttcttctgtgttcaagctgataatgagcccatcaaaggaattcttcatctctgatatattcttccttcatagcattcccattggacttttaatgactttctctctactgaaatttcccaacttttaatgtttgttgtgtatctcttctactggatcttttgttttgttttgtttttggagacagggtcttgctctgtcacccagcctggagtgcagtgatataatcatgggtcactgcagccttgacctaccaggctcaagctatccttccacttcagcctcttgaatagctgggactacaggtgtgtatcaccacacctggatttttattttattttatttttgtagagacagggccttgttatgttgcacagactgttcttgatctcctgggctcaagtgatcctcctgccttggcctccgaaagtgcttagattataggcatgagccaccatggctggctgaccttttaagactagagtcatagttattttgaagcccatgtctaatatttttacctgggccattcttaagtataatttttttgatgtttttatcctttgaaatgagtaattttgttcttgctttttgggctgtatcatattttttattgaattccagaattggtataaaagtatagtagaatgcgatttaaatagtattttcattaaaaatggatacacatgtttttgtgtcaagtaaacattcagaatcttaaagaaaaattgattaatttattctcagaaatgtgatatatagcatacaagataagaagtttgagcaataaataggtcaaaattgtgctgatgaacttcattaaaattttaacttcattaaaaattaaaattttaacttccttaaaaattaaaaataaaatatgtaattcaggaacatatatttctaaagtatcccattatactgaatattttagagtaacagttacaatggtatgtacatggcaagtaaaacagattttgaccttttcttgcaatagtagcaaaataataacaacaacaacataaaaaatcataatggtaaagtagcttatttacaaagtgaccaggagtaacattttatacccactctcacatgtaaagtgataagtggtacagaaaatgtattcagtgggaaatgtgggagagggtactccagagatagcagggagttataatggtctaggtctggacaatcacagcatcatatccctggattataatgattgatttgggaccggtcacagaactcaaacaaagactattagctctaacaagagctgttttgggaccctttgcagttagaactaaagttgtaaaaagataagactagattgacttggtgccattatgtcaccccaaagggtgagcctgaattaaaacagccaaaacacagaaaaatggagtgatggacagcaataagtttctgataatattatttaagtctttggattgagctatgcctaaagatctttttcagttataagaaccagcaaatgattttttcctatttttaaatgtaatttaattatttatctatgtttaaatcaacagataaaattgtatgtatttattgcatgcaacatgatgttttgaagcatgtatacattgtgaaatgactaagtataattaacatgtgcattatctcacagttatttttgtggtgagaacactttacttatactttcagcattttataagaatacaatatattaactatagtcaccacgttgtacaagggatctcttaaacttattcctcctatctaactgaaaatttgttatcttttgatcaacatctccccaattccctccttgcaatcaccttatcccctagtaatcaccattctactctctacttctatgagatcaacttttttagattccatatggtgagatcatgcagtatttatctttctgtgcctttcttaattcacttaacataatgtccttgaggtttatccatgctgttgcaaatgacaggatttcccttatttttttatggacaaatagtactccattgtgtatatgtaacatttttcttatccattcatccatgatgaacacttaggttgattccatatcttggtgattgtgaatactgctgcaatgaacaccaaagtgcagatatctgttttagatgctgattttatttcctttggatattatctcagtggtgggattattagatcacatggtacttatatttttaattttttgagaaacctccatactgttttccatggctgtattaatttacattctctccaacagtgtacagggttctcttttctccaaatcctcactaacacttgctatcttttgtctttttgataatagccattctaacaggtatgaagtgatatctccttatggttttgatttgaatttccctgatgattagtgatgttgagcaccttttcatatacttcttggccattttgtatatgttctttggagaaatgtcaattcagatcctttgcctatttttaaattggggctttgctgtgtttttgttttgctattgagttaactgaattccttatatgttttggaatattaactccttatcagatgtatagtttgcaaatattttctcacactctgtaggttgtcttttcactctgttgattttttcctttgatttgcagctgctttgtagtttgatataatcccagttatctatcttgcctttgttgcctgggcttttggttcatgttaaaaaaaataattgcctagaccaatgtcatggagctttctcctatgttttcttctagaagtttcatagttttgggtctaacatttatggctttcatccattttgagttgatttttatatatggtaggagataaggatccaatttcattcttctgcatttggatatccagttttcccaacaccatttattgaagagactgtcctttcctcagtgtgccttcttggtacctttgtgaaaaatcagctgactgtaaatgtgttaatttatttctgtgtactttattttgttccattggtttacgtgtctatttttatgccagtaccaggctgttttggttactgttattttgtagtatattttgaaatcaggtagtatgatggctccaaatttgtttgcttgtttgttttgctcatgattgctttgtctatttgggaccttttttgatttcatatcaattttaggattgttttttctgtttctgtgaagaatgagccaggcacggtggcttgctcctgtagtcccagcactttgggaggccaaggtgggaggatcatttgaacccaggattttgaaaaattagctgggtgcaatggcatgtagctgtcattcaggctgctcgggaggctgaggcaggaggatcctttgagcccaggagttcaagacagcagtgagctatgattgtgccactgcattgcagcctaggtgacaaaacaagaccccatctcttaagaaaggaagaaggaaagaaagaaagaaagagaaagaaagagaaagaaggaaaagaaggaaagaaaataaaaaaaagaaaggagggagggaggaaggagacagagaaaggaagaaagaaagaaagaaaaagaaagaaaaacagaaagaaaaagaaagaaagtcattggtattttggtagagattgcattgaatgtatagattgctttggataatgtggacattttaacaatattaattcttccaatccatgtgcatgagatctctttctatttgtgtcttcttcaatttctttcatcagtgttttatggtttttggtgcagagatcttttacctccttggttaaatttatttctaaatattttttgtagctattgtaattaggattattttcctaatttcctcttcagatagcttgctttttgggtacggaaacgctactgattttttttttcccaacaaatgatttttaacttagacaaatttacactgggttttatctcctttcaaaaaaatgaggctgatggaaaattcaagagtcaatgttttttttctaagagagaaacagaaaaataaataacctggcattagggtgtagtatggcctggagaaaagagatgctggagatcagcacagcagcaagagtcaggatgataaagagagagagagagagaaaaaaaaaaaaacactaagtaaccaaagataaagtactgagtgggaaaatattacttccaataagggaatctgatccagcacaaagtctgggctctggaggaaagaggcatgagaaagaaaaatataggatagctctttttaagtcaaagacatgaactgtttactccaaattagggcagtgaagacctgagttgcagactgtctggtgatatcttgcctttctgttaggtaagcactagggtggctgagctgagctgctgcaaatgtgacataaccggtttgggactatggtgtgcacctgcttgcgctatatgcatggcatgacccaattgagattatggtgtctttagttggcttgtcctagtggcagcaggtgaggtatccagatctgcacctgaaccgaggtatttgaataagtgatagaggagcaattcaaaaggcttttctgaaagtaagtcagtgagactggttgtgtgatggatgagggacctcaggaagagagaggagtaaatactgatgccaaggatgctagcttggactctggatgaacactgacatgtgtgactttgagtttaacaattgctaaactgtgatcaaaattatgggaggcattacactgaaaggcaaaactcaaagaaaactctaatatagtattagttgaaaagtaaatgggggtaccatgaagataactaaagccatatttggtatacatttaaaatgctagaatatgtcctttggatgtgctgtttgcatatagggtacacagaaggggacttttatcttgttaggttttatttcagatatataatggctctttttgttcccagtgaatttgggatgttctatgtgttgcttaatagtaaaatatttaaatgttaaattattagtatgcaatatgtgttagtataaatcaagtactttcattgaatctctgaagataaatacaaccatgtaatgtttaattttgactgtcttgcaaacgacctgaacatcaattaacaatctaataataatagtaactaacagtttttcatgctcaggcactattctaagtgctacacaatctggtaacctatttaatgttcacaactaccctacgaagcaggtacaattagttctcccatttactgatgaggaaaccaaatcactgggaagttaacttgctgaagtcgcatagctagtaaatagtagaaaccaatattagattctaggcagtctgattccagcgcttaaactcaaacactcatctttactggctacatgttgtatattcacatacacacacacaaaatttaacaaaacacttataaacaaagtactgtgagatctatagataagaacatccagtcttgctgttaggaaatgtggctgggaaaatagaatatttatatgaaaaagataataatagaagacagtgtgtaggaagtgacagatggatggcacagacaaatcactctgcagaggttgtagagaatggggcaggggtaggttacaggacagatggtcttaaactgatggataggacctacctgtaccatctggttcctgcccacctctctaaacttatcttcctgacattcaccaaattctagccacacggaccttctttgtgttcctcaaaatgccacactcttttctgtcccacggcttttacaattgttgtgtcttctgcctggaagactctttctttaaatcttggcaaggctgcctcctttattattcagaagtcagatcattgtgccctctgatatggtttggctctctgttcccatgcaaatctcatctcaaattttaatcccacatgtccagggagggacctgtaatccccatgtgtcaagggagggaggtgattggatcctgggggtgatttccctcatgctgttcttgtgatagtgagttctcctgagatctgatggttttataagtgtttggaagttctttcttcactcttctctgtgctgctgccttgtgaggaaggtgcctgcttccccttcgccttctgctatgattgtaagtttcctgaggtttccccagccatgcagaactgtgagtcaattaaacgtctttcctttataaattacccagtctcaggtagtatcttttagcagtgtgagaatggactactacaccctccttaatgagaacttccttggtgacccaaactgaaatactgcttcactcctaccccagtccactagcctgtttgatttcattcatgacactttccttacctgaaattatctacttgctaacctgcttatggtctgtttctcttcactagaatgaaagctccacgagcaaggatctatgatgcctgtcttgttctcatcttttttattttttccctcaagtagtttctgaagtttctacctcatctacacaatctttctgggctttaaaggctatgagggaatgtccctctttgacttgttttgaagccttgggcctacttatttgtatataagagaatatttttaaatggttctcttctttatatatttaaagcatgaaatgctctgaatatcaatgaacccaatcacatttgggtaatagaaaaggctgttttcttcatagttgattctttttttaaaaatttaatttcttatttatttattttgagagagagtctcattccattgcccaggctgaagtgcagtggcatgatctcagctcactgaaacctccacctcccaggttccagcgattcatacacctcagcctcctgagtagctggtattacagctgcacgccaccatgcctggctaattttttgtatttttagtagtgatggggtttcgctatgttggccaggctggtctccaattcctggcctcaagtgatccgcccgccttggcctcccaaagtgctgggattacaggcctgagccactgtgcccagcctgtagttggttcttttgaaatgttcctctcctttatgggccaagctgatagcatttgctttaccctctccatttcgtatatttatcagccatcaaaggcttttcttattgcttggaacttaattgaatgatgtttttgtttctttaccaacaaatgaacacaagcggctttcgaaaatactccaaaaaacagtgagctgtaggcaagattttattcttcatgtgtgatatattttggtaattaaggagtcaattctttggctaaatgctgaaagaaaaatgatgattattgtgtaggataaagctgtgaattatagaatactttcaactctgtttaaaatctaattaacattaattgttacattaattttccctgtgaaatttactaactgtatacaaaatgatatttaatcttcctaatggaggtctagtgtattcgtttcagtcctattcgtaggaatatgagttgaaatggcaaagttatagttatgttgaaagtaatgaagtaatttttatataaaactaatttattaactatcacattgtaattaattaaaacactcttacttttacacaatgttcctgtttttaaagtacttttgtgtgtgtgtgatatacatatctatatgtacatatatgtggattcccacagcgtcgtatgatacaagcagaaccattaattattatttatccccatacttatgtataatggagtttccatgaggtttaaaaacttcccctgtaacataaggatagtggatcatgaagttcataatttgtgaccttattaagttctaattactagggatacttcttgttttagtttgctagggctgccataacaaagcatcaagatttagtggttaggccaggtgcggtggctcatgcctgtaattccagcactttgggaggctgaggcaggtggatcacctgaggtcaagagctcaataccagcctggcccaacatggtgaaaccccgtctctactaaaaatacaaaaattagttgggcatggtggtgcgtgcctgtaatctcagctactcggaaggctgaggcaggagagaatcgcttgaacccaggaggcggaggttgcagtgagccaagatcgtaccactgcactccatcctgggtaaaagattgagtggcttaagtgatagaagtttcttttctcacagttttgggggttagaagtctaaggtcaaggtgtcggcagggctgactgcttctaaagcctctctccttggtttgcagacggctgccttctccctgtgttttcacacggacttccctctgagcatgtttatgtcccaatttcctctttcttataaggacaccagtcgtgttggattagggcctaccctaatgacctcgcttttgcttaatcacctctttgaagatcccatctccaaatacagtcacattctgaggtactggagattaggacttcaatttatgtattgttggaggataaaattcaaccataacgcttgtgtaaattgtgaagaaaacagtaattaatgtatagcttgttttaaattttctgagtgaatgagttaaagaggctatatgaaatagtaagtgctattttagccaagaaaattatgtctcagcacatgtggtttgtgtttcaaaaatatttcttgagtaaaatgtctgatttatctaatatttttaataatgctataacctttactattttgataatggtagtactacccgacatatattgagtcttaccatgtaccagactgttttaaacatatgccctgtattaacatatttaattattacaagcaacctatggaatactattattgccctaattttaaaaatatggaagctggccaggcatggtggttcacgcctgtaatcccagcactttgggaggccaaggcagatggatcacctgaggtcaggagttcaagaccagcctagccaacatggtgaaaccccatctctactaaaaaaaatttaaaaaattaaaaaaaagagagtaaactctgtgtaagaacgctaaatgacttgtcaaaggttctacggcaattaagtagcagaattggaatgaaacccaggttctcaggctctggaacttttgattagcaggccagtggttctcaatgggtggactctagtttctggctaagatggagtaagaggaaaagatttaccatccaatgtagaacaactaaaaaatgtatctaaatatgtaaaacaatggattgtaagacattggacttcatggaatgaaaggcagtgatccctgcgaggaaccatatagttgccccactttataatcgagagaaagagttcccaggcttgatgctcaggaaggtgatacctgacccctgcagcctgcagttggaacacagcactgagagtccagggagaccaatgcaatcagagtacagggaagaggacaagagtactctgcacagggagcgagaaagagcttcacagacagtcagagggttcccttgaatcatcagaggaaaacagattagtatatacatgtgcagaaactagccatggctggggaaagaactaccgaaggactagagggaacaattgctggaactcatctggggctggaatagttcctgtccccaaatcataactcatgggacattgggtagaatattcagaagaattttgactcggtggggaaaaattagccctacactaaattatgctagttccaccttaccaagcttaaaagaaagacctgaaagggtcaaactgtttccaagttgaagaggaaagggaataaacattcacgaattactgtcatcatcgtgaagggactctggatgtgaatcagtagctacacaagaaccttcagtgtctctgagcatgggaagatgaaaagatttgcttttcatgcaaggaatttaaatttccaatgtcatatatatgaggacaaaatacattagtgtctgagtgttcccagcacttctcctcttcaccccactgaaaagagtctatccacccagattcttcccctccacagctcttcagagagggttctgctggccagattggttcagaaagaaggtattaagaattaccagctgggtgtggtggctcacacctgtaatcccagcactttgggaggtcgaggcaggtggatcacgaggtcaggagatccagaccatcctggttaacatggtgaaaccccatctctactagaaatacaaaaattagctgggcatggtggtgggcgcctgtagtcccagctacttgggaggctgaggcaggagaatggcatgaacccgggaggcggagcttgcagtgagccaagatcccaccactgcactccagcctgggtgacagagcgagactctatctcaaaaaaaaaaaaaaaaaaaaaaaaaaaaagaattaccatgtgaatgatgaacacttcccagtgtttgttgataactgaagtaaagaccttgagatagtgttggaattactgtttggttgctgggtagtatttgtttacctctcacactactttcagatgggctatgttagtcatagctttaaccagattatagatttactgattggatagatgtttactaaaaattaagtgagcaaatgcaaggactagaacaacatagacaatatattctgatttttatttaaaagaaatatgcaaaaaacactataaaattttaccccaaatatacccatcagtataccaaaagtgtaccatgtatgctaacagccatataaaattactaaaaggatatataccaagctattggtaaaaggttatctctttcactggggaccaggattgggcaggtagaaggcagtaggaacatagcaaggagatcctttcactttgtattccgtatattgatgagttgcttgagttaaataaaacaagaattataatttgtcattaaaaaactaaatattaaaaattaccatcttcccagtgtttgcaatttttttttttttttttttgagacaagtcttgctgtcaccaggctggagtgcagtggcgtgatcttggctcactgcactctctgcctcctgggttcaagcggttctcctgcctcagcttcccaagtagctgggactacaggtgtgcccagttaattttttgtatttttagtagagatggggtttcaccatgttggccaggatggtctcgatctcttgacctcgtgatctgcctgcctcggcctctcaaagtgctggaattacaggcatgagccaccgcgcctggcccaggcttcaaaatttttaaacatttaactggaatagtaagtaaccaacaagcacttagaaagtgcctagtgtttatgattcctgccacctcagagagctacatttgtgttcaatcttcggacacttaaatgttttcaatgtatgtaaataattattgttaagattttcctaatttctttgttaaaatggttcatttcaaggttctttagagcttgcatttatttcattttttgtcatgtttcttttctcttagaataaaaaccagcagtcattttaattacccctgataatgttcatgaatactgccttggcctgtcttctggtttggaaccttttcaagggcgaatggatatttgtctggtgttccatgtataacctgtccttgtgccacttttccaatgtggcaggaagggaacaactgtcatctgttctgagaattcagcactgtgtctggcactgtgggaatttacccagactgctttgggggaagacatctgacacttcatgataattgtaattaaccagaaagacactggaattggaggatttgaagggaaatatgacaagggattaagactttgagattacttttggagccagggtgacttaagcacatttaaaaagttaggtttacttatatattattattatattctaaaccataagacattttctaataaggtttctaagaggaacatgtaaacctggatcaaatttaaataaggttactgaaaatattaatgaaaccaatgactgagcattttataaatgagaactgtattgctttaagttggagaaaagctgcaagtaagacaacatatttcttcatttgaaagcttgtgtccttatatgagggacattgacaaatgagtggtgataaaatggtggtctatgtgccataagggcttaggtacataaattaatgttttattaaccataaaaataaggttaaaaggttgaaatgtagccttcatgtgtctatgtaaaaaagaggcagaaaaaaatcctcagcactctagagaagcttagtctctgagcaatcactgcatatactaatatattcacatataatctagaatgaatgttaaataacaaaaatcatgttcgtttttatattttgctttgcctttgggatacgaagtgatggaacgagctcgttaacactgctcatttctggttagaagaacactagaaccacctagtggatttttcatttattgcatgatccctacactttactattgctaaattgttaattgctgagataggccttaaagtaaaatcagtggttataatctctttgtgggtcataatagaaatagtaattgttaatcttcagcagacaaagctgtccctaagtccttgaagggaagtccctgcccaccaaatacttaccaactagcacactgctgcatctagaaaagcacaggcagagttaaacatttggctgctgagatacaccgtgcaactggagctttaaatttcctgtgaaagtcagtgagcaaggtaaactgcagcaattcatctgcattcatggcagagtcaactttcggtgagcaagactagggaactctgcagagcacagccaaggggctacattagcagcttgacctttgtattcaatataaatctgtgggcacacaaactggcgtttctaatcaattttgtttttggagcaaagtagcttatgtggttacagcgtgccctggtcattctgtttcccattgctgaaccaactgggtctccgcatcttggtggtgatgacagatgttacgtatattacattgggatttgggtcagataaatagcaaatattctgggaaaggatactttatgtttttgcaaaaggttataaaataccaaactttagtaaaccctgattctaggccaaaggttaactctttatatctatgatttattaggtatcaaaagaaaaaagtcaggatctaaggggaatggaaaagtttctgctattctaacctaagagctggttgtcttctcctagtaaactaactgttcagcagatgggatgcatcgggctacaaggttggtgctttccagccggcaccgcgtgtgaagggcatgtggttgggctgggctctccaagtctgcatggcttgggttgactataaccaggggaaacacgcagtggctacaactgcttctcctaacaattctcgtttcattctcttctcccacagtgtgaaggaggctaggtggatattctctggggcttgaaatttcacactgcaaattttacgagagtgatgatctcttcctaactctttagaagccaagataggaaaaatttcagtttacaagaataaagcccaatccctcttcttatgttggaatgtccagtaaaatgctaagaaacgggtgggtagaagaagaggaaaggaagaagagaaacagagaggagagtaaggaaaaaatagaaaaggcagaaaaaaataatgtacatgaacaacaacaaaaatagtgacaaacagaatggactatagagataggggagggtagtgaagggcttcagagaagtcaggtgaagggccttcttttcttttctttttctttttcctttttttttttttttttttgagatggagttttgctctgtcatccaggctggagtgcagtggcataatctcagctcactgcaacctctccctccgggttcaagcaattctcttgcctcagcctcctgagtagctgggattacaggtgcccaccaccatgcctggctaatttttgtacttttagtagagacggggtttcaccatgttggccaggctggtctagaactcctggcctcaagtgatcctcctgccttggcctcccaaagtgctgggattacaggcatgagccaccgtgctcggccagggccttcttttttaaagaaaattttattatgctgtgataagaacacaacatgaggtctaccctcttaaaaattgtgtgcataatacaatactgttaactagaggcacaggttgtacagcagatccctagaatttattcatcttgcataactgaaacttcacccctgttgattagcaatttcccatccttgcaccccagtccttggtaaccaccatttattctactctcgcattatgtgaaatggactattctagatacctcctcaaagtgcaatcttgcagtatttgttcttctgtgactggcttatttcacttagcataatgtcatcaagtttcattcctattatatatgtcaacattttcttctttttaaaggctgaggctgagtaatattccgctgtgtgtgtgtgtgtgtgcgcgcgtgcatgtgtgtgtgtatataatattccaatttacgtattcatccattgatgaacattttggttatttccacatcttgttttttttgaatagtgctgcagtgaacagtgggatactaatatttctgagatcctgattttagttttttgtgtttattttttttgagacagggtctcgctctgttgcccgggctggagtggtggcgccatctcggctcactgctgcctcaatctcctgggctcaagtgatcttcccacgtcagtctcctgagtagctgggagtatagaccaccatgctcagctaatttttgtttattttttgtagagacgaggtctcactatgttgcccaggatgatctcaaactcttagactgaagcgatcctcctgtctcagcctcctaaagtgctgggaatataggcatgagccaccatgccaggccccagtttcagttattttagataaataccgaaaagtgggattgttggatcatctggtagttctatgttttcaatatttttaatttttcccagcttttttgaggtataattgacaaaaattgtatatatttgaggtatactatgtgataatttaagttgtgaaatgattaccacaatccagttaattgacacatctgtcatctcacataattaccatttgtgtgtgtgtggtgagaacatacaatatctactttctgagcaaatttcaagcatgcagtatggtattattaaccgtaattatcatgctgtactaatattggatccctagaacttaattcatcttacaacagaaagtttacatcctttgctcaacatctatttctcctacctctggatctctggtaaccaatttctactctctgtttctaagagttcaacttttttagatttcacatataagtagaatcagacagtatttatctttcttcatttggcttatttcttttagcatgatgtccttcagattcatccatgttgttgcaaatggcaggattttcttctttttttaaagactgaataagattttctttttatgcatacatattgtctttatccattcacctgtgatggacacttaggttgtttccataccttgactattacgaataatgctgcaatgaccatggggatacagatatttcttcaagatacttatttactttcctttggatatagacccagaagtgggattgattttattatatagcagtgttgttcttcactttttgaagaactgccatactattttccatagcaacagcaccattttgcattcccacaaacagtatgcaagggttccaatgtctccacaacttcaccaacacttttctcttttcctcggagctttttgtctgttaaaccccagcttcccccagcctgaagcatagttgacaaagattgtatatatttacagcgtacaacatggtgttttgatatatgcatacattgtaaaatgattcaatcaagctaattaacatagccgacacttcatgtacttatctctctttttttttttgtgatgagaacattggctttttgatagccatcctaatagatgtgaggtgatatctcattgtggttttgatttacagtttcctgattaggtgatgttgagcatcttttcacattcatgttggccatttgtatgtcttctttggaaaaatgtcttttcaggtcttgagccccgatttaattaggttattagtatttttgctcttgagttttaagagttccttgtatatttcagaaattaaccccttctccattacatagtttgcaaatgttttctcccattctatggtagtttttttcattctgttgtttcctttgctcacagaagcgttttagtctgatgtagtcccatttgcgtatttatgcttttgtcgctgtgctcttggtgtcatatctatgaaatccttgccaagatcaatgtcatgaagattttcccttatgctttctcccagtggtttcacagtttcaagtcttacatttaagtttttaatctacttggcattgatttttgtgtacagtgtaagatatggatccaaattcattcttttgcagttggagagccagttttctcaacactatttgttaaagaaaccatcttttgcccattgtatattcttggcacccttgtcaaagatcaattgatcatatatacgtgggtctatttctgggctcctgattctgttctattggtctatagtctgtctttatgccaataccaaagtgatttaattatggttgctctgtaatgcattttgaaatcaggaagtgtgatgcctctagctttgttctttctcaaaattattccggctactcaggggcttttgtatttccatataaattttagaattgttttgcctatttctataaaaaatgccatcgagattttaataggaattgcactgaatctatagattactttcggtagtgtggatacttccacaataataagtcttgcaatccatgaaccaggatgaagggcttctatatatagggcatcagttctcaagattggctgctgggcttctcagagcccatgaagataataatgagacactgttagttaattttaatattttaaagtttgatattctatcttttaacgtttacaggaatttgaaattgtatatttatgtgtgtacctatttgtttcatggctctatgaaggcaggaccatgtctcttttactcaccacagaacaactagcaccactgttgtgcagtagagcctgatggttagagctgcacgcatgggcagacctcccggtttgccatcctgctgcgaccactgactaccaatggcacatataccaccaattggctaggctaacaaacattccaagccccattttgccttgttgccttccattatagaggcttgtacaagaaaaaaaaccctacattttactttcccactctcatgctgctgggggatggtcaaaggacacagacttggccaatgaggggttagcagaaagctggcgaaggattctggaaaggctttgaattcctgctgaaaaggaaaaatgcagttgacagatgacactaccctctctcttcttaacttaaacgtggatgtgatgcttggatataggtccgccattctgtgcttctgagggaaagagtcagtcaattctcagagggagcagctctaacaccgtggagccatggaatgaacactaggaacaaatgacctcccagctgattgttatatgagagaaataaatgtccatttgtttcagccactgtacatagggctttctgttctttttcagcaaaacgctcctattacagcagttttgtgacttcaagcaagttactttactctgttttaatgttcccatttaaaaacagggattataccaatatcgtcctcatagggttgtttgaaagactaaatgagataatatacgtaaagagcacagagtaagcactagatagggataaattactatttttattactattttgatgatgggctcttaataagtcttagatgaataagtggagtaggtcaaacccaaagggtatggcttcaacccaaggcaacccaaggcaacccaagataactcatttttttctgtttgagaaaaatgagaaagggtggagaaatgagaggaaggtggggtgcggggaaggaggcagggctaaagtggagccaggtgggtgctgggtgggggggaaaatgccctatgaaaatctcccatggtgaatggtcaatgtgttggggccaacatattggccatgtgtggtccaggcatgccagtatcaacagacactaaataaacattttttttttttggctcattgaataaatgaatgcattgtgagggtgttcattaacaaagaaattgccatctcatccttaaaactgaagagatagaagtgagagggcagaaggtttttctccagtgtcactcgcacacctattataatatttgcctggaattatgtgggtgaagatgcattgctcaataattgcctgtgccctcgcaaggagcagaggagaacatccggtgggagcagaagcagaggcagaaagaacagatttcccacggagtaaaatattctgttctcataaaaagtcccttgctgtaacaaacgagaaaatgaaaaggagagcctgtagaagagaggcagacacctcttaataggcacatctctccaaagtttcccaccaggggccaactgttcattaaacagggaacaaatgcgggagcgtagctgtgatgggctccattccacagcccagtgctgggactgcagtgcgctaggaagggcgtcgctgttgttgctgtggcccggtgtgacagcaggtctggcatgtcagaatcgccctgcacaaatagctcctgtgcagctgctctcacccaaacctgctctgaggaggctcagtgcattctaatccttcctaaaaacatggacagaaagcaatggaaagttgacatgtataaaaggtttagtcatggggtttttaagtggatgcctccatgaaaggatcaactcagatggccacgtttctgaacattatttacatcaaaacctgacataaatgcctcagatctagctattttcttcctctatcctctttttacatgtctccttttccctctcgattgctttagcttgtaacctgcatgcgctttcaaatgtggtaagcaaatagaaagcaagacgccatttgaatagtgaatggacttgtattcctgtttaggaatgtgtagttgcccttgggctttctcagttataagactcataaaataaaaccttaacacagatggaacacacacacacacacgcacatgcaccacttaaagcagatgtgagtcaaaaacatatgctgatgaactcaatttgctgatggcattctgagcagtgagcccactcagtagggctgaagggttggcatagcaactcttcctgggaaaaaatagacagctggaataaaccatgacgatgaaagtcttcttccaatgactgaagaagtagagagaaattgccatctcttctaaccccttcaagcaaagcaccttggttgaggtttatagactaggatcttacaaattagaagttcatgtattttcctaggtcagattctataccttgggttatattccagctaagaaacactttcagataggctgcatggggctgtggggaaagagagagcacaaacctccaaaaagcatggagctttgaccaaagtttatttctgtaacttatcctaaggctatgccgagtgaagacttgtttactctagctgtaacttactccatcacatagcaccattactttgagaaattaacatattcattctcaattatttatcaagtatccagcactagcaatagggacacagtccctgcttttgagggattcatgactaggcagacagcaccctgagtatattaattaagatctgatcccatattagaataatatgcacaagagacttattacctctgtctcctcattcctataaacatttatctgggacctatcttatgtggactgtgctaggtgcaatgccaagggataaagcaagttaaatggcaacagtcctattcgacaggccagggactcaggatcagactcaggaccctttccctcttgttgcaaatcctgctatgtgtgggctcagccccaaactgtctctgaaatctcagaaatgagcaaaggctaaggatgtcaaattggctttgagatatgcctgtagactgataacaatagtgatgatgacgatgatattagttaatacaataaagctaatactgtgctattattaccaggcactgttctaagtactttaaataacttatttcatatactcttctgtcatttagtatgcataccattattctccttcccattatccatatgaggaaagcaaggcactgagttaaaacgactcacctttaactgttcatctatcaggtaagctaaccccggagcctacataaattcttaactattaaataagctatgccacttctcaaccactctgctgaaaactatacaaactgacaggtcctacaattaaaacccaaaatagatataataaagcataaaaaatcagttaggaattttctcttgcttttgctctgctgttattgttgttctccagataagtcccattttaaaatccacagtcaccttaaggatgtgatgtgggagctggagctgtctgcctacccaccagctatttttaaaggaagatgatcaggaactagttatgaaagaatcagattgtttaatctggtaccacagaacttgagaaactatagacttggtaagttggaaaatatgtaggcagaagtgatgtctctatggaaacagatgtgaagattcaagtaaatactaggcctgttggactttttatgaagatagcagaagcttttttccccacttcttcttctataacctgtttattgaggaatctgaccatggtgaggaacaagctagagacatatttttatctctagtcactgcttccaactctgctatgtcgaatctcccaactcttctagacatctctcaatgacatcttggacaggaaccatagtcacttacagtctagtccagccttatagcatatgcaactgcatatccagttcaagattttccattgctccattgatggctacacttattactcaaggatctactgtgggtgtgcttaggggtaactctttcaccttggagagtggtgtgggaatgttcttgttctagtatacttcatcccaaagacccaattcctcctgttttggggactgggagagaagatgagatggcttaatgtctcttggctttctctattgcttttgctgtctctctagcataccctagcgaccactgagactcttgtggggcagagatccacacgttatctatcttagggacatgatgggttcttcgaagtccctcatgagaggcgtgactctggctcaaacatgttcagcccccttcagctgtccaagcccccccaccctctatcagctctaactacactgcttgcatttttctttcctggtgggctgctttactggcatgtggaggagtgctgatatagcaggaagagttttgctacttcttattaagtcctgaaaaggtatctggtgggtgctgtgtttgtaataagatacttagcacctgtttcccctcgagctttgggcctaggtatcagttctcagacaaaaggaaaagtcaatttttataccctattataatgataaactttgattgaaactttggggataagaaagcatcgagatgtttctctctccttctattcctcttttctcctccctccctctctccctccttcctttgctcccttctttccttcctttctttcttccaaatagcaaccatgtaatctaaattatgaatgataaaaaagcctggcaaatcaatgagagaacttagagcaaaggaatttggaatattataagatagggaacaattttagtttcctgagcattttggttgtattaccacctgctccaatcatagactgtactttttcatgcccagaaaagacttctacaacccagccttcatagcaatcagccactcgggactttcttgcagtctgagctcaacctgtcttattttgctctgagttttccagttctgaaggcttgattactggtccaagagtgtcatttaggtagatatgctgaactcacatcatcctcgttacaaattgttatggaaaatcccaaaaatataaaagaaaaaaattttaaaaactagctaagggcactgttcacatgctgcaagatctcacggaggagaagatggaatgagtggaggatacacttgctgtgtgttcatcattgaagaagggaaagagcttgtgaaatgacccctagcagaaactcactggtgctttcaagttcagggtggcagggttgaaggtgagagttagcttcagggaagatggtggagaagaatgtttgctagtatctggaccccaaaggattacacaggatgctggagcctgcatgggctaggaataccattagttcaatcatggtctacacttggcaaggaagatgcattgagaataggtgaagggcatagtcaagaccaatgctaactgtcattccttatggaggaattatggaatctacttcaggctgccatgaaaagcaaagcagagaatctgttgggacaactcgttcagcagcctcagactacagctgcatctttacttatctaggcctctagatcactcagaagtaaaggaaaatttaaacaaatctaaacattctcattctttcactggggtcttcaaagttttgaacacaatctctcagaagaatcaatttctgatacctgaatctttgtaagcacgaacagagagaagggactggacagatgaaaaggatttgtagttcaaagaagagggccattgtggggaactgatgctgagctctcggttctatgccccccagacttccttcttcagttacggtccctgcagaatcagcatccatctgcgactctcctttattcattgaactccttgttttggagaggagaggcatattttctactttatgtagctctccagcccatgatctcctgtggtcaggggctaaggattcctttccctgtttcctagtaatgcataactctatctctccataaggcagggtgggccaggcattcagaaagttggggaagctaggcagaatgtgaaataagtgaagggaattgaagggtgctggaaaacctcccatcaaaatttcctcccccatgttattccaccattaggtaattagctccctggttcttaaaggattacatcacttttctttgttaagagttgagtcatctatgcaaaaaaaaaaaaacaaacaaaaaacccaaaaactgagtgaattaaaaccagaatccttattagttattacctcaggagctttaacagtgtcccacttcaattagagcaaagctcactgggaatgtgtgtaggataaagaagatgttggaggtaatagacattaaggaaggggccaggagcgtggagggaacccaagagacgtgggaggatctcaaaagtgatctttgcctattgccaactgtgactgaggccctggcccatcatttgatgttctctgtcattcttgggagaggcagaggagtgtgatgattaagagcatggactctaaagctagacttctgggttcataaagggtaacagcttagctctgccccttcctaccttggggactttgagcaaataatttaaccgctctgtgcttttttcttcatttataaaacaggagtaatattggtccctgcctcaaagggttgttgtgaggattaaaggagttaacacacataaaatacttagaagagcacatggcatagagtaaatgctagttgttattagtatgctttcaatttcacaaagggacttaaaaggtcagaacccttacttactcctaggaaccactggggaaggagtgaggaccaacatatattgcatatgtatgccccagatactgtatataaaatatctcattgaaacctcacatattgatgaaataggtattacaatatccctattttgcaggtgagaaaactgtgtctcagagggtgagaatctggcccaaggtaatacagctaaaaagtggtaaagttatctatgatatcccacaatgttacttacacagttctctttggaaataaaaatataaacaaatggtacaggcagattaagaacaactccagcattattattattattattattattatttttttttgagacagggtctcactctgttgcccagattggagtgcagtagtgcgatcatggctcactgtagccttagcctccctgggatcaggtgaccctcccactttcaagtagctaggactacaggtgtgagcttttgtttttttttttttttttttttaatagaaacagggtttcaccatattgcccaggctggtcttgaagtcctggcctcaagtgatccacccacctcggcctctcaaagagctgggattacaggctccagcatcaaatgtttacagtagttgtcctcacagaaaatgcatacataactcttatcttcctgactcaatgctcaccttcacctcccaccctgactgcagcctattatccctgcagtcagtggacttttaatccagataccttggctgagcaggctcatagaggaaactggcccacagaaactgtgagaaataaatgtatgttgtttgaagctgctaaatttgtggtaatttgttatacagccataaaaacgaaaagaccaaacagtcatatcctgaatgattaaaaattggttgcataagtaaaagaatgtatttgagttggaagatttggggttttcacatgaaaaaccaagtgtgagtaaaataaccgcagaatagctattttggaattctgatactcaaacacttgctagttgaaggagtgctaagattatggatataacaattgattctagggtttcaaaacttatttcccataacataggaaagctgaaactctggctataaagaaaaggctatttttctttctcttgaaataatttgtactattcattgcactgtcaatagccaagaacatgctagaaattacaacgtgctcgcacatatgggtatttctgctatgatgcaacatatatgtttctaaaattcattttgttttgcaaaatcaaccaatagaaaaacaaaggacttataagaaaaatagggttggggcacaatagtcacaaactgtcagtaacacaaaacaaaaagataaaatctaatcaaattgtggtagcacagtcttacacaagtcaaatgggtaagaaatatgtaaatactacaaaaataagacactttcctttgacaaagactttacatttgcttgtggaagtgggagtcagagcattgcagcttgtgagtttttgtgaaattgtggaaggaaggtgatttgaaatcaagggaaagttgtatcactgatgtggatggatatggcccatgttgagggtggtggactgaggtagctgacatgtttcaggtacgtgcatgtctgttttgtacatcttacctggctgggttcaggtgtgtgcaattttctgtgtttccctagtgtttttcatagactaaacagtgcataagcaaccccaaattcgtgttatgctcaaaatgttctctaataaaatcttgtgtcttgaaaacaagtgttaaaaagtaaaactgaccagatgttatttcatttgaatcttacgataaaagcaataaatagacatgaggaaacagctttagacatagagctagtaaacagtcaaggcagattgaactgaggtcttcctcctctgtgcttttcccattaggccactccaggaatgtctcagtctagcatattttaaatctgtgtgatgctatagtttcactactgcaatttctaagactttatattttcaattagacatttattttactaccaagaagtatcctgatccagaggtactattctcccagccatggagagttcctccaaaagacaaaattctatctttgctaatgaaaatgcaaataaaactgtatcaagagtttcatgattttactaggtatttcccatcatatgtttatcatacagctcaaaattgatgtcaagttttttactctactcttttctcaagttcattcactataaattgaatttcatttttctgcacttgggttgtattttttgaaccactgactttgcttatattagttttactatgatattcatcaatttgtttaaaaaaattcagaagatacctcttgcacaaattcattttataatttaagaactcacttcagaatgttgagactctgttaagtatcaattctaggattatgaagatcctgtctaccacaaagagccccacaaaggtcttttctccctcattcccaagcagtttaacttaatgaattcttctggtagaactttgtttagacggacttaaagcaggtaagagttctttttaaaatacttgtggagtgcatgagtgtgcaaacaaacttaaaagcacatattggctcaggaaagctgaggggaaatgataattttcaacagtccaaaatagccatcctggggcttacagaaagtaaggtagcaattagcctaactctaagcctaacaataacacagtcattaatcctgggtgcccagacacattccattagaggattttggcaacaaaattttgcttttctaattctgagtagatataaacaataatcccttaatttattagtctgtttatcacacttattaagcatttcctatgtcttaagaactgtgccacaagacaaggatgccctctcttaccactcctattcaacataatatgggaagtagacataaacaataattccttaatttattagtctgtttatcacatttattaagcatttcctatgtcctaagaactgtgccacaagacaaggatgccctctcttaccactcctattcaacataatattggaagttctggacagggcaatcaggcaagaggaagaaataaagcgcatccaaacaggaagagaggaagtcaaactacctttgtttgcagatgacatgactgtatatctagaaaacctcataatctcagtccaaaagcttcttaagctgataaacaacttcagcaaagtctcaggatacgaaatcaatgtgcaaaaatcactagcattcctatacaccaacaacagtcaagctgagagccaaatcatgaactctcattcacgactgccacaaaaagaataaaatacctaggaatacagctatgtagggtggtgaaagatgtctataaggagaactacagacttacaaatcactgcccaaagaaatcagagatgatacaaacaaagggaaaaacaatccatgctcatggataggaagaatcaatattgttaaagtggccatactgtccaaagcaatttatagactcaatactattcctatcaaactaccattgacactcacagaactagaaaaaaactattttaaaattcatatggagccaaaaaaagaaaaaaatccagaatagccaacacaatcttaggcaaaaagaacaaagctggaggcaccatgctacccaatttcaaactatactacagggctacagtaaccaaaacagcatggtagtgacacaaaaacagacacagagaccaatggaacagaacagagaatccagaaataagactgcacacctacaactatctgatcttcgacaaacctgacaaaaacaaacaatggggaaaggattccctattcaataaatggtgctgggataactggctagtcatatgtagaatattgaaactggatcccttccttacacgatatacaaaaactaactcaagatgaattaaatacttaaatgtgaaatcaaaaactacaaaaaccctggaagacaacctaggcaataccattcaggacataggcatgggcaaagatttcatgatgaagatgtcaaaagcaattgcaacaaaagcaaaaattgacaaatggggacaatttaagctaaagagcttatgcacagcaaaagaaactatcaacagagtaaacagataatttacataatggtagaaaattgtgcaaagtatgcatctgacaaacgtctaatatccagcatctataaggaacttaaacaaatttacaagaaaaatacaaacaactccataaaaagtgggcaaaggacatgaacagatacttttcaaaagaagacatatatgtggccaacaatcacatgaaaaaagctcaacatcactgatcattaaagaaattcaaatcaaagccacaataagataccatcttacaccagtctgactcttactataaagttaaaaaataacagatgctggtgaggttgtggagaaaaaggaacacttatacaccgttggtgtgagtataaactagttcagccattgtggaagacactgtggccattcctcaaagacctaaagacagaaataccactcaacccagcaatcccactactggttatatacccaaaggaatataaatcattctattataaagacacgtgcacgttgcatgtgtatgttcattgcagcactattcataatagcaaagacatggaatcaacctaaatgcccatgaatgacagactggataaagaaaatgtggtacatatacaccatggaatattatgcagccatataaaagaatgagatcatgtcctttgcagggacatggatggagctggaggccattatcattagaaaactaacacaggaacggaaaagcaaatacctcatgttctcatttataagtgggaactgaacgatgagaacacatggacacaacacacactggggcctttcggagggcagaggatgggaggagggagaagatcatgaaaaataacttaatgggtattaggcttaatacttgggtgatgaaataatctgtatgataacccccatgacagaggtttacctatgtaacaaactcgcacttgtacccctgagtgtaaaataaaataaaataaaaagaactgggtgccagatgttgaaggaaaatagtaagatcttaagaaaatggctttggccgggagcagtggctcatgcctgtaatcccagcactttgagaggccgaggtgggcggatcaggaggtcaggcgatctagaccatcctggctaacacgatgaaacaccgtctctattaaaaatacaaaaaattagcctggcgtggtggcaggcacctgtagttccagctactcgggaggctgaggcaggagaatggtgtgaacctgggaggtagagcttgcagtgagctgagatcacgccactgcactctagcctgggtgacagagcaagactccatctcaaaccaaaaaacaaaaaacaaacaaaaaaacacagcttcaagtttgtagatctatggtcattcagtctatgacactgaacacttcctttagtagctcacttgttgaataacatctagaattaaataggagaaaaaattttcctaatagaactataccaggctttacatgattggtagtcttcgttcttcacaaaccagtttattttaatagatatctcaggtagagttttatgaaggcctcaaagcaattaaaacttcatttgcaggaaggacaatcttatacttaccagaaaactacagctaacatgaatttctttgttagacatttgctatgaaggatctttgagaaaattctgtgttagaacccatgacacccctaacatagctatgccattatttttttcttcttaaatgaacagatgagttttgtaagcaaagtaggataccatgattgatagacctttttgtaaagtatactcagatttgctgaaagagcctacataattcagtctgggtgcagtggctcatgcctgtaatcccagcactttgggagactgaggtgggtggatcacttgagatcagaagttcgagaccagcctagccagcatggcgaaaccctgcctctactaaaaatacaaaaattaaccaggcgtggtggcacatgcctgtaatttcagctacttgggaggctgaggtaggagacttgcttgaagccgggaggtggaggttgcagtgagccgagatcatgccactgcactccagcctgggtgacagagtgaggctttccctctctcaaacaaacaaacaaacaaaaaaaacaaaaaagaaggagattacataactcaagaaaaccatactcgaagcctctctttttaaataatttttatctcaaataagggaaaaatcaaaatggaaagaggttatgatcagtttcaccattggcctacagtattgcttcagagaacaaaataaaagggttcttgcctctccccttgctggaactgggcctgccccagggacttggctgtagggttgcaggtactttccctgtcctttgatcttaatcaccaagggagcaattaaagttccatgtccaggaatcacttagtaaagagtcttgcttttagttagagagttgaaggggttgtgggcaatatctaaatatgctttggacattgtatttgatggggttgagaaataaaaaaaaaattctaggctcctaactaactgaatggattcccctcttggccaagggtgaaactgcctttgcaaaattattacacaaagagaaatctaacatagttgactccatcttgcttctgacttccaagctgtccttggtcattcctgggtgtaggccaagctcactttgggaggaatttagtttatagttttaccttaaaacaaagatgataatagcccttctcaaaactaaatcacctttgtaaaactaatggaaaggcacaaggttaaaattatgagagaggcccgaattctgataggataggcatagtttttatcagcccttacagatcaggaatcatgtgaccagaggtcacaagatttgtgaccttcccatttactcctatagttaacattgctatgttagaacccaagattgtattttgtgggggatgttttccagactgatcctacctgaacttgtgattcatgactcaattgatcctatggcctcacccagaggtagactcagcatacgaagactgttttccataccagtatgattccatccctaaccaatcagtggcacccattccctagccccctgcccaccaaattgtccacaaaaaccctaagctccaagccttcagggagactgatttgaatgataactccagttctcccacgtgagttagctttatatcaaatgaactctttctccactgcaatactgtggtctcagaggattgatctggtctgtgcagtgtacagtgctgggtgattaccagagaaactcgggaagctgagttcatggccttggcgggatgggaggttgaactagtctcactagtatgtaatcacttgtctcactgctgtcccctccccaccttttttaaaggaaaatgtacaaatagtaaacttcctgagaccctctttggaaaaaacagccatagatgcatctgtgacttatgtttttcctggacatgccctcaagctggctcgataaaccttgatgactgagatttatgactcagtcactcattttgattgtcacagtataaagggcctgctatggtctgcatgtttgtgtctctccaaaattcacatgttgaaatctaatctcaaatgtgtgggcattcagaggtggggcatttacaaagtgatgaggtcatgagggtggagcccttgtgaatggaattaatatccttctaaaagaggcccaagggagcttgtttgccccttctgtcatgtggggacacatagtaggcaccatctacaaggaagggtcctcccccagacacggaaactactgttggtgccctgaccttattaattatgattgagacaatcaaatatggtctggctaagagaagaatagtccataacattttgatgctgactccctaaagtctatgttttgaaatattgaatatttaacatgaagagcaaattacaattaggacgtcttaggtccatacaaagtaatattctatggactgcctttggaattactaggtttggtcttgggatcagattgaatgaactcagtatagattctgtgtcacttctactcatgaaacacatttactgatggttaatctaagagtatctttaggctaggtacagtgcctcacacctgtaatcccagcactttgggaggccaagacaggcagagcacctgaggtcaggagttcaaaccagcctggccaacatggtgaaaccccatctctactaaaaatacagaaattagctggatgtagtagagggcacctgtaatcccagctactcaggaggctgaggcaggagaatcatttgaacccgggaggcagaggttgcagtgaactgagattgcgccactgcagtccagcctgggtaacagagtgagactccatctcaaaacaaaaaaagtatttttatatatggcaacatgttgctatatagttatgaaataaagtgttgacaaaacttgactgaatgtaatcatagtgaagccaacgttatgtgtcatatgtcacctgtgcctgttttgtcacaagtgctctttacaaaccacttagcatcttcactttgaggttgtatgctcttatttaatgctccatagagttttgagattgttgtgagttttctattcaacattggcttctccaaagatttgatcattttttaaaacagctgtaaacctattcaaaatttatataacatatatttaaaatataaggacgctttctgatttcaaatgcatctcatgcagttaataaaattggtaattggtaatttagagtcacagataactctaagtaagtcaattaaaactgtgtaagaatttgaaaagaggatacagggcattgaggggattgacatttggtggccaagtcattatagctattgtttggaagaatctgatgatattcaaatgatcaaagcaagtattttgaagaaataaatgatgtgaaataactgataaagagatactttaaactgacattatcctacacttaaatataataaaaatacacagtaataaagcaaaataacagatttgttgtttggctacaacatcaagtcattctcaactacatattttgacaatagtgactctaaatattttctcaaactaagctttcctaaatattttcccaaaccaagctgtttctttacggactttatatgcattaattttatatgaatgactatttttctaacataaaaacaatctttacaaatattttgagaattcaggaataaaactaaagcattcaaatgaccactgctcagttgtacttgagagattttgcccaaaattatttaaaagtgttgaactgtagaaggccttaaaatagaacttgtagaatttcaatattcagaaagtaaagtttgttactatgggtcatactgttgtgaaaaagcagaaaaagaattcagaataatcaaattgaaactattttgctgatataatcaaatatgcctgatgtttgttgtggttttaaagactgtattttctctttggacatttctccatctttctttttttttttggtgtaaaatatacacaacataaactttccctttttaactacttttaagtgcacagttctgtggcattaagtacatctacactgttatgcaaccatcaccatcatccatctctggcactttttcactattcccagttgaaactgtacccattaaacaccaacttcctatttttcccttcctcagcagtcaccattctactttctgtctctgtagattgactactctaggtaccttgtacaaatggaatcatataatatttgtccttttgtgactggcctatttctctattgttttactaacataaaagtattttatctgttattaattttatctagtcagaaactggaaacactgacagaatctttggctgattaattacactacaattgacaaaatactgcccaaacataagtgatttactaaaatatgggacatgatgtttaaaattaaaaacctgatgaaactgtagtgtcagtctcaattgcagttgtaatatttttcctatagccaatgattaaaatgtgcatttgttagtgattttaaattaatttatattaaatttactattttcccatctaaagcagaattaattggtcatttttttggcacatgaattaaaacatatatacactgtctttggtttgctaaaagaatgaatgaatgatataaaggcatctcatgtagaaagatttgttcttgttaattagcaggtttattagaatatggtttctttcatctgaattttggagattggaaaaacaatctccaaaatataaagaatgcagagaagtgcaggagaagagagaatggtaagctaaaaattaccatcaaatgctaagtgtcagacctacacaaacacaaaatttaacatacttaacagtggcatgttcagtgaatatgagcaggagacatgagctcaaatctaatgatatctatgatgccagaaactttgtatatgctgaatttaatccttatgacaactctctgagtcatataatttccccatttttgcagatgtcaaaactgaaggtaagaaacggtaagaaatttgcctagtctcaacactagtcagtgtcagagccagaattccaattcatgtctacatttccaaagcccatgttgttcccatgacacaaaattgtagcatgccttacacttattgacttgggagagttttttttcttaaaaatatagtatcaatataattttagcaaatcttactgccattagaaattggtaacatttatttgaggatagacttcaaaatctttatgagacataagaaaatgaagttccagaataacaggaatttgaatggtagttttcacctttcagaggatggttttttgggggtggtaagaaacatctaagtattggttctcatttgggggcatgcttagaggcatcagtagtttctggtaaagtaagggtctttcaaaagaaagacaaatgaatgatactgtataggtgcagttacatcataggcaccacaataaggtataaaagtaaagcattatgactttcaccttgggaaagaactttgaaatgaggaaaacaaaattgcccaataaaggtgatattttataaccaaccagtgtggactagtggagcataaagtttctttaaagacacaaaatagctgtagcttggattgcacatgtggatacatcaaaataaatatgtgtcaatcaaaagtaatatatgagagtttctgctttggcacattctaacttggtgttatcaaccatttacatttttcataagctaaatagtacgaaataatctcatacagtggttttaatttacagttttctaatgactagtgatgtggagcatctttttatatgtttatttatcatttgagttttctcttctgtgaactgacagtgcatatgttatgcaaatatccaaccttcaatgtccaattttgaagtcttctaatagatgtgaaatttgtgtatagattcttttgaactctacctagacaacatgggagagacggagatgcttaccaaacccattctcttcttcccaggcacacagttacagcgtgtttccccatctctcagttgttttgccatgtgacggactgaattctagaaaatgtaatgtggacagaaatattgctatacctattccataaaacttcccacaactgaaccttcattgtgttttaccatttaccagctggttggagaggatcaggatctaaagggggtcacaggtgagacgagtaatcatgtgaaaggctgcacaacagagaactcccacattggactataatttgaatgggaaattaatctattgggttaagccactgaaaatttgaagtttatctgccatagcagctaatattgtcattaactaatatacactatgtatcgttgtgaataatgactattttgtttcttcctttacaatctctatactgtttatttcccaggagttgacattttattatgttttgtttctttcttttcacttccccgccgtgtcacctaggaactctagttcaatgttgaataaaaaattttgaaagtggccatctgtgttttgttactgaatttcgagggtatgttgaagtttctcttttaagtggggttttcttttcttttttttagagtcaggggtctctctctgttgtccaggctggagtgcagtggtgtagttatagttcattgcagcctcaaactcctgggctcaagggatcttcctgcctcagcctcctgagtcactgggagtacaggcataagccaccattccttaagtaggtttttcatacataaacttaattaggctaagaaattttccttaaattcctagtttactaagaaaattttactgtaaatctgtattgaattttgtcagatgttcataggcttgtattaacatagtaatacatattttttggcctttaatctgttaatgtaatgaattacataacagacttttccaatgttaaactatcgtacattcctgggataaatccccttctgtttttacatattattgttgtctaatattttatataatagttggccaatataccaatgtttgctatactgcttttatatcactgttattggttatttttttcattcttgatttacatggccaatgttcatttggttttacttacatatttaccagtttctttactcactactgtctctttcttctcactttttcctttgagttcagctttcttatttctgaattacagtcttcacagttcttcagctaatagcaaagttttaaagtctttttctgacaatgccctttttcattcttattcttgaattttagatagctgggtataaatcctttgaagacactgaattctattctgaattgtattgttgttattgaaaggttcttcttcttcctcctcctcctgctcttcctcctcctcctgctcttcctccttctcttaggtaatatctttgtctttgtttcttctttagatattctctttgtctttgatgttctgtgtttcaccaaggatgcactgtgtaatggctctagttgtgagtttctttttatttaccctatttaggattcttgactttaatcaaatcaattaaagtgtacttttctcccattcttttaatattctctatgtggaattcttatgagacatagattaaacattacttctatgtctctttttaacatatctatatacctctctgtgaatatgcacacacatacacacatatataatatatatatttgtatatgaatattacatatattttgtgtatatattatagataaaagtatatatacatgtgtatttatatgcatattgcctgtgtatataaaattaatcatatgtaagtttaatttctatataaattatatataactttaatttatagttaatttaattatataaagattacatatatatatttgttgtgttttgtttttacttgcagtgccgagaattgaggtaatcatgttgctcagttcatggcacactattgttatcagtgggtgtactatttctcccttggttgtttgtttaatcattcctctttattctcatttcccacttatattttccttctcccataggaatctaatgtatttgttagaataagcaacagcacagtaccacagttgtataaattaaaatatatacccactaaagaacattatgtatttttaaagtacctatttctcactttctatattcagcattctgttttaaagatctatatatgttgctgtatatttatctagttcactgcttctaactgctgcatcttaatatataatgtgctgtcattgcatttccctgattcactcttcagtgctggaaactcagggaacttccaacttcctgctgtgcaaacaatgatcaaataaacattcttttacatgggttttatagacccttttgagaatttctctgggatgtattcctaggaattagattgattggtcattggatagacatatttgagccttatcctcttatattttgcatcttttgctgaatttgggatagtttcattaaattgatcttccagtttgtattttatatgttttaaattttctgtatattatgatgttttgacatcttaaaaaaccctttcttgctgtaaagagaccgcccttcctggctctagccaattcttagagatagcaaaggactcagttaggagcgtactttagatttgcaaattaaccaagttgtgtatcttctgtgtggcctgtacacccccagggaaaaatatgcttgtgtcttaatcatcccagggccatgtaccaggcaattagggactatctctatagtttagagcctgcagttattattcaaactaaccaattctaagaagtttatcctgccctccctcacgcttcctgtcccacggaagctccaataaaattctagttttggttttcctcttacttctgtcttctgccacctgaccaaaacctggtgattccccggtaactctgtatggcatgtggtacccccctctctagaacctgtgaaagtaataataaactttgttttcttgtggctttcctgtgtcccctgtgctgcacctgattaaccatcacctaaaagaactcagaatacgattcatacattttctcttcatctgcctctaatatgatatttttaaaatgtaaatgattagaagctctatttgaggataatagattgagaaaatgattgagcagaaaaagtaaatcaaatgagaatactaagacccttcaaaaaagatatggcagaaattcttcatgtgttttacaattttagaatgtaaactcataatttgttttgagttcatttgaaagaatcacatttgtaccagtcatgagttgatcagaaaaacggatcgtcatgaatgaaatagaatagtggatttaattagaccttgtacaattggggaactggttaagaagtccatgtcaggctgttgctttttcatgtggtatttactggacctggggtcactgtagataagctggaaggcaatcaggaatgagagttggatttgaaataggaaagggcaaggacaaactggaacccacaaggtcagacgggaaccccagaagacaaaatggagcccaccaggacaaactggaatttgactctgtctctcatgatctctaacttcaataatgttagtgacctgcagagaagtttgaacccttcatcctgaagttgcacatacacttggcccaggactgaaggaagtcaaagaaggaaatccactggaagctggagaactgtgggtctaggtgcttctcagtgtcaataaggtgggttaatagattagtgacaacatgtgcaaattgccaatgcctggtgtcatatattgagtttcagagtataaaatggtggcttcttcatttgtgcccttcagttcccagaccaatgtgctttatggcctactccaaattgagaaacacacaaagaaataaattctgagaatgtaattccagtttagctaggttgacatagtataaaaccatattacactagtttagttgaaggtatgtatctacggatatattttgtgtttatttcttttaccacccttgaagtatctccagctttggattaattttaatgtaaatttttcattttggagctttctagaccaatagccaaacttaaaatgagttacttgacagtggttctgggttctcaaggaagagtctctatttcgccattctgaacagaggctgagaagacaacttacccagttatttccctatacctatgggcatattagttcacacttacgctgttatttagagtggagtttctctaggttctagactctggtggtctctgttccaactccctataggagtagggacagacgaccttatctcctgcctcacagtggatattaagacatcagcctctagattacctaagacagcccttccccagagtagacaaagagtcagatctgggctttactgctgtgagtttcagttctctattattctctgtcccctgaagagctatttattttccttctagttcagaaatgcattaaaaattaaaaaaaaaaaatctagatttttcagatgtttttagttgacattttcaggctaactactctgccatgttacctgaacagggagtccattgcatttgcaaccaagaacttaaatgcagagacctcttttacaaggatagggtgctttagcaaattcagatttacaggaaagaaaattacaaatatacaaaacagatcaattagagggatgaatttgcataacaaaaggactcgccataggactagttaaaatagctaggatctaacagtgaatttagagcatctaggaaaatgtgcattgtataaatctatcaggcctgtagttaaagaaatgcggggatgaatccttttgtaaagcagaaagtcctttttgtaatgtgaatgagtactctctaatttacaagtctgtaagtttgagaagtttgagtctttgtgtatctggcttctcaaataatagagatccagaataagttatttatacagagagttcaggtttaactctcctgagtatgatttttctatgttaatataaaataatcaaaacaatctgcatatttaaagaatggaatcatgaggtccttcagacgtttaatatgtgcatttctacataatttcccatgggtcttgttactggaaatatgttgaagacaaatgtttccacaaaatgaccgatttcttttgatagatctatttaagcacacagtaaaaaacatcttgaccagaaacataattgctaattcactgtgttggacattagctattgagttattaaccagttatctgagggcctaccatgtgctgatcagagagtcagagttccttagatatcaggtacccaaactcttcattttccagatgaagaaactagtgatgtcaaatgacttgataaacagtttcatggctactcagaggactgcatgaaacttccagcatattatactgctttctttaatagagtgaaagagtccactaaattaaagaggttgtcaactccatggatgagaaatttatgttaaggaaccatgactcaccccgaagggtgccagactgagtctgtggcccagtgcaaagggcacagagacatgccatcagacaggcttgtgcctgcatgtcttgcattgacgttgggcaatttattaacttctctgaactgcagtttccccatatgcaaagcagaaaattaatactcatcctgccatcctgaaaatgtattgttagaaaagaacattattatatgggagatatactttactgtataaactccaaggtactttaaaaatgtcatttgttatgattattgccatagctactctagagaatgcatatatcaaaagatctatgaactttcacaaatatttttgcagaataatcaaggaacaagttgttaacctttttctcagaagcaataaacaagaaaaatctagactagatgtttatacaaaaagttatttacaattcagagctgtgtccaatgtcatttgttatcattattcttatatgagtgaattaaatattttttaaaaaattaatacatggaaagcaatcagaagaatgatttgcacacaacaaaatgtatatgaacattggttattgttaattatatcctcatacttttctattcctcctgcaattgtgcaagccaaactctctcaactctgaattttattttctattgtttgaaatgacaaagatcatgggtagctgataattcaagcattgtttttgctcaatgggaagactaagatgttgctttagggagtaaaagtatggggagacattgtaacaacagctatagtgtcaaaggacagtgtgtttttaaatgtatgtatacattatacatttattcccacttagcttctgttataaaagtcctgagacatcttctgggctttgatctgtttatggatccagatggcagagaggtgatgagaccacaggttagagagaaaatttagtcacaagattggaaattataagccttttactgcttaattattcccttcctgaatttcaggatatggtcacctatgaaggttattttacttcaatcaatccttggatgaagaagacaataaccatagctgtacaaaagaataatgagatttaagtattgcaccgatttttacctacattctctaattgctcattacctaaggcagctcagaaatgacgaactggctcctttttcatggtcaggacagctgcttttatatgttacatacttgtttaatatgaacttcaatggtttttagaagaaggaataattagaacaggtacagccaggggatttttataactcctttaatgaatactaaatagtattttatctttaaaagggaccatggctgcccttaactgcaaccaagttcattaataaaaagttttcatgcagcagacacaaaacaatataaagaaaccagagaaaaatctaaactgagagctgtagttactatctgtgctaagtgaatcaagcctacttgcaaagatgcataattattttttaataaaaaagaaataaaagattttgctggcttaaccaacgataggtaatgatactaaaaatgacatgagagtaggatgctgtatactgattccagctgcttctctttcgagttgggattatctgaattggaaaagaaaatccccatttccccagcaaggtacagattttacaaaacagagatccatccttgacatggtaaatatctaatgaaaccacctcttctttccatttttttcccaccctgagccacatgctgtatattaaataaaggactcaactttgttcgtactggagaagttgtctgggctgctgcaggatggaggtttacctgaggttacctgtatgaagggtgaattgctcacgctttagagcactgttatctttctccccatgtactccttcaacagcacaatctacagtgaagtacttgtcagggtaagcggtgaggaaagtgagagcaggttgatcaataaaacatagactggaggaagcctcttccacaggaaactaacaatgcataagaagcatattcttaacaatgtttggcaggaaactcagcagcatgaaatgtacttaatgtttaacagaagttctggaagaaggcagctttacacgtgacgtaaagaagattgactgaaggcatgctggggtctctatggaaagagatttggatgtgaatagacctgggcttgagccctggctccaccatgttctcaatgtgggaatgtgtgtgagttcctgctcctccccttcctctgctgtaaaatgggaatggtaacacctgccttaccagactataagcaaacagtgatctgagatgtgtgaaagctttgtcaactctaaagcactattaaaatgcttcaggaaagtagagggaatttatcctggtcacctgccttgggaacagtcacgaaaccataatgtgttcccagtcctgacactggcttccctctggctcaaaaactgggtcttgcaatgactggctttcttctgattttcaaggttgagtgactggcagtctgcctgggcacacgtcaaagagcaccaccacatcaactgcatggctgcagtccctgtgcaggcagcttcctttgctccccagcaagtgcaggggctggcagaggctgcttcagccttgtattgtagggggaaataggtgccacatgctgttatgaccatggtgatggtgggggcgactggtgcttctacataccctggttctaagctccttttctggatctttgtagttacacatgggagtcaacagcccactgccttccctttatcctctatctaccccattgccttcttccagcttccccccaacccccacccccgtctaatgaaaaagaagttaaattcctatcttagcatcaaatccagctgtagttttttctcccaactaagcacatgcagtacggtacctcctcctgtaccatatacctcctccagtaagatactcctgatctctttctcctcctctaggctcactttaaggtccttgttgtatgtgaccctatgtataccctgaatgtggttcttattgaactgtactataactgttaacttgctttcaattagaatgcgaactcttcaaaggaaattcttactcaccagttgtctctccatcatctagcatagtgcttggcatacagtaagtagatgtaaatgattatcgaactgaattgatcagaccctaccactcccattgatttaaaattatacatatgcaaagaagggtcattttgagaccacagtgcaatcaagatgaacatgtctctaacttctgacttctctctttctgaatccgtctaccctagctcacccatctgtctctgcaagaagggccaagaagagcacagactcagtcaaacaaagatggaacaaaattggtcacaacttgaactattccttctttattttccatttctgttttgaccctttaaaaggaatttcaaaattttactttcttctggtgctactaacgtaaaatgcctaataatctctacatggatacacgatttgaataattatacacttgatggggttataaggaaagtttggaaatcatcttacaccttctagacatattccaagtcaaattgattaaagaaattagttctttctccttagttctaaatcatatgccaggaattccaggtttgtggatttgtcatttaattgcatattattgataaatagtattaaagacctttcctgaggactcactgttctgagtggtttctatagctctgtgacagatgttaccagttggccagtaaaatccattccaatttcctctctcttgcttgttttctcctgcagagcctggaaaaagctaagacacactttcccagtctcctgcaagttggacggtggctgtgtgacatggtctggccaatgaggtgtaaacctgagtctgctggaaagatactggaagaacttttgatatcctgataaaaggaacacacatctctatcattgctccctttccccttcctccatctgggaatgcagatgtgatgacagaagctgccatagccactctgcagtcatgaggcaaaaaacacaaaagcatgaggacaaagtgccatcatgctaaggagagcacagcaaaaagacagaaaggctctggtcctaaatggcacagctaacaagtgcccatttccatgcctcttgccaaccaacacaattcatgtccttatgatttcaatccctggtggtcaggttttggtcacttgaagctaaaagcattcctaactgattcaaaccccaaataaaaacattgccctaatgatgaaacagaaattggttactttggcctcaattaaaaaatgaaatgtagctaatctttaacaaattcaatcctaaatagttctctttatgcctactgtcaggcaggcccttcttctgtggctggatctgatttcctaaagccttaatttctaactcaacatagcaaagaggtggagggaagccatcgtgcccaaaccctcatgggggtcatgacttacagttgactgaggatggcctccatttatcacatagtctattgcaacttgaggttcctttaacaaatactaggttataacatttaaagctgatatcacagcttctgttacaagaatattattgtactagtttcctaaggttgttgtataaattaccataaactgggtggcttgaaacagaaatttattctcttatagttctgggggccagaattctgaaatcagtgtgtcagcagggcattctccctctgaaggctcaaggggagaatccttccttgcttctttgagcttctggtggctccaggtgttccttggcttgtggcagcatcacgccaatcttcgtcttgtctttacatggccttctctgcttcctcttctcttttgtctgtcttcttttcttataaaaacacttgtttgacttagggcctatcctgttaatccaagatgatctgatcttggatcctaaatgaattagatttataaacactccttttccaaataaggtcacattcacaggttctacgtggacatatcttttggaatgccaccattcaatctactacaactctagaaaatttattccactttccttatttatttttgttgggtctcatgaactttgatttttttaagctgtgtgaggaaacatttatggcaatttaagttttgtgttgcatcagaatttaaggttgtttcaggaaacacgtgttttatttcacattttaaagtaaagaattatttctctgattacattttagtctttatttctcatgttaaagtaaaaaataggtgacttcagatcagtaagtatatcatggtagtgatattaaagagtatttactaggcttagtataactcaggcaaaacatttcttgcaaattattcaccataatctttgacataggctggattattagttttaaggcatgaattactttctacccaggtcaatggtttttaaccctgttacacattatagtcacctggtgaacctttaaaaatgcatgcccaggacccatttcaaccaatgaatgcaaatatgtggggatgagcttgtgcataaaagtctcctaagttattcttatgtatagtgaggattaaaaactgaccttgactcttattagcagttgccttattcaacaccatttatttattcaatcaagtaatcattatgcacttttaagtgtgtaagtagttgcagtacatataaggacatataagaaatgcaggtttataatttagtagtcatggtgtataatattttgtgtaatgtgccatttatactccagggtggtagagccaaatgcttatagagaccttctctgctggtcactcttaaaaattcaaatcaatttatagaagtaacttgtatcacaaaaaattagccaggcatggtgaagcatgcctgtaatcccagctactcaggaggctgaggcaggagaatcacttgaacccaggaggcagaggttgcagtgagccaagatcgcaccactgcactccagcctgggtgacagagtgagactccatctcaaaaaaaaaaaaagtaacttgtatcattattgctttaactcctctgcactcaggtgcgtgtgtgaacacacacacacattgctggtaataatcagagcaaaataagactcctatggttgactatcttcagattacaccctttacaaggtcaggagccttttaattattttagatcccccttccgcagagtagaaaccaatatatgcttgtaaaaactcacgactggtagtgatccctattagtagaaaaagcttgagcagtaaagttgcctgtgccctggagaagtgctgaggactagaaattcctctagcttccagctatttgggaagacccttgggtgttgagccaacattggcaggtgcgaaagggaatgacactggggctgaggagaggatctggcagccaattagcagcgcttgttagagctcaccccagactgctgtgtgactgctcattcagacattcatagacacccctgtcacaaataagccacccagagctctgtagtcgtacaaagcagcaataggagtggagaagaaccatgtttgtcaggaaggccctgcatgcaagagagcggcagggcagagagcagagtagagcttggaggctatagttgtaataagctttcaggaaaagagaactgagcaccttaattattttatttttttttttgacatggtcttggtctgtcacccaggctggagtgcaatggcacaatcactgctcatttgcagcctgatctcctgggcttaagcaatccttccacctcagcctcctgagtagctgggaccataggcgtgtgcaaccatgctcagctagtttttgcattttttgtagagacggggtttcgccatgttgcccaggctggtctcaaactcatggactcaagcaatccacctgccttggcctcccaaagtgctgggattacaggcatgagccactgcacctgacaagcaatttaatccgaggagtcatggagtcttatacatgtgaagtcttgttgatgaaagataggaagatggagaggagctggaggagaacatgatattaagccaagtatttaaaaactactgatgagctaggaatcaagctgagtgcattcattcatatgttaatcaaatactttttgaacatcttctatgtgtttcaggtgttgacagtgcagaggtgagcacgtgttctccagggtgaaggacactggaggagatttagggttataaaaacaaacagataacaaatgcacatatattcagagtaacatgatagaaatagatggtcaggagataccacctcagtttgggcgatgaggaaggccttgacccaaggaggtgacatgatgtgagctgagatgatgtggaaggtgttggggcttagaaaacaacaccccaaaatgaaggcctcagaagcagcctcagaagcaaaagtttttctctgaccttctcctgccctcctgtttctcagtcccattctctcctgaggctagctatagaaactaggatccctcttccccagggtgggtcatagaaaccagaccccttcttccccaaagccagccataaaatctaaaaatattactctaactttccctccacctttctatgtgaaaactggccacagagaaattatctgacttaccttgtttgactgtaggtcgtaatacccccattccagagagggtcttgcccaacacagagaaggaaggaatgcatgctcaggggggccaagaagaatctagacagacaggccttcctggctttcttcactcagtctattagcattagatcagaccctttttttggtccaataatatttcggcacagctgtccatactttgttgaaacgaagtgtaaaaatggacaatctccccagtatttttgggtcttcatcctgaaggctcccatgtttacatgctaaataaatttgtatgccttttctcttagtaatctgcttgaatgtgaattgatttttcagcaaacctttagagggccaagggcaactttcttcttggccccaacaaaggagaaggacggagatgcatgtaaagcggtccaggcagagggaagagcaactgtaatggccctgaggcaggaatatacttggagtttgcaaagaatcagatgatatccaggctagaatcagagtaagggcatgtctggaaaaagtggaaaaggcagcaggggttaatgataagcacgtggccatggctgggcttcgggaagggtgaggcttcaggtctttgtggtttggtctgaaagcgactgaggttccactgggtgagctgctcagggcacatcctgatgcagacagcctgttggctctgacagcagctctcccatcctcccagctgcaatgactgccgagttggctttgctttgagtattccaatcacacagggcctgcacctctctgcattccctgggggtgattttgatagtttctctgtgtgcacagtgattttgaggcaggagatacatgagcgactgcagcagcataagaagtcagtggtgtcaatgcctgacaactaccatgactgaaaaagttagattcctgaagtgacttcatttatattgccatatcctgacagaatctgaggccactcttggtatatgaacacagtatcatcttatatatatggaaataaaaaagaatgggaggtttttttttttcttaagcaaaaggaaaatattaactcaagacccaaactgttttattcatttgtggactcccacaataccttccttacacagttatttcactgattctagaacacacacttttcctcatttaccatctgtgaaatgataatgcatcttacaatccacagtgcctcacaattgccatcacatggttgtcatagcccatacccacatgcttggtcatagctgttcatgtgttgagtataattggcatttaaactgtgttcaaaatgattacattataatttggcatcagtacttggaaagatacaaatacagtagggagaggataatttgatatttgtgaagcaaataacttcactggagaagagactgcaatgacatatttcctttaaaagcagtaaccatgtgcattgtgggtctgaaggaaggaagatatccacaaatgcatgaggccttattatgctttgttactgcaatatatgaaaaagattacatgttacatgccaaggaactcaacaaaggcaggagtaattgacaaagccctctatatgaaggaaatgttcaatctgtgtgaggctgtgatgggtttatgtgttggacagaatcaccataaggctctgtgtcacagattaattggcagcacttgtttttcttttgtaggaatgcataacataatgatgcatcttataatagatggtatttctaggttccatgaaatagagtggaacaaagtagatgtttttgtcgttagactagggctatgcaaatactagacctcacttatcccatcacgttcaaaatgtctctgcagtttatttacatattaccaaagagctgtccacttgaaaacttatagtcagcattgtgtctcaagccaaggtaaaccaaactaaacattcttatggcaacatggccaggcgctgtggctcacgtctgtaatcccagcactttgggaggccgtggtgggcagatcacgaggtcaggagttcgagaccagcctggccaaaatagtgaaaccccatcttgactaaaaatacagaaaactagctgggtgtggtggcgggtccctgtaatcctagctactcgggaggctgaggcttgaacctgggaggcagaggttgcagtgagccgagatagcgctgctgcacaccagctggggcgacagagctctgtctcaaaaaaaaaaaaaattcttacagaaacttgatactcttggttggtgaactgaattttatcaaaagcatctatggcacacaggcagatgattgtagaatacatggccttaatgaaaaataagctaactgcttaggcgattatttcaaattcagtttaaggaagtcactgtgttttagcgtctgattttgaacatcaggactaaagaccctgaggcttttttcctttaaggtactatcaggtcagtgtgaaaaagctgtttgccaggggagccagttggaaatgaatgaaataatttacattcctgctgtgggcaagttgtcaatcattatgtgtgaagcctgtaccatcatttttctcctatatctacacaaggatgctgtcttaaggatgtagtcaagtgccgtgacaaatagcaggtcaatagctgaggacacgttgcctggtgtgtggtggtagagaaagggcacacctctattccccaaactccaggccggctgcttgatgtaatagcaggttgtaaagtgaaaaagcttctgcatgaaaggatagcctttacatggggtacagagcgcagaaacgttttttggccacacattggtttttctcagccatggatcataatgattatcagtagaatcatttgttttaaatgcagagaagagctgaaatgcttctatgtatcattgcttctggagatttctagaaatgtgtgctaggtagttcaatttaccatgtccaaatggaactcttgatttctccctccaaattttccctaacaaatattcccaatctcaagaaacctcaggccaaaaacatttccaccgatccttaattcctttgatttatctacaatcaatatcacattcatcatctctattttccttgtaaatcctgactcagatattctcaccttcttcaccacaccactttagtacaaggcaccaccatctcttgccccgactactaggtgaatgcctcagtaggttttcaatgacctccatccccattcccacagcagccaaagtgagcctttcaagcataaaccaaaccatatctctctcctgtttaacacccctctgatgctcatgctcacatttagattactatgcaacccctctccacagctcacaatacctgatcctgggccaccactgtgacatcttttctatcagccttttccctggctcatgctactacagccacactggcttccttgctggtcctcaaacaggcacggtcctgccgcaggggatctgcacttgccgctccctcagcctggagtgctgatctctgcatggcttcttcccacacttggttcagatctctgcctaaatgaaacctccttaaagaagtctttcctgatcaccctcctgaagatctggtcactgtctatcctcttaccctgctctatgtttccttatagtatgtgccactagctgatatcatattacagacttatctgttacctgcttattgtctttgtccagctctagaatgtaagttccataagagcaggagctctgttggttttgtttccaatgcatttctagagactagaacagtgcttggcatatagtaggtgttcagtaaatattttcattcaatataaatactacatatacttcttcatatgtcgtcttcccagttggacactttctaggcatactgggccctcacaaagatatatagagtgtggactacctttcaactgaagcattttaccggacatgccaactgatggcagcacccagggatggcaatgagatggtgtgtgcatcacccaagtggccctccacagtcaagtaggtcgctgaagtctgtctctgatgactttgcctcccacgtcttcctctgtgtctttctttcccattcctcccctggcagcaattcattcagtgggtatttttaagcacctgctttgtaaagggcattgtgtgaacatacagctgagccctccgaagtcaggtcttcaaggagtttggtgtctggtggagaggcgcgatgaacccacacaaatacaagggctggtaaaaggtgaagtgtcttgccccagtggaataaggaactagaaactgaaattggctcatctgactctgagtccagcctctcatccactctgctgccttgcagcccacccaagcctgccttccctctggcgctcctctgcagtttgtttgtttgtttgtttgtttatttatttattattatactttaagttttagggtatatgtgcacaatgcgcaggttagttacatatgtatacatgtgccatgctggtgcgctgcacccactaactcgtcctctgcagttttaatctttgttctaaatcctccttttccccttctctatattcaaagcaccaaatcctgcccttctaggtgaagttatacatcagctgatgatcagatcagactagttcacagtaagtgagaatgactcatagatttagttctctcaggtggcgtttgtattgtagtttgtctctgctgcagccagtcacaaggagatacatgtgtgggagtatctgtttctctatttttggggggactgcgggaaaaaggatgccacctggggtctgcttatttactgtaagtctttctaccttaccctgcctcttgggcttccataatgaagtaggtctggccatgggtctttctccttccttagtacaatttctaaagggaaggcaatattccatttttggcatttgggaggtggtgaaacaggcaccctctctgttctctctcactctttctctctctctatgtgcgtgtgcgtgtgtgtgtgtgtgtgtgtgtatagtggtactacagggtcatttataccagcacgcctcataagttgcacccctgttcgtcttgtgcaccatgtgccctccagtggctgccacgaagaagaaatggaacttcctaagtcagccatcctgacagacactgttggaaactttctctgcaaggctgagaacatgagggaaagactgcggatgttcattctgttgttaaacgtatctctgttgcaagaccagcctagtgtaccgcctttcatgacacaatacatctgtgaatataaaataacaggaactggtggcttttctcatcaaaatccaaccagttctcttcagacacttcttaacctgtaaaatgggaatggcaacagtgtgcatctcatagggttcaggtgaggggaaatatatcaggatatatgatgtatatatgacatatatgtcagacttagaacactctcacacaaaagtgtctttaggtcaatcaacaggtatttatttgccacctccggtgtgctagaaactgttctaggagctggggatacaggagtcaacaaaataatctatgccctgatggggctgattgtggttaataatcatgatagcaaaggcatagccaggatccaaatccccgcagtctagctccgagtccccagtctcctccatgactccatagcacctcttgttcactgagcaagagaatgcgaataatacacttgagatgacgttgtgagttgagagcctggacctcagggataaagacctgtacttggcagccatctactttgagtctgctagctgaaacctgtccaagaacataacactggggaaaggaggtttgagaaaaaattcttgagcaagattgacaattaacgaaggggaagataaaggaagagttactaaaacaaattcccattattgttactactattattccctgtgctcatctagaggagtcaagtaacctaaggaatcaaattcaatgaaaaaatattggttgcacacccactctgagcgaagagtggatgtgcaacaaatatttgagcaaggcacgaaaatgatttttcattagacagatactttgcaatttaattttctaaaatagctgagtttgatggtcaatgagttcaataaacaattttccagctttttatatatctagcaattccatgatcacacagtgtgtttatcatctatcattctccaattactgaatattggttggggttcctgtcccccagttttccatacatttaggcctccttgcatggtaccctatccaggtcatttttttccccccggtgagcccccattgatcatcttagattttctgagatggttttgatttcacatattttgagtgggggcttacaaacaataataagatcatccataattctaaaatctctcttcttttctctaattaaaacctttgtgggccaggcacattgactcatgcctgtaatcccagcactttgggatgcctacataggaggatcacttgagcccaggagttcacaacaagcctaggtaacataaggaaacaccgtctctacaaataataaaaataaattagtcaggtgtggtggtgtgcgcctagtcccagctacttgggaggctgagaagggagcactgcctgagcctggaaggttgaggatgcagtgaaacttgattgcaccactgcactctagcctgggtgacaagtgagaccctgtctcgaaacaacaacaacaaaacaaaacaaaacaaaataaaacaaaaaaacccataaaacaccaaaataaaacaacccccccaaaatctctggggtgcactgattgcagtaatggtcccatttcttcacccttccctactctcaagctatttaccgtgtgattttgcagttgctcctattgagaggtgaactatatcctcccctcccaagctgattttgagttttccatatagcttcctttggccaagtgttggcagatgtgatgtaagtagaggtgtaaaaaagcgcttgctcatttttgtttgtttgtttctttctttgttatgaagacatgtctgcgatagcatactagagagtggggcacagggagtcccagctgtttcagctgagaccaccccaggtcagtcaactctcatatgccagaagactagagccaactgccagatgtgagggagccagatgagatcagaagaaatttgcagccaagcccagcctaaatcgctgacccacaaactgtaagctcagctaaacaaatgtctatcgctttaagccacttcattttcagacagcttgttccatagcattgttgaggcaatggataactgataatgcttcccataaatcttaggaacttggaagctgcccctccatttgccctcctttaagcaaaaaattgaatgctatttgcaaagcattgtataaaatgctttattagattatcttattgaatcctgacaacaatatctagcagacagatataatgctattatccaaatttcagaggcaaggaaattgaagcttagagaagtttaagtgacttgaccaaagtgcttttagaaaagcagagattctacaaccagtcttctaaatcttggaagactgcttttagccacggctgcctgccatttactctttggattctccattctacctgttctgctgcctacttctaccacctaattaggagaagaccttgtgttcccatttgggatatagatacccactttcatactgggtttacccctaatatttctctccataccactcatgtagatggttgtcttccgcattaatctggaaattttttgagggtaaagactaaaatacttatatttttatccccacaactctatgcagtatttttttaaaaaagatcatagtcatgttttaaggtagctattccataaaacatataaaaaggtaaaaaatactctcctagagaatatatgcatatttaaaaggacactgttattcaaattaatctaatttgtggaatacacagtagagggttttccccattttgttaaatagttttagttatatgttatttgaatgtagtgtttgcctgaatatctacaaaaataaaactctcttgactcatttatagattaattccagaagcagggattaatacaaaactggcagtgaataatttctgttttgcagttagtttctgcatttaagaaattgctttagggttcagtaacttgccctggacttcaggtatgctgccaccagatggcagcagggtgccaggcataaggcttgtaagcaaagaatttgtgtgctttctgaggctcaaggtaatagctctttccttaagttcaaaaagattttcagaccactgatttccaatttagcataatacatttctttacaaaaataggtaaactaaaactctaagccaccctaagacatctttagaacagatataaatcccaagctataaaatcacctaactcattattacttctcttctctagcatctaattatttctgtaatggcttatacaccatgatggcttatacgaatcttatacacctacctcagtgatagtgttaaccattataatttactttgaatctttatgatcaatctctgccatggcaccgtgtatgttagttttcaaaattctcaatagtttttctccaggtaaaaaaaatctatctggctttcctttcatctgtcttaagagagcagaggtttatcttttcagtattatctgagatcttctcttaagaccaaaagtatttctccactacagtggcatgaacagtgtttatttgcatttcgtgtatgtatttgtgaatatggagtacttttgcttttgtattttctatactatataataatctactagaatatttcccctctcaaagctcttggaagcacagaggcagtttaccatactttaacagaaatatagctggattaaaattttttttttttagcaacaggctctgccctaaatatctcaagaaaatactttaaagaacaaaaatcttcatgccaaattagcaagatacaggaaaaaaggtaagtgggcaaaatacagggaaaaaaagctaattcaccctgacagttgttacacaaagctgagagagtctttccctctcacatttacaaagtccaggagcggaaagactttcagcaggagtaagccatgagggtttggacaaggctggtaggggaaaatgttatctcctgggcatactgggaagctgagagtccagggcaggtgaatggggttggagatgggaatgagggaggacagcatctgagcagtaaatcctggaactagagttagcatatcaagcagggctatctatgcacccaaggtaagttctggctgggagaagcagatggcaactaagctgtgaaaataggctccaagggaccagctcccagcgtaactctgggggagggatctggggaagtacaaaaaacatagagaggcaaaagacaaataaaataggaggagaagagaaagggatggatcatagaaagctcttatttgattttgagtctcacaggaaacccatgaagccagcagggcaggtattttttatcctctatttacaaatgagaaactgagtcccagagggggtaagtgactttttttaaggtcaacataccgaggggcggatataagattcaaagtcaagtgacctgattccaagctaaagatgaaagaagagagggcacatttgaaaccctgacacacacactgtatgtcctactctttgctttataaacagtaagtaaaattttcaaataatggaagcttagtcttttaagggtcaaacggaagcagctttagccactgttgaaaagcatttctgaaatgtattatatttgcccttgcctcctttgaaaactgactgtaatctactctcttcttgatacatgggttataattacaaaaatttactatatttatgaacttctaattcagtagataccctcaggttctatggaggcacatgtgttttttaaaaaattaattttttttgctgccccacctaatacattcatggctagaaatagctgtgtagcagaactggctgagtcagctccttcttccctcacagccagctcttccttcttaagtgtgtctgctgctggtccctatctactgcttctgatcaggtcattccgcttattaaaatcctttagtgactccctctaaccactggttgcagtagtttgcaaaacaggctgcacatgaaaatcacttgaggagcttttaagacctcctgatacccaggtgccaacacgaaagatttcaattcaattgttttagatatggggccctcacctacagggattaacataagtagcatgaactcttgcttctggccaagatggaataacgggggctagatttatctttccaatggacacaactaaaagtccagatgaatatattaaacaatggttttcaaggcaacgggcatgaggcattgaaggacagtgatccctgagagatggaaaacaaacaaaatgagttgcatttgcctgcaattgcccctgagagaatttctaggccatgcagcagaaaggaagaattcagaaggagtctgcaagactccttaaatagaaaagatgaagcagagaatccaggtagactagcgtggctagagtttgccaggcagagtattagagagcagggagttctgatcagtacatgcatgtgaggaaatggtataaaatcaaatgaaaaaccagctgaaaagatgagtaggaatagtctttaaagttcaaactggactggtaaaactgagatttgaaaactattcaaattgggaagccctgaaattcaaagagcattggtcaagtactcagaagggtattgccctcgtggtggggaagtattgtcaatagactaaacaatactctgccttgcctaaccttaaaagcaagacctgaaagatcaaagactattcaaagaattttcctgtatcccagagcaatacccaaaaatatctgtaggaataaaaaaaaaatccagcatccaacaaggtaaaattcataatgtctggcgtgtaataaaaattaccagacatgcaaaaaaacagcaaggagaaaaatcaataaaacccaaacctaaactgacacaggtgttacaattagaagacaaagatattaaaccagtaactgtaactgtattccatatgttccacaagttggaggaaacagcatgtttaatagagacagaaaatataagaaagacccaagtctggccgggtgcggtggctcatgcctgtaatcccagcactttgggaggccgaggcaggcggatcacaaggtcaggagatggagaccatcctggctaacacgctgaaaccccgtctctactaaaaatacaaaaaattagctgagtaaggtggtgggcacctgtagtcccagctacttggaaggctgaggcagaagaatggtgtgaacccaggaggtggagcttgcagtgagcagagattgcagagattgtgccactgcactccagcctgggcaacagagcgagactctgtcttaaaaaaaaagaaaaaaaaaagaaaaagaaagacccaagtctaacttgtgaagatgaaaactataatgtccgagataaaaaatacactgcatagtaacagtgacagattagctattctaagaagaaaagatgagtgaacttaaagacatagcaatagaaacaatccaaatgtgtcacagagagaaaaaagactgaaaaaaaatgaataggacattggtgaactgtagtacaactttaaatgacctaatactgatgtatttggggtttccaaatgagaggagaaataaggtgagtaatagaaaatattctgaggccagatatggtggcttacaactgtaatcccagcactttgggaggccaaggcaggtggatcacttgaggtcaggagttcaagaccagcctggccaacatggtgaaaccctatctccactaaaaatacaaaaattagccagatgtggtgtcgcatgcctgcagtcccagctacttgagaggctgaggcaggagaatcgcttgaacctgggaggcggaggttgcagtgagctgagattgtgccactgcactccagcctggatgagagaataagactctgtctcagaaaaacaaaaaaatttaagagataatgactaaaaaatttccaaagttgatgacaatgataagtctcatatttaagaagctcaaaaaacttcgcacatagaaaacatgcaaaaaatgataccaatgtgtgtaataatcaaattgctgtaaaccagtgaaaaagacaacaccttcagtgcagccagggggaaaaaaactgacccattatgtatagaggaacaacaaaatggcggcaggtttcttgttagaaataaagcagaagagaggctggtggagcaatatctttaaagtactgttcgttagaattctatacccagcaaaactatgtttcatgaatgaaggcaaaatgaagtatttttcagacatacaaaagctgtgaaaatttatcactagcagcctcacactatagaataatgtcaaagacagtccttcaggtagaaggaaaatgacaccagatggaactaagggtctacataaaggaatgaagagcttggttggcttcaagggtgtgtgacctgtatggttacacaaggtcctgcagatagaagggccttgtgctagctttaatgttttgatgttactggctaaaaatttttaataatttttgaacaaggggccctatattttcattttgcactggtagctggtcctgatgaagaatacttagtagtccatagaggtggaggcagaggctggaatgccgagcttggctctgaagatccaggccatatgttcaggcatggaatagggaagagatggaggtggcttcttcagaggaaatttggaatgttttaattttaatcacgagaagggtgaatgaacagatgtccactaaaataaaaattttaaggtagcaatttctgggtaattagaacacaattttcctttctgcacagagatagatcataaatggctataattagagagtttcagttttttctgaagttcatttgttgcggagtgttcaaaactgtctcttcaggccaaaatgccttgtttattgtgtgtgtgttttactatttctgatatcaatgctttaataatgcctgttctgtaatattggcccagaggtactgcaagagtgtaaattcactttacatgaaaaagaaaagctatattacttccaatgacattttagtgattaaatgcattttatttgtagtataattctatcccagtttaggtcaaagctccgaagttgagagtagtataataagtgtggacatgcaaaagatgctgaaaggtagtagaaataataatgtcagatctagcccatcaccaccctccagaacatatatgaaaggattagaaatcaatgttaagtgtgtatttatttgggagactgtccatcctaaatgaggacaaatgtcagggtgcttttcccaaaacttgggctggctgagggaagcttcaagagaatccctggaacagcttgaaatctggatgcagggggtggagttggtagagtccagaagctttacctgatatatgcctggaaaagtctaaagctcagaggtggtatctagctgtcctgaaggcttgtggggagccagctgtactgtatataggtataaatgcaatgcttaaatccacagataatttataaagttcactctacacttgaatactcacatccagtcatttagttgaagccttcggctttgattaaagttgttaatatttgaagtgctgactgatgtaacctccctggtatggaaatatgaatatttctcatttattatgtcccgtggtgaaagcataaccttttacttaaaataattggtttgaaaatggaattagaatattcatcctccccattcctcccctgcaatttgtgaatttagtaattattcttcttggttatgagcataagttaccatttacctttattcaatatgtacacacgcacacacacacacacacccacacactctcacagaatgcaaaaaaaaaattaggaaataaagttatcgcaactttagcaatgagagcggggtagacagaagtgtgagtttataatgctgatcatgaaataaaaacttcaaagcaagcctaaatctgatactcataggatgatagctctactgcatttaaagcaaataaagttacatttctcaagaattaatgcaaaattagaaagtttcctttgaaaatctcttagcacatctccaagtggttagctttcctgggaaagctggaaattaaatcaacaacattgaaagaaaaaaaacctcacagtcctaaattaaacagtcatgtaaatatagtttccaaagctattaggcaagaagcaaatgattttctaatcaatttactgttgcaaaaataatgccagattattttcatggggcatgtgaaataatttacatgggacacacgtggatattgctaccttagcaatcttatctagttctacccaaaggtatttaaaaaacaaccactgacgctgaagttatttgtaatcatatcagcagcctatctcctcatcctccattctcttcccctccaccagctgacttttgtatcaaaggcaggctacccttgcacttctcttttcacttaacatagaacaacagttactggagcaatctggttcccttaaaactagcgactcattacaatggttcaggatgtgaacttccctaaaaggctttgctctaaatcaaggtgactgtacattcccttttaggctagaaaacaacaaactatgcattcttagtataggattattcagcccatatattatatgagactacctcatatttgggtacctctctcattagttgggataaacaagtcttgaatttgagataattcaaaatctttgtaagccaaaggcatgcacacattttgcctttttctcattttaaaacccagtaacccaaaaccatcacatgaactacccaattctattgggcatacaaattttgttttctgatttccaagtctgaaggttcaggtcaatatttgtccgtaattaacatggacataattaatctgctgagttaaatgacatacaaatcctcaccaccaagagtgtgaacttgcccataaagttgtcacacagaaaattgaattcaatcagcttactttaaggaaaatatactgagttagtggtagacacagatggcatgcttcagaggattttggccttaaggtctaagagacagtgactatgttttcaaattttgacacaatgcttgtgacaggcacttctccctgtattgaagccagaaaactgttaagagccaacatgggtggaaaagaccagttttctttttttctttttctttttttttttttttttttgagacagagtcttgctcagtcacccaggctggagtgcagtggcgcgatctctgctcactgcaagctctgcctcctgggttcatgccattctcctgcctcagcctcccgagtagctgggactacaggtgcccgccaccacgcccggctaatttttttttttttgtatttttcatagaggcagggtttcaccatgttagccaggatggtctgatctcctgatgttgtgatccgcccgcctcgacctcccaaagtgctgggattaccggcgtgaaccaccacgcctgactagaaaagactaattttctgtctcaagtcaaggctgattggcctcatgggtggtggtggatcagtccctaagccccggcagtaaagccaggggccgtgatccccatagtcactgcagctgtctacaaggtctggctgcagtcactaaacaaggatctctaggccacaggtacccccggcactggggaaagtgagtgcccaagcttacatcttaaacactagttcaggcctttggattttgagagacatagagcctcacattgtaagtgatccttacttcagtgaaaacatataatagagtcctattgaaatccattctttacaatgggagattactgctaatgctagctaggtgagtgattcatgtgctacctattgtaagtattaattcttcattaggtagcagtgtgattcagaaaatgttacatagggatatttttcaagctattccattaactaattaactgggatgcaacttaagttggaagattgtttggttgatgtatggaaggtacccctttaaaaaatatctatgagtagccatgtgatgagtgtcaagttcttgacagagaattgaaatcttagcctgctgcgaccaaaaagcaatactgtttcagttagttccgttgccacacagactgaatgaaattaaccaaaggctttatgttagacaatgagtctcttctgaaataatgatagcttttgtgagggcataagaagcagaaagttaagaaagagttacttatggccatacaatcacattaatttgtctatttaatgtgacttttagattcaagaacaatttctatacgatgttctagaaaagacattattttttcagaaagacttttaaaagcaaggaattaattagttactaataataaccatcatttaaaataagcaatggcatgtaatgtgtagaaccgggacttttggcgagaaagtgacataaagagtagaacagagcacttttgaaccagcagaaacttatttgctttatctcttagttcataaatgccattttcctcaatcatttactataaaactaaaactattctttaaaaacctaagtgatttctcattgttactgttaaaaagaaatgtgtgctatgccaaatacaattcaaatgaatgaccattttatgttacattttcatcttattccttcatttatgctagaaaataacaaaagtaaaaatgcaatgagaaaagtatcaaagtcatgtatgcagattcagttgatctctttgggcttgactatttggcaacatatgttggccagtttttataggaaatctatgctaagtgtatgaataaaacagagacaacgtaagattagacactagcttcagaaaataaaattttgataatacagcagcctatttagtaagaataaaagcagtctcttggagtgtgggatttgtatatgtgattaagaaatagagacaaggggccgggcgcggtggctcacgcctgtaatcccagcactttgggaggccgaggcgggtggatcatgaggtcaggagatcgagaccatcctggctaacaaggtgaaaccccgtctctactaaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccgacctgggcgacagagcgagactccgtctcaaaaaaaaaaaaaaaaaaaaaaaagaaatagagacaaggaaacatgatagagatagaaaactaaaaaaatgataatttaaatctttaacagtgaatatgagcaaagatcagaataggaacctatttattatcatatctatatcctataactgaaaaaatttcctaaaaaggagaacacaaaaatgcttggaagattttcttggataatgcaaaataccctgggagttctctctttacctcttagttcccccacatttaaacttcaaaagacaatgactctggagcttgagagagatcgatatttaaaacagaaggcatatctataaatccccattggatgtccaaacacttataaaaaaagaaaattaaatttcatttatcaagggttgaatagttaaggtgtcactaagagaccaacttacattaataagttcaacctcccagatttttttcaacaggtccatcgaagtgtagccattaattagaaaggctttggtgtagtcgcccagttcaatggaatccagccactcagctacagaggtgggatggtagccatcatgcccaatgggtctcatctgtaataaagaaaattacattaggattaaactgtatactttgtgtcccaacaacagaatgcagatttccccttgaaaatttatttgacatgaagaacagatctttctggagacggaaacaaggaaaaagaaaacactttctgatgtgttttcacaattctaaaacattaataattttcacgctgaataggttttcaaaatatacacagaaatttccaatttagctgctagattaactctatatttggaagagctaaacatgtcaaacttctgtcatagacattattggcattctggtgggtggaattaaaaatgatgtcagttgaatggcattaaattcgatgcgaaagtcaccaggaagtgcactttcaacatgtagatgataattctcatatgcacagcaccaaagcatgtgaaaatactgcatgacttaagcattcaaagggaatttgtgcttatgcaagacatgtattggaggtagtgcaaacacgctggagaaacatactgctgcggtgaaccagtaaaggagaggcctttgggtattttaagaccatgtgttctgcatcgactctacagtatgttagacatgaatagagaacttgctggcagacaggcatctattttttgtcagctatatacagatttttaaaaaataggagaacaaagaaatgtgacagcaacataatgtttctgagtttaaattggagtgtgaaagtaatttaagcaagaggaacttctgggtttaaaattttgtatggattattctggtcctttagcttttatttgaaattgtagctgaatctgtggttcttggttttcgaagtgactcacttctaaaacttgggctgctttgcatgccacgccgtatatctaatacttcagtttttcaggagagctggcacctcatcaacctgatgggggccttcggtaaaattcacgatggaaacagcaaggctgggcaaaacacaacatagattttcctctttctttgattcaaagagataaatattaatggaaatttatatgattctgatttgcgagcagagaaaagattagtctgggaatcagggattcagattttaatcttaaacatggtaagctttctatcactatgcatggttctcatttttgagattctccctactccttcattttaaagttactttttctcttttccagttgttccgctccccattctagtttccatttcaaagtttaaatgttctctgttttattttattttttttgaaatggagtcttgctctattgcccaggctggagtgcagtggtgtgatctcagctcactgcaacctccacctcctgggttcaagcaattctcattcctcagcctcccgagtagctggaactacaggtgagtgtcaccaagcctggctaatttttgtatgtgtctctactaagagacagagtttcaccatgttggccaggctggtctcaaactcctgacctcaagtgattcacctgccttggcttcctcccaaagtgctgggattacaggcatgagccactgctcctggcctaaatgttctctattttaaagttagagtacaatttattatttacattagagtctgaacttggtcagacttttgtacttcacttttacattgactgacccattttagctactcattaaatatttgttcatgtaacacttaactctgtgtttattatgtggtagctacaaatgtaaatgacaactcagcatttgcagaatgaaagtcagtggcattcacaaatccctggatgttatgtatgtataagatcagaggctaggacccaaaagggaggctcatagatattcggtagcttcatattctatagagaattacaaaaatattggggctgggtacattctccaggcctcgttaaaaggtggttgaactaactctgttaacctaaataatcactctggccccaggaatcttcctgactgccccagtgacatgaaataagaaagaaagggaagaaagtgagaaacactaaggttgaagttaactgcttagtagggaggtcttgccgttggcccatccataaagctgaccactccagcagcagatactcgggaaaagcttagggagtcttgatgactggatttgggtcaaagtcagttgtctcataccagtgaactgtgcaatggggttaccacaggttacccccaagcacttacacaacactcttttgaggaagcaattagtggccatctgacacacagagggtgttgatggtcggtggtggccaaagaatcagggaacccatgacaggactgcaaagaaaatctaggtaagtacaaagatgtttgcttgtccctccaatccccctttcttgtcccaatgccagaaaatttagaatcagaagagagaagtgccagtcccttaggggaagtctaaacttgggggggggggaggtggtgaggaaaataaaactggaggtttcaaataaattggaactgagccttcaacattttacatggttggaaagttattggaaatgtctgagatgatatttataaatagtaaagggagggtcagttgagcttggttgaatgattggaaaataaaaaaataaaataaaacagcaaccatcatatcaggattgcacggaatgcaggctgttcagtggtctgattactcctgtaaggcaagttctcctagaccaatcttaaagaggtgagagggagggaaatatttggtgggaggatgaaagacaagggcagggtagagagcacaactgaagagaccttggaaatgggtatgctgaggtgtacagggcagtatcatccgcccactcattcaataaatatttaatcaatgcctattctgatgaatgttgtggaaatggtagagaacaaaacagtcatagtctctccctcatggagattataactcttaattaaaatatgcaaacagatgaccaataaattatgaaggttctgcatacctgaagagaggaaaccattagagccaaatgcagttacaaaattaacttgacacatatttaatgatatgcagaatagttactgtgctgcacaataatttcttccaaagcaatgatcccatctgttcctttatttctgtccctactgccattaccctgtttaggttcttgttagtgcttacaaaaactaacacaatagccttctacatggtctcccacctttgatccagcttgtatcttgctactacattagtcttcctaaaagtcagacccttaagtgtacctttgtataaaagcctgtagtggctccttctcgaaaaaagtccaaatgtcctattccagcattcaaggccgattgagattagcctaatctcccactcctctgctattgtgtacccaataaatgtaactagacacgtgtatgtctaaacagtacattaaatcgctaggcattccctgaaaatgacctgtatatgacacagtcaatatctttgctaatataacttcccatgcttggaatgcttttgcccctgcttctggagtgatttcttcaggactggcttctcttcttgagctctgagatgcaaatttctaaccatttgtaggacatctcacataaatgtcctataggtgtcaccaacataagtcaaaaacaaatttaactcctttagttcaaaaacaggctctcttcctctttttttccatttcagttaagggcaactattactccactgcccaagcagaagcttgggagttatcttactttcctctttctgtttactatcatatctaattaggccaacatggtctatcaatttgatttctaagatgactctcaattcatttctcttcttccaaaatggactttggaatatgacattcccagcagtgctacgtatttgttgggtgatctttggcaagttactctttcagcctgtttcctcttttttagaataagcataataatacctattccaagtgttgttgtaaagattatatgaaatagggaataaaaattgcctagcacagtgatttgaatataatagctattcaattataactcttagttctcttttctccccattgccctaaattagacccatgcttattttgaaattgcataatattctgccattggctgctagtcttttcagcttccaatcaaagctctcctctctcatcccttcctatttcctctatttccttccttctttatcttgttttagaaatggtttgcatctgctaacatctttacccctctccccttcagccgacagttattttttagaaacatatctaacgaggtcactcaagtcgattgaactgtttattccaattcttcgttctcttactgtattagaattatgcccctgtgccctttgccaagggatcaacattatgtctcagtgtggctggagttacttcccagtctcatcaatgctggccaatagaatgcgtgaagtgtcagtgtggtggttagagacgaggtctctgtgctcctgtgttctactaatctttcagtgttcatatgctctctcataagaatagcaagtgctgagaagttgcataactcctggttctaggagaaagatgaagactcgtggagcaaacctaaatttaacccaaagcttggaatctaccctagctcgatggggctcaggaaagtccagatgaagttagctgaagcacagcagacccgtgagtaagaaaaaaatattttttgttgttgttgctgtgaactactgaaattttgattacagggaaaaactgaatagtcactccttgtttaaaaacccttggtgtttatccattatgcctgtggaatataaatcagaccttttagtttatgaatctattggcaaatgcatcttcatgagactgagaaagattagggatgctgaataagcaaacatcagtatccttcccaagctacctcactgtcatgcagaaactctgcatgccacatcttttttttttttttttttttttaagacagagtctcactctgtcacccgggcacccaggctggaatgcagtggtgcaatcttggctcactgcagcctccgcctcctaggttcaagcaatcctcccacctcggcttccctagtagctgggaccacaggtgtgcaccactacacccggctaattttcttttgtatttttagttgagaccagggtttcaccgtgttgcccaggctggtctcaaactcctgagctcaagcgatctgcctgcctcaacctcccaaagtgttgggattacaggcacaagccactgcccctgccctatatgctgcctctttattaaccctaaactaagtaattctttattgtatgagtttgatttttggggcataatccactgtacatgtaatatacctccacatcttcgctcatgccattccctctgctaggaatacagtttctactttttctcctaatgaaattctatctatccttttttttttttttttttttttttttttttttttttgagacggagtctcgctctgtcgcccaggctggagtgcagtggcgcgatctcggctcactgcaagctccgcctcccaggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggccaattctatctatccttaaaaggtcctgtttaaacgttacctcctgtgtgaatctttctctaatgttaccattattccaccgaaaaatcatatcttctgctatatttctgtagtattttccatagagttctattatagtattattaaagtctgctttcaataatagagaagtgagtatctgtcttcttcattggactgcctaccccttggtgaagaaatgaggtgttaatcatttttgaagtccctaaatcgtccagcagagcatctcacatatggcaagcatatgctaaatgtttgttaaattaagtgacttaatgaatacatgaagacaaaatgacaaattcatttcagtggcttggtatccatttgtgggagagatttgtattttgtactccatgttatgaaaactaaggttatctttttctgcctaacaataacattcataactatttaaaacctccatatatcaagaaccagttccagataggatattgtgttacagaatgcaatggactttgtttccatagcacagaagacttgattctattagccatgtagccatgggcaagtcacttcatctctctaagcttcagtggtgtcagctataaaatgaaggtattggaccaaggatctcaaagctgctttgtaattcctaaattttgcaattccatgactcgtaaattaattttaaattagtaacctatttgtttacccaggaaagaaaaaataagcccaaagacaaaactaaaattcatatatatatatatatatgataggacgtgtagactaaaggtcagatggcattcacatttctttcatgtatcttcagcagtacccacagggagcactgtgactgcattctcaaattagcaatgatgaaactttttttccagcgggaacatctggcaagacagggctaggaagtgacagctccatcggcctgccaggccagcagtgctgctaagcatgaacggaagtcaggctcactctataatctgagaggcagagtggtgagcaggcagcaggcattcattacagaggctcgcaacaaggcaatttgattcaattagttgaattccaaagtctggaaaaacctaagctgagacagaaattcgagatagcagtgaagctttagtcttgggaaaattgagatatattaacatattttttttttgccaaatgccttccttgttcttgttccacccaaatgactttcctccaggagttttttagagcatacttggcctcagagagagtatgctgttaacatcacaggtggtacagcaggcagagaaaccacaggacagtactctgtggagttctgggtttgagggggtcagctacggggcagctgaacaacccatgctctgagactgcttgatcgacttcaaccagagtaactcttattttatgcgttttatacaagtaagaggaagaaaggttttctcggctttaaaaagaaatgtttgaaaaccacgaatctagaagacttttgtaagattacatgaccactatgattttattttctcttaactttttagctttatttgaaatattatggatctgttatatatatgtggttatatatatatatacacacatatacatatatacacatcacacacacacacacacacacacacacacacacacacacacacacacatatatatagagagagagagcctgtcattccatcattctttctctttgcctgaagccagcattttctgtgcagataaggataatatcttatgagatgacggagccacaggatggaaggtatagcaggaggaaggcaataaaaacaggtaaaaaaaataaaaagagagagaaaggtgatatacattataatagctttgggattaaatgagaaaagtagttcttgatgggacaacttattaacctagaattatgatattggcatggtatttagaacaagaggataaggaaccctgaaaagccaataatggattagacaggcatttttatgtccaaaagtgttagaaaattgagaaaaagactacttgttgttcccttaaacttgtcctctcttcttccacataatggggttaaattgggttcatgcctgccggactagagacaagatacatcagctttttttctggttgctgctgtgaaaatatggttgagcctgtggaatgctaatgaaagtgttgcatgtaactttcaggtcacctctagctaaaagaagttcctcgacctagaattcctcttttttcttcatcttcctataagctggaacatcagtgactgcagttcagctttgactacacaggcaaaacaataccctggagtctgggaaatgcttctcagacctcaacgtgcttaggaatcatgcagagaatcttattagcagacgattctaattccgttatttggagggaggattggagattctgcatttctaaccagcttcctggtgatgctaatgctgtcagcccatgaaccacactttgagtagtagtgctttggaggatgacagaacaacaaatagaaggtcctcggtccttccacaattgcatagagcaaagccaccttgtaaacctgcactgctcatttcaagactattatatgagagaaattaatattcgattctttaaaccactatattatgaatgtctctatttcagtatcatagcctttccttgaatacaaacataactaaaaataaggcagtttcatgtagaacatttaaatgaagcctgtacttccatttgacattacattgtattatctcttgttttgtggggccgtaagttttcacatctgttatcgttaaagaagcttcatttcctttaactgtgtttgttggcatttctctgtcaatcacagcatcatccctttgtaacaactatgcaagggataagaggagaaaaatgcagggaaaccccaagtttctagcttggatatctgggcaaatggtggtgttaccaggtaaaagagaaaagaaaatagactgggatgacatgaataattttgagacatgagaaatttaagatgctatgctgtggaatggcactttaaatttggagaagtctggggagacacgcggccttgggcatcatcaaagtacaggtaagagtgttggcaactccacttattagctatctgacctcgagcaaatcactcatacttcctaagcatccattttctgattagtaatgtgaaagattaaaagaatatctatcgctgagcgttgccatatgtattcaatgaaactacacaaggagaatttagcacaatacttggcacacagaagcactcaataaatctttgttattttttttctgacagctgaaatcatgcacaggtaggactgcagaggtgactttgtagtgtgagaagagaagtggcctgagaatgaaccaacactttcaatgcataaggaacagataaaaataatactcaggagaccaaagaaggaatggtcaggacaagaaaagaaatgggggaaataagagtgtcaaggagagtgtggtcagcagtgaggggatgctgcagagacgtctaataaaatgatgaaggagaagggtttgtgggatcacaaataggtcatcggaaataggtcaccagacaccttattgagaagagcacagaagctgagctgccctaggttggggagtttgtatgggaagaaaagggggagatgagattttagaaagcacagaggaaaacacatggaaaggggtaaagaaatgaggactcagggttgagaagggtcagagtcataaaacagttaagttccagggtgcagtggagattgcaggggagggcttgccttttgctttgacactttgccctcctttcttgaaattacggatctgacaaggatggttggagctaacttcagggtgaatactctgtgttaaaacagtgcgagtgtttggaagctacatggtttagacttggtgagagctggatgcttgtacgtgaagtacctgtgaccttctggtgaaggtcctcacgtgggcaagagctgtcgcctgtgttgtcttcactcctcagatacaaacacagcaacctatcatttacatagacccaccagtgccgatatccctgatgtgccaggctcagctacttaaacttgcctaggaagctgccgtggaccgtggcttctcttttcccacctggatgtactttgtacactcagatttcctgcctgatatggcttttgtaatacagatagctgatatcgtcaggtacttccctctattctggctccttgttctagactcttctgctctgtcctgctgctacccaagtcttggactaacagcagtcctgaaaataaacgaggacaagcagtgctagcagacagtgtgctgccaagtccaaatgcaggtctatcaagtagtgtgaggatcaaatctacaggctgtgagacctgggcttagacatcactgtgctgtttcatcagtggctcttaaaaggctgattgaacataaaagagaaaggctgatcttctgaccacgaggccccagaaaaaagtctacctatcaccatctgagtgctatctacggcagtgcaactttgctgggagggacgtctccaaaatgctgagcactgttaatgataagaacatcacttaacaatgatgtgggactttaaagagcctcaagtgatttcacgcatgtcacctcagttgtaaagtgttttaggtgatctttaggaagacaccctttaaggagtctgagagcctgagtatcccatataattatattccttctgtgggaatggaaaggattaatatactgtgactgttgttggaaagcaaggagtgataaactctctgtgttgtgcatctgtagcaagggaggtatacatgtacaaatacgtctgctacttgcagctcctttgtttacaattagactctgttatggatacaatttctataaaagaataaagagaaacataaaccctcagaagtaagaaaactgtgtctgatgtcactacgaactcacagctacagaaagtggtaacccctctattatttttcccaccactgactgagccttactgatttggggttccttgagtgttcagatattgaagactcccagctgtaggcataaggcagaagcagtgaagaagtagtatctggatattacttgatactacatttttgggaaataaagggaaaggaaagtgctttggactagacactgtctctcaatgttctaggttttctatttcgtgaaaaagagaaatgaattaaggtctattccagagagggcctgaggtatccctaattttgaaaagtcttagatcatggagtaaaatagaagtgaagcaatggacagcaatgaaggactagatttaaaaatgttttcaagacacataggggatcagcttccaacagcacagaatagcctagaagcactagactggccctgtctctagtcatcagggataggggcacgccctctggacaaaggcactgggaagactacaagttaaaggagttaagttgccaatgcagccaagttctataaagcatccttgggaaaaaaggtcaaccgctacagcaacaactacaaaacaatctgtcttatttcaagccgtgtgtgagagctactagtcaggcactgctctttttagcttcatctgtgcccagggagattaactctatctgtagcagcacttgagaaatgctatctgccatgtaggatctgtgtgggatgcagatgaaaagaccagtagagccctaacacagtagacatataacatggtccttggggttgaattattttattgaatggttttgttgtacctctccctgaagctttgcgtaaaagaggtgtttttaaaaatttaataagaggaaatgtttttaccatcttttcatttctaaaattcttgttgaggtaatgttgaccctagagccttttgttaaacatcgttatttgttttgatatgtttccttgttgcaaagctttttttatgaagcaagagttcagattaaagatgaacagaggatttactgcaactagaataaggcgctgaacaatgttcactagcattcacatttccaagctctactagtgatgtgaactatatttagaaaaaagacacggggtctctttttttctctgacagtacatgttttctgtcattcatgcagctatttggtggttatatagtacactgctttgctcttcaaacagaaactttaaatgctactattaatcaggaatatcatttgcatacttttagtctcaactaaaataatttccccaaacttgagtcttcagaagataatgaatgccctgaatgtcaattctatttatttgatatttaaaaaccatgtcctttctcagagcctccaggcacatgcataataacataatccacagaagtacttcaagcagataaatgtaccacacaaccagaattagcagtacacaaatgaatgacttatgttctacctgggtagagcagtacaaaatatgtcattcacatggtggtcaaacaggagtatactcacgttcacttagggagttacaaaaatgaggacctaccatccattccattcatccatccatccatccatccatccatccatccatccatccatccatcccatccatccatccatccatccatccatccatccatccatccatccaaccatccatccgtccacccacttatttactcaacaaatactaacagtatgtttgctatattctaagcactgttctggatgtgtcagtgaacaaaacatatgaaggtgccagtccttgtggggtttaccttctaagtggggaagacagataataattaataagcataataaataaagtatatagtctgttagaaggtgataagtgctgtgaaaaaagagaaagtgcagtggggggatcggaagtactggagtgtgtgtatggtgtggcaggtgcagtattaaatagcgtggttaggggaagtttcattcagaggagaagatttggacaaagatttaaagacagtggattggctgggcacagtgactcatgtctgtaatcccagaactttgggaggccgaggagggcagattgcctgagctcaggagttcgagactagcctgaacaacatggtgaaactctatcgctactaaaatacaaaaacccagccaggcatggtggtatgtgcctgtaatcccagctactcaggaggttaggttgaggcgcgagaattgcttgaacccaggaggcagaggatgcagtgtgttgagattgtgccactgcactccagcctgggtgacaaagcaaaactctgtctcaaaaaataaaaaagtaaaaaataaagacggtggattggctgtgttgagggtgaagatttcaagtagagagaacaactagagcaaaggccctcaggaaggagggtccagcatatgttcaagaaataacaaggagaccaatggggttggagcagtgtgtgtgcacagagaagagagggaaccaggggccagataagtgagggcttataagacctggcaaggattgcctttcaatctgagggaaatggggagtcagggtatgcatttgagcagagttgtgacatgatctggcttacatttcagcagaatcactttgactgctgtgttgagtaaagctaataggtcttttcagaggctgtggaagtaattcagaaggaaggggctagtggcttggataaggtactaaagtaaaggcagcaagaagtagttagattctgggtatcttgacggtagaccagcataatttcctgaaacacaaaataaaatcatccttgttctctaacatggatcaggaatctgtcagtttggtggttgcagctgtgtgtcatgggtctcagcttgaagaggactgtattcgttcatcgtgtgtgggaacatatgggtgactggcagggacaggcttgcagcagtctgtgctcagtgaggattccaggggcctggaaagactctgctcagagattcaaggaataatagatgagtatcagagagaatgggtgattctgaatgattttaaaatctggcactctgactgtgccctggccagtctcccatggaccatcccttaagatgaagaggtttcaattaaatagctgtatcatgaaacatttttggacattgagaacaaaaggagtaggcagaattagcaccagcaactttgtcagcaagaagagatggtgccatattgcagatattggtgccctcaacattgggcaccagcagttggcaatgatggccactttggcaggcttcagtggcattggcagaacattcagttggcattggctaaggtgcccttgatgggaagacactgggtatcatagccagagacacagacatcagtacctttgacacattgggcacctgcagctctgaagcagcccttggcattcattagtggcagatttggcaccttcagtgagtatgaagaggactgagagcacttttggtaggtcctggtggcactgtctcaagctgtggtgacagaagacatcaccacaataggctagagcaagagaggcagaaaagggcagatgtctcatggtcagcggtagtctagttaacagtgcacatgtgacaggagacactttgaatgaatcattagaaggaatttcagtaaggcctagaatatgcagagaagtgttgctctatgattgttgctgttatcctattttgaagccctggttggagttcctgaaaaccccttttatatttatagttaagggataatctaagaactattccactaccattggagtgagaacagcagtcacaacaaaaaatagcttgatctttaggaaaatgtttccagcctcatagtctgttgtatgtgcgtgtgtgtgcatgtgtgtgtgtgtgtgtgtatgtgtgtgtatgtgtgtttgtcagtctagaatttctaattatctcagacaatggagtgactaagaatcttcagctctatttatgggaatccccagtagagtcactcttacaatagttttagtagttattatttatttaattcaataagaatttttaggcactatagtgcatcatatgtataacatcattctagatattgtatatctaggacaatatatatataacatcatcctagatattatataaatgcaaaagggaataaagttcctaccttccaggaatatgtaatttccttgggtatacatttgaaatacatgcaaataaagttctgtgtcacttaacaacagggatacatcagaatgtgtccttaggtgattttgtcattgtgcgaacatcagacagtgtacttacgcaaacctagatggtatcacctgctaaccatctaagctattgctcctagtctataaacttgtccagcatgttactgtactgaaaactgtaggcaacttaacataaattactaggtgatggaaatttttcagctctattataatcttatgggacctcttatatatgtggttcatcactgacccaaatgttgttatatggcacatgactgtatacaaagataagtgccagtttttataagttctagaaaaaaatgctagagtggattggaaacatttgggtgaatttcttttatagtttctcttggggttaatatatggtgaagtaagtgattgtatgtgtgcttgtgtgtacatgtttgtcagagagagggatgcaggtgggaggggtggggggcagagagagagagagagagagacagagagagagaaagggagggtgaatatggacatccatttctctttattgtccctagtcctagtcctagtcctagcaggcacaggcagcatcctctgtctgaagtgactccttcaatgtcctagttggctaaaaacacctgttcattctttgagattcagttcaagcaccatccacctgcccaaaaagctttccctgatccccatgcatttagctcttctctcctcttgtagcattttccacatagtattctagtttttgacatatctatctctgtctaaaatgcaggcagaactccttgaggcagggaccaagtcttctccatgtttccattcccatctctggacttagcatagagctgaaatgaatagacagtctgattgaatggatggacaatgagcaatttgctaatgaatgtctgtgcatggccgtgtgggtgtttgcagacgttatgcctctggagttgctctagcttcctttcatctacctctgagcctgctgggtctcgggacacaaggtaattgttactttatgtctacatcacgtggcactcagaaaagtgatctggctgaagtgcatgataatgtaattgagtcccagaggtgacaggcagggaaattgatctctctatatttactgaaataatctcttgtacatctgtggggaaaatttcacattcaaaactttcttatgatacatttacctcttagtatttagaaaattgtaaatacaatcctttgccaccaagcagtagcttccaagtaaagaaggggttgagggttaaaactaatataatgcattgaagaaaaagcttttaacctgtcaggactctgtgattcataaattataaccttagaaatcatttaaagtgtatccatttagcacttataccttcatgaattcatggaacaacaagtaaagctaaaatgtatttcctcttgaagacatgaaagaggaatcttgcagtttcttgggtactcgtttcctttgataagggcagtagttatctattaactgaatgtctatttactaaaatacaaagcaatagacttgtgtgaaatagtaaaaatggccagtcattttttccccaagatgagtaaattgatgggtgattccacagagtacagagacggggcactccagtaataggaagtagaggaaagcagttaagggcatagactctggagccagcctggccagtttcaatcctgactctgacacttactagtggtgtgacctcaggcaagttacttaacttctttgagctttaatttcttcacctgcaaaatagggatttaattttgagatttaaatgtgttaatttagagttaatctgaagtacttagaatagtgcctggcacgtaggcaattttctatttaagtgattgctattaacataggggtttggcccagaatgtctttctggcatgctgaggaacatcttggggaacgtgtattctttagatagagttcactatggatccacagaagaccaaccatcaggctagaacccaaagccaaaggataggtggaaggactactggtttgaagtagaaaatctcattgattaccgcccctcctcatcccccacaaaaataaccacaaagaaataccacgtaatgaaacagtgcttagcttagggaaggaagaatagtaactatgtcacttgtttagcctgcttcattaagctcactataggtatttgtttgggtttgaaatatttgactcattatagcttgaaggacaaagtgatgaatgaaatttatagctggattgatggcactagctgtatttcagctgtaataaccagaggatggttattacgaatgagaaaaaatagcatctctatctgcctgttagctaaacatatgctttggatcactttttgcttggagtgtcatgagttatcacaaacttccacaacaaagaagttttcttttttaactttgatctatgtattatttgtttttttagagacagggtctcattctgctgtccagactggagtgcagtggtgggatcatagctctctgctctctaactgctgagcttaagcaaagctcctgagtagctaggagtataggtgtgtaccaccatgcctggctaattttttaatttttttggagagacagggtctcactatgttgcccagccttgtcttgaagtccttccctcacgcgatcctcctgccttggcctcccaaagtgctaggattacaggcataagccaacacgcccagccacaacaggtaagttttaaaggtacataggaatggctttttgattcatctgtctccttctccaggaacctactcctgattccctgaacagaagagaccttcccttttacttaacgtacaaaacttgttatttttactcctattatagcttgtttcatgttctgacttgtactatattaagatcatttgcatattggtctgacttcctttgctagactaaaatcttcttgaaggcagatactgtgtaatttcatcttatttttctccttgcactgtgtcttgggacataagtaaatgctcaattcatttgcagacataacttgaacagaaatatctcacttgaatgccattgatggaaaataagaaatatagccaaattctattcaacaattaagttagcacttatttcaattgtatggtaaaggcaggtgacaatgccttattcaaaatggcgaatatgctgttttacagttttcgtgtaaatgcacacagttctgcttttctgtgaaatcacaatgcctttagcaactaaatggaactacactgtcaagatctgactgctcagcttctcagttcacttccattccattctatgctatgtatatttatattgagtccttgcttctaagagatgcagacaggaagatctctctgtattaggcttattcatttaatctctctcttttttttttttttgttttttgagatggagtctcactctgttgcccaggctggagtgcagtggcgggatcttggctcactgcaagctccacctcccgggttcaagtgattctcccgcctcaggcacccaagtagctgaaactaaggtgcgcgccaccatgccaggctacttttgctatttttagtagagacggggtttcaacatattggccagggtggtcttgaactcctgacctcgtgatctgcctgcctcggcctcccaaagtgctgggattacaggtatgagccaccgtgctctgcccatttaatctcttaaatagggaggcatgagttatgactttaaacaccttctcttctagcttctgatggactaaacaataatctttaaatacatttcaaaattatcagtttagtagatgacaatcaaattggaaagttttgccagtttcttatctagaaaatgaataactgcactgtgagaaacccactagctcagagtagaatgttcactatgcaatgcagtcatgggcatttttagtcacggactctcttaggtcagtaattgagttcttttctgttacttcttggctccaggcaaaagcaacatcaaaaatgtattgatttttgttaatttagggagaatttattgaacaaatgcaagtggtcataactaatattgagttcctctaaatgtcagaaacttcatatgcatttttgtatttatatctcacaatgacctaatgtgataagttccactattatctattgttttatagataaggacactgggattagagaatttaagtaacttggccaaggtgacacaagcagtaggtggctaaactgggattaaattagatttaactaaaagctcaagagagttattttttgagcccctgcaagattgcaagttccttaaagatgacttaagtggattatttagcttactcatctcattatccccttagtatccttagggtgctttgaagtacagcgtttagacaatacagtggggtggttaagaacctctgttaagccgcctcagtatgaattctagtttatccacctaaaacagcattcacagattcccatcattttctgtccatttcttgcttaatagttctccatagcatttatcattacctgaaattatatagttttacttctttttttctgggtccctcactagaatttaagctgcacgaggacagtgaccttgtaagtcttgcttcctaacaccaaattctcaatagctagtacagtgcctggcatgcagtaagtggtttaaaaatatctattgaatgaataaataaaaggagatacattttgcttaccgtttatgcctggagtcgtaattttcaatacaattaatgggccaaatgaaccctaccttttttcttggttcagcttcaaaccttctttttaaaagtgtatttaatagacactaatatagcacatatgctttggaaaactccattttatgtgctttacaaatattgacccatttaattctacagagaaggtgaaatcattacatccattctaaaggtgaggaaccaggcacagaaagatttagaaacttgcccatggtcagacaattaggcaaagaatggagccaagattcaaactcggatagtctgaccatgttcccaaccattccattatgctgcttcctagattaatcccataaaaatgtcatttccctggagtttaatgctctaaagatgtgtctttgctctcttagagaatgaccttccatcttgcctatttttccttcctctctacccagattaagaaggaaaataaattaagattattttacttattgaaacagcacagtatgctatcagtgaagcttctctcaggctaccttcaaggataaataagtgaatgaccccggtggctgctggacagctcacatggcctatatctgcttttcttctttttcatatttgtctttttcttgtatttctagagctcttggattcctgctgcaacccttccttctagccttgagaagggagttcagtggtccatggaggctgcaaaaactgccttttaagcctgaaatgtaaaaggaaggccgattttataaatgattcctgttcttgcttttagtcaattggttctttcatttcctgtcccttttcagtttctttcacaaacacacaagcaactcacagccttgggtctctgatatagcaccatattcactcaggaggcaattgtcatgagcacagatatctgggatttagttccagttcagttactaaggagcaatcttccttggggcaagtcatttaataggactgggacttagtttcctcacctgtgaaatgactccagtgagaggaagagctggagatttaaaggtcccttccagctctaaactgtgattattctttgacgaattatgtaaggaagggaaagtgctcagatatctaaagccctatttctctcactacagattgcaggataactccaagggagccactgttctttattaaatgggggtgaacttctcagaattgaaggatgacggctgctggggatagcaatagatcagaacctattttcctgcctaattccttccctatttctctgtaaatatcagaaggagattaggagtaaaagtgatatttcagctctgtggtctacataataaacgattccaagataaattcttaaaaaaaaaaaaaacactaaaaagttctgcctctttagcttgggaagaatgtagtagccatcttgctttgtgaaactgcacaaaaaacttggagcagagcatgggtaagtatgtttgaattgcgtgctctcacgcccagcagttgtttaaaaatctatccagcccatacagttattgcgattttgcattttgtacatatggggctttgtcatttcaaagggtgcaaagagcttcatgaacaatggccattccttctctcgatgtgaccccgtagaacagactagttattggtcatcacttgtaaacaggaagcatgaatctcaccctaggaaatgcaggccgccagtgctgtcatgcttacatgaaggacatgccttatccctttgtaaaacatttaaaaataaaggcactcagtttggaaatatctttgagcatcctaacctgacccattcagaactgacctctaatcagcatttttgtttggctcagtccagtctaataaatattaactgggcattactatgttcatgatctgtgtgctccatacctaggaaaggaagatgaacatggccaagatcctaatcttgagtaagagacaaattagtcaacaggtggtttttatgaggtgtaatgggaacacagaagggttaaatcatctatcccagagagaagatgttgtaaagatttctccaaggcttaagtattaaggaatgaataggagttacccatgggaagaaggatgagagttaaggtacagaaggagatgatgtttctggcacagaatgactagattctcaggaattctatcacatattcctaggaagagagataatacttcttggcctaatttgcagtttaatgagggctatgaacctgaatcctggtgaatcaaatgtgatttaaagtaagtgatgcatttcctgtcctggcaatagaacatcccaagtgatcttctatgttcctctctaccctgctgtcatggcagcccacaaagaactccaggatggaagggtccatgatggaagaagccagggtccctgaattactggttggaggagagctgcctgacccacactggacttagcatgtgtgagaaataaatttaacagtgttaaaccactgagaatttggagctgtttgttacagtggctaggttcattaccctgatcatactgtgtgccaggctaaggaataataaaagggatctgaatgacttgctgtcacttcaacatttatatagcccaaataacttaggtttttgaccttaacattgattactctttcttcctttctcatccaatggcaccaatgatttctttcttaaaaaggtgatcttttacagtctttcagcaagtcaactgctcctcctgagtatattatcagcatcttgtgtcttttaatgacatttgtctattgtatataattatataacattatatctattattatatctattattgtataacatatataatatacaacaaaaaatgtattatcgtatatataatatatgttttatattatatatactatacatttgtattataaaatatatatcatattgtatataataggttataataggaatataatatgttaatgttatacaatatagcatgtatatataatgaaatatcatttcaaaggtatctctatataaaaatcaatttttctcattagaatacacattttatgagggcaagggcttcatctatattactcattactgtaaccctagtgctaagggaaatgactagtatatagtaagcactcacagttattttcagaatgaatgaataaagataaatataatagaatagaggctgggttttttaaaagaaatggacttcagctgtgttcagatgtaggcgttctgaaggcagaaagagctccaaacccagacgagggttgacagttgctcatatgaaggtgatagcagaagctatgcaggcaaatgaaggcgcctcaggagggtaagggaaggaagaagatgagagaattaaggctgaattttagggaatatcaatgtataaaatagactaagtataagcagctaatgaaacaatattagaaaaagtaaggaaagtaaagagagtattgcggcacagaaacagaactctgtaagaatcacagttttggggtcagatctgtgagtacagcatattcaataaacacctgtctattgattgaaataagtgctgaacactgaatagcatatagtcccatgaagatggtcaaaggggctgactccttttctaaaagacatatagccaatgtcatccctgttaattatacacatttctctgggatgacatcaggaggcttgggttaccctggggcctttcactagtctgataaagtaggctatatttctgatctgagttcttccctgtttagaagattctcagaagtatggaaaagttcttaatctagctggatatttattgataagttacgggtcagtaaactatgcctacagtctaagcctggtctattgcctgtttttttaaataaagttatttggaacacagccacactcattcatttctgaatcatctatggctattttcactctgcaacagggttgagtaaccacaatataggacatatggccagcagagtataaaatatttatgatatggcttttcacagaaaaagtttgccaacccctgagcactgagcatatctgttttgcacccccggcaaaaaaacaaaaaacaaaaatacaaaaagcaaaacaaaaaaaaccccacaagacattttcagaactgagtggagcttgtaagaaccctgggaataccacagcctgtcttactaaggactggacctataggaaatagaatattctgtgccttcggtgagactgggtcccgtcatgtatttactttaggttaggacctccatgctaacagtgcacgtatgtgggtgtgagattctctttgaccgtgtatctttaactgatgtccactgggtggtaggccaacactgagtggcagtgagtttaagacatgcaataaaaagaataaaaagaaatgcaagtgaaaagaatgagggtagatggagagtgagtgatgggatgggagaatgaaaataagtcgccctgtcaaaaggtaccatgagagcatctatgcctgtgggctatattttgtcattgcccttctgaaaaataccagaagaaataagaacaagtttctatcatttttctaagtgacagggaaataagactgaaccttcctttctagacttttaaagaaataacattggttgtacacttttccgctaaagcgtacacacatctgcgtcaaccatcaagcctagaatcaataaacatctgaatgttaaggacttagagagcactagcgtctttaagagaatgactctgttctcttgaagatgctagttctttcaaggtccttaaaattatcttcatagaatgtctctgttctcttaaagactctagttctttcaaggtccttaaaattcagatgtaacttctttgaaagaatgtcacattcctaatactcctttcaaaggctgaaataacctgtgatctcatcatattaagacatttctagagtgattctcttcatctatgacataggggtagcagagtgacacctataaccaaatctggcccccaatgctttgttttgttaacaaagtgtttatgaaagaaacccacagtttttttggggggtgaggaggggcaggacttctgctctccagtgtgccacagtttccaccactccatattgtcttttctttaaaagtgtttgagttttcaatccctacaatctctgcccacaccattttgagggggccaactgttgctttgatctattttcttcgttcaggcctaaaattaaatgaccacttgtaactttctagctatgttagtttattagaacccgttttatttgctaacattcttcaagttttgtccaatagagtttagtagactcactgacctaatatatatggtaaaatactcttttcagtaatgaggcaacaatgaagaataaatacattttaagaaactgtgctgttttatgggattactgatttgtgtatatcacttagatcagtgatgttcaggttatgaagtgattatgtacaatttgcaaatatctagtgtccctaacttctgtattatcttatatcatgctacattatacctaactctacagaccagagacatgtgcctcttttttgagtggcagtagcaaaggtggctcttaaatcatctgactgtgaacaatacagtcccaggaagatggcccaaggaaataaagggtgtttttttccttgtagtttttgacggattattccattttaactacaaatgtggacaatggaaactaggctgtaaagtagatcattataaaatgtacctggccaacttctaagatgtaccccaccctgcccgccctaccccatggtccccaccgtctggtattcacgcccttgtgtaaacacctctattatgtatgaactgaatctggtgacttgattgtaatgaatagaaaatggcaaaaagatgggatgtcacttgtgtgattaggtagcaaaagactgtgacttccatcttgctagcactttcttgtcttctcacttgcttgttctgttgaagctagctgcatgttgtgagatgctctatgtggtgacaaggaactaagggaggcctcagccaacagtgtgtgaggcactgaggcctcagtccgaaaatccctaagagcctgaatcctgcctacaaccatgtgagtgagttaggaagtagatcctcttgacttgagtcttgagacagctgtagctgtctgaaagatccagagacagaggacccaatcaacattgtacctggattcctgacccacagaaattgggagataataaatgttgttatatgccactaaaatttggggtaatttgttctttaacaatacagaatataaatcatctattggaataacagcaaaaatttttttagccaaagcctcaaactgaggatagagaagggggtaatttaatccattcattcagaggttctcagtgccattcagtgaaaaaaataaatatatgtagctccaataaatattggttaaactgagcagaactcagaagtaaagggccactaaaattcaggtgttcattatgtagtaaagtaacagtagcaatgaacaaaagtgaataccagacgtcgcactaagatcaagagtcctgtgataacaatatttactagtcatcaaatatttttgggtttgagttttgaggaactccaggatttaaccgaggagaatgagtaggcagagagacaacagcagagatgcagagagtaactacgtattgtggaagccgaaagaagacaatgttaatagtgaaaatttgccccatggggttaacaagaatccttgagcttgccttgcaagaagacagacgaagaaacagcttgttataattctctctgcttgcaacaaaactggctgactggctgaaactggctggaaccaataaggctgactggagtcagaatggcacagaatagactcgctctcctggggggtgacgttttgatgtcacagcctgaatttccacgtcatgtttcagaccagttccccatgaatttgcacaggcaacccacggaaaagcacgaagggacaactgcgcatgctcaacggactttccaaacttcccattcctttctgccaatcactaaccaaccgggaagccccgcccccagaatctctcccttaaatataccgctttaaggctggtacagggcgacggatttgaactggattcctgcctccttgcttggccgccttgcaataaacctttctctctacaaaatccagcgcttcagtgtttggccgcaattgtgtgcaggcaaatgaacccagtttggttgataacaataattgtcaatagtatcagagtctgctgaagtcaaagtagggtggagataacaaagggcttatggaatttctgatcttctgcttactggtgaccttagcactggttgtaggaggtcgcagcagagaaacaactcaagcccttgagggattagtggagcaaaggaaatggggagacgttgagtatagacaactactaagtaattccaaaaggtattataaaactggaaagcattagaagaagaaatattgaaaaacagcgtgagcatacaatataaaagttgcttatgtgctgaaatatactgtcaactcaggttgagggatatgaagagagcagatgcgatatgagccttgacacaaagtcctgcaaacctttaaaatgaaaatcctttgaatgcctgaccttcaggtgttatattatcaaaggacagaagcgtttatgcccttttaaaaaggaaaatgtattagaggattatccaaagacttggccacatacaattcttttctggaaaaaactaagttttatgttgaaaataagtaatcaggtaatatccctgtgtccaaagagacagaaaaagcacaataaacttaacatttctaggacagtagaaaaaaagccattttcttgtggaactttgggtttgtttcctttcataaaaagggaaaaaggtgaaatttgatcttcaagaagtccaggaaagcttttagagctgagaaaagacagagttggggttggtgagggaagtagactctgggtgaaaacggataattaagctttacaaaaggtcaagcattgcaaaagacagcgagaaagatgcattctatgtgttgaatgtatcaaatgtagttgagaagatgtaaatcttcgcattggtgaatatttcagtattaaaaaagacatattaaagaatagctattcttacaaaaggaataaacttttttctttgaagcttgacacaacatatacaaataaaagcatgaaaaatatgctttgaagtgtgctaacacatcaagattgtactgagcaaagcaccttttctctgtttaggaacaatctcactaattccacaacacaatatgttaattaaaggatcccaggtagcaatcatggaatatttcttctcatgacagatgaagaatacaaatattctgaagactgaaattgtataaacaaaatgaagagacattttgtccgttttctggcagtgcaaagttaaagtgaatgcagatgaatgtgctggcaataaaatgacactattaaccatctgaagatcgggctcattacctaagaaggcaaagcatcaatttgtggcattacaacattctatttgtgctgctcaatgtgcgtctggatgtttttatatactctctactaatttgtgtgcagagtgagctcttctgcatcagcctctctatagaagcttaattttgtattgtttctcttatattattttctctaatgagaatgatattctgtattagaaataaacacttcatttattcttcaaataattctacgttcagtttctcttgttttgcattatcaagtggtgtgtacaggattacagatatatcttaaaattgaggtgctctgattaaaaatatacatttgaatgacatgtgaggaaaatattcattcactcagtcactcactcattcattcttaaaagaatgtctatgtattgggttaagcatcatgggaaattcaaggatgttgcactgtctctgccctcaggatgtttatagcatagaagtggctgaatgttattagtaccttgagataggaacaaggacagggccataaaatctcagaggaaagggaaggtcagtgtattttctcataccacaagtattacttgggtacctactatgtgacaggtgctattctagaggctggatatatagaaaagagaataagacagtcaaggtccctgaccttatggaccttgcttcctgagggtgagatggaaaataatgaagaaaaaaagcaaataaataatataacttcagatcacactaagtggcatgaagaaaaataaagcagagcaatagcaagaacagtgatggtaagggaaggatgtgaattttagctcatgaaggcccctgtgaagatgtcacattcgaatagagatttgacaatgtataggagcaagtgtatgaagttctgaaggaagggctttctaggtagtgggacctttgtaggacaggataaagactttattctaagtgggaaggaaattcactggagaattgaagcagggtatagcatgacctgatttatattttagaaggatcattccagatactgtatagaaattcaattatagaggggtaagaaggtaacctggacagaggttaagcatctgtgaatagtccaggatagaggagaacaatgagaacttgattcatgtagtctaaccaaggatgacagactggaatgcactgtggtagtccatctagatagaggtggttggtgaggactaggttgataattacttagatggtaaggagcggttccattttgaaggaagttgcacaaaggaagtgatatgatatgataatatctgagttgaactttaaatgaatggcagcatgtgacaaagcaagtagtcattcatggatttgttgagtgcttatctatttttatgaaccaggcactgtgctaggtgctatagatacagcagtatggaagccattgctgaaagtgagaacaacaaaacttgctgagaaggtaatattttaagtaaacatacacaagcagagaggtgaacaatatgctcataggaattacttcctgaattggttctaaggatgttttattcttttccatttagtgtagaaaattatgtgattaaactcctttgtatatttggctcagtgaatttgcaaaaggagtaagtgtctatcagtagaaattcaattcactgtcagttgggaaatttcatcagacaatttccttagaaatagtggctaatatttacttttcccacttagggagggagaaagtatagcctctctagaaagaataggaggataggagagtacaaaacctaggacaatctcaaatatccaggtgtatctattacagttcatctgccacctgcctccaatctgccccacagtctttttgcaaacagatgacccaacttcaactttccctccttctaatcccacttgtacactgcctctagaattaactggcctaaagtagtccagtcatgtccattccccagtgcctacagaataaatttcaaattcctcagcctgacacacactgacccaacctactttttctgctttatctctgactacacacttctcaattgttttaatcaccttgaattttcttcctctttttaaaattattttttgaattgcatgaatatgttatgaaatacacataacataaaacttaccatcatcgccatttttaggtgtatatttcagtggcatgaagtacatttgcattgttgtacaaatcccattggattttaaatgtctatttccctcatacttccagcaatttgttgcctgaaccaaatttgtttttatatggttcctggggcctcctgaaatgccttttcccatccaagtactaaccagacccgaacttgcttagcttccgagatcagacgagatcgggcacgttcaggttggtatggccatagatctgaaatgcattttcctttccttatcaattaaaatcccacatatctgaaagattcatgctcagattttgcctcttcctttaggctactttgacaccttatctggaaacaggaggtcaactctgttgctaggtaacacactgcttacagtaaaaatgatgcctggttggtaaattgcatctggactaggagggcctatacatgaactataaatacatgatggggatgtgatactttggacttccctgagtaatgactcgtgtaattaggtcccttgtagggaccatggaggataagtctatggagttgttgcaggagatatcgtctcttatggggcaggaggcttttaagccagggccattcctgcacccacccaatatgaatctagtcttcttgaacctgagctgccacctggggggccagaactgatatttgtactgatattaggactctcactgaagagaaaatctgaagcttccctggtggccagcagtgttttctgtatcacatttttctaggtaaatctcaagctaagggttcatgcctgtaatcccagaagtctggaaggccgaggtgggtggatcacctgaagtcaggagttcaagaccagcctggccaacatggcaaaatcccatctctactaaaaatacatacacacacaaaaattagccaggcatggtggtgtgtacccataaccccagctactcaggaagatgaagcaggagaattgcttgaacccaggaggtggaagttgcagtgagcctagatcataccattgcactccagactgggtgacagagagagaccttgtctcaaaacaaaaaaacaataaaacctcaagccaagtgtggcccatagtagtctcataagtctgaatgtgcagttggacctaagaagatctgctcttgaggttgcatcaatatgtagaactactgtactaaatacaaatactccttgcatgcctggactcaaaatcactgggaaccgtacacaggactagggcaataaaagtattgctcacctttggaaggagctggattgcctgtagaattctttgtctgtgcccagaattaaggattccaatttccaacaaatcctgatcttccataacattgcttccctgaaacaaaacagaaatgttacaagttaaatcaagcatttatactgtggataaataacaaggatttatttaatacagagaaaaccagtgagtgacctgatttttatgaacaaagacatagagtcattcttccgtgagggtgagggcagagtcggtcaccttgttactgatgtgaagtctaggagaaagctcccctcccctcacaaatatctatcgtggcttatatccacatggggttatctgcactggagattcattcgtgtgacttaaaactttgtttctgcacattgtgcacatgtaccctaaaacttaaagtataataataataaaataaaaataaataaataaaaaaagatccaaaaaaaaaaactttgtttctgtaaaaatgtgaatgcttctagtaagagttgccatttaagattatcagtgacttacacattgatatgaatgaatcatttttccccccttgatgacagattttgtgcggaaggctgatagaaaaattgacatatattaggcaggttaaaagtgagagttaatacttaatttcaaaatattgagtcacaatagcaaacacatagaatcaacctaaatgcccatcagtgatagcctagataaagaaaatgtggtacatatacaccatggaatactgtgcagccatagaaaagaatgagatcatgtcatttgcagggacatggatggagctggaggtcattatccttagcaaactaatgcaggaacagaaaaccaaacaccacatgttctcgcttataagtaggagctaaatgatgagaacacacggacgtagaggggaataatacacgctggcgcctgttggagggtggaggatggaggagggagaggatcaggaaaaataactcatcagtactaggcttaacacctgggtgatgaaataatctgtacaacaaagccccatgacacaagtttacctacgtaacaaactgcatgtgtactcttgaacataaaataaaagttaaaaaaattattgaatgccagacaccagatcacgatatgaagattgaatgatgaatatgatgcagggccctacccacaactgcctttattccttccagtcccgtgatggaaagggactgttcaaaggcagttaggtaggatgctgagactgtgctatgatggtgacacttgcttaggagtccagagggaatccagggtattttttcagagaaaaggacatctaatcagatataggaaaaatgggtggttaaggcatagcacctaaaagaggaaggacaatggggaaattatgtgcaaagacctgtgagtaagaaggaatgtagtatacttggaagcatcatgttctgggataatatggagagaggagcaaacggtaaggctgaatgagtaagcagagggcagaccatacagatattgcatgccatgctgagggcttcagactttatcctgaccataatgggtagccatggacagcttttaagaaagagagttacatgctgagattccaaatttagaaacattattttgatttctggggctgggcctcagtttccctacctataaaatgataaagttgagcccacaatgtccaaggaccagttcagtcctaaaattctgatttcaatggttattttaaacctgtgattaatatttgaatgcagaagtttacatattgctcattttatccctagattttaatctttcacggtttgtaagacagagtttctctttaaattgaggcgtctatagaggttcaagaattcagatcactattttttttgacaaatcaaactctgtcctacttatgtgtaacacaaaaacgcaagaatagaaatgacagaatatccatttatttagtgatgagtaccattagacactcaaagcaaaggagaatgaatttgaaagggtgattctggggcatggagaccactgtggttgttttctagaggcgctgtgggcatagactaacgtagtagtcacaggagcaaaaagaagcaggtggatttgcaaactatcaggaagtttgacgtggagattgaacatgtggaatgatgcagaaatgtggaatacacaaaaattcaaggcttgggcagtgagtggaacttgatgccttttcctgccataataaaggaggaagaacagccctggtggggcgcaaagtgagactaacatctttccctggacagggacagaatagatgcatgtaaacaacttaataatatcagactatgctataaatggataactggctgtgcttagaaggattaaagccactggaatggcacaacagctagggatttaaaacgggcattcactggacaaaagcattccacctactcatagtgtcattcttatgcttaagcaacaccagccatctcggaggaagcagaatgatccaggtattcagcagcatgataatgaaaagcctaatgaaaaacaaataaagccagtcttggcaacatgccacaggaaatattgctctcaagaaattactcagtgcacacaacagagcatggctgagaatacaaatgacttcatttagagaaagcgttattatttccagaaatggactagtatggcatgagcgagatatgtgataccattctgacttttactctttgaggagttacctggcccttaagaaaaaatctttcgtcatctttgtgctagaacattaccaggttttccaggtcctaacttaccaacccacaacttcagcccatgtagaatagaggacctggtttttttgcagaaacagaaagcatacgaatatcccatagtgtgcatagctactatctctaggtaatcctgacaactggatttcagtgtttgaatactgaaatgttttggtaaattaaatcctaaagatcactgttcttcctctacacctccaatatgctattttctgtatctcagtaagagaggagtccttttgaagaattatagggaagttagatatttttaaagaaggtgttgagtacataagaacatctttttgagccaaatttcctagcatataggataattgccaaacatttttgaaaaatgaaccaaaattatgggaagcacaagaaaaatagtgaaaatgtgtcaaaggggaaatggcactaattgggaaatggaaaggaaaggatttactgtccccagtgaggcatgctgttagaaattttctattttatctttttctataatacatagggatgccaaaaatatcctagtacatcattcagccagccttttgtccaaacactaggggacttggagtctgcagaactgggtttggatcatggcggggcaaacttggctaagtcatacattctttgtaggcttcctggtcctcacccaccaaatgaagcagtttaatgaatatgtattcagtttcaaaatgctatgatttcagccatgtttgatttttggttggtatcattatatataaatatagattgtatattttgaaattatgtttcagtgtttcagaatttgtaacctaaaattagctttaagaagtgattaaagagaaattcaagaatatatatttttttttgacaaatcaatcttggtatgatggacttataaaatttcttattaaaggaaattataaggtaacttatttttgtagtagtacggattcttatagcttttcagggaaaaacaaaatgtttcaaaccttataactatctaaccatttctttggcacctgggtgacagttgtgccatcaaagacaataaacattcccattcttcctagggagctggaattaattctcactttatcacttgcctttactaaatgctagcaaatctcagtttaacttctgttttttttttttttttttttttttgagatggagtttcactgttgttgcccaggctggagtgcaatggcacgatcctggctcactgcaacctctgtctcctgtgttccagtgattctcatgcctcagcctcccaagtagctgggattacaggtgcccgtcaccatgcctggctaacagggtttcatcatgttggccagggtggtctcgaactcctgacctcaggtgatccatctgcctcggcctcccaaagtgctgggattacaggcgtgagcaaccgctcatttttctcaataaaaactgaacacaactctagctttcttcctcctccatcatttttttttttcacataacttttaggtcaatgatttgggggcagagctccgtcatgtccatcttctgtttagtcatctactacactgcactctcaatctcctttcctacccagtacactccagtcccatgttttcatctcccattttcctcctcaacccaccagaataagctgttcccccccatcaactccatagaacttctctgtcaaatgttaagaatgacccctcaattgccaaatatagttgattcttttaaatcttgatttcaagaatttacttgccatatgtaggtgatggccaccatattggacaacaaagatacagaacatcgccatcattgtagcaagttccattagacagtgctactctacagttagagacattgaaactttagtcaaatcacaaaaatggggcagtagcagggaatcaaatcagggactcaaaaatactcatgagtttttctcaggatgtagttattcatgtgcctcttagtcaaagttcatgaacattaagtttaggatctttagcaaattctcttttaattcttcagtcaccaaaagaaattagaaggttgttctactttcagcaacatttctttatggtggggctataaatctatgctatgaaaatgacaagtccaatcactaaattatttttgactttcttagcatccaccaatcacactgcataaggtgtttaaataacaataatcaataaataaagttgtttagttaatgactttctagaatgatcaaagacccaaatgcagtatttttagaatagctgttctttgcctgtcaagaaatgtctaatgcagggtgtctttattgatctcttaaatcatggaatggaaaaagtcacctaatgttttatgcactaatagctgaaagtggaagtttctttgaccacggggagaatatcttaggtactgaacttcttcagctgtgataaactgttaggatgcccaaatagaatgaaaagcagtgttttgtatttaattattcattagaagtaaaacagctatttaccaaaaacatctcaaaaatatctgtactgatggctctgtctctccaaactctgcatttaaaatttcttgtagttttttaaacttaatacgatatcttattcatttagcaagctttccttcatattatatattgtagaaaatgttaggaaaatatatttaaggaccacagggaactggcttattcttaatataaacttgagttggataatgttatttattctcttccttcatccagtccaagactaaaaaaatcaagatgatactgttgattggggaaacttgtttttgctctataattagctaaattagattcttctccacaatttatgtgaccttaaatatttaaaatagaatcactgtataatagaatgacagcaagatcttacaaacttacacatagaaaaacatgtactttagtttgcttttaatatttagccttttataacataaatagcatggtagcatgaaactgtacataattttcttggaataacaatgctacctctctgcttctataaaagctttgagtcaatttgatatcaatttacaagtaaacccaatgcatgtcttctctgcatgattatgataatggttattgtgctaaataccagatttattattcctctgtcagtgttggaacaaagctttatttagcttatcatatagaaacacgggtgactataactgatcagataatggatgatgtgcttcttccaactttaacttcctctctcacattaatgaaatggcagtggaagaaaattctatagtacactaaaaaatccctctaccctaatcctccatttaaacatattctgtctaccgcaataaaatttcttgcatacaacttaagtaaattttcatgtttttagcttatgaagaaagctttctggattcttcagactatgtggactattgattcaaaaaatattacatcactgaccaataagacatcatcttatatgtgcaagctgtgtattttaataaattatatcttaaggttaagatatagtttagcattatatatttaacagctaccatgattacaatgaattttctgtcaccgattttttcctctttatttttgaaacccaattcccctttgaaacatctgttgtcaagctacagagaaagagaaggaatttaagtaaccaggtatttatttgttaaagtatcgagcaggatttggtgatatcataaattataaatgtaattcacttgagatgtgttcatgtaggttttagaattatgtgtatttgtaaaagagtgcaaaataatttatacagtaatttgtactgcctttggtcaaaaattttatagctatgagagaaggagcctattcttcatttttaaggatgctaacccagagctccttcaagtaagaagaaaagttgatgtgaacaaaacttttttgtatgctcttacttctctccagatgcatatatctgtataaatataaagctgatgaatacctactgtcttccttcaactttcacactgatagcagttggtgttcattagtgtaaagtaaatagcacacttactgtgtcaggcactgttctaaataccttccatatattactttatttaattctcacaataactcctatgaggtaggtagcttgttcccatagctgataggagactttctcaagacttaccctatactacctctagcaggaatcatgcaggagataaaaggttgagttaaaaaaacatggttagatccacaccatttatatttttacttcagagtcatctgaaattcacatttgaaagcgagtgttccaatgcatttatgtttgatttcacagtaccgaagcaacaatgaaccctctctatggaagagaacttggagagctgtctggcctaatcttccctgctttgctccagtcctttctgttcactgaatcctggaatcaggcttggcagggacctggggggtttctagtttctagtctaaacgttccctaactacccacaaagcttcaacttctcttttgaagtgtggtgtctcactgggttgacaccatccccagagaggtagggaggatattaaatgctttaaatggtctttcccagcagctgagtctgagcagggggtgcggctggggttggggtggcacctctgtcctactcttttagctcccactgtggtacagaccaagtgttgcaggagagctatctgaagaagaacgtgccagaagcggagatgaaaggaaaacagttagcagctgtcctgtgtccttttgtaatcacaagctgtgaagctgaaaaaaaaaaaaaaaaaaaacttccttgggtaggctgtacataatcttggcagatatctgagtgttgttcttctgtctaatatgctgaacgtttcccagtgcctcacaagagaaaagtgagacagggttaggtgagtttggacaccttgctccgaacaggcagggaacatggcgcccttgtacgttcatcaagctcttgcaaatgccctgtcactgtagatgctgatgcagagctccaaaaggaagggctcctctgcaggagaagcaaaaagaatttgctcctgggtattcccaacacagccacatataatgacgcagaaagaagtacctaaaaagattaccagccattacattcactgtgtagcaggtacttcacccaccttatttataaaccttacagcactcttgtaacataggtggtattattttcatcttatagaggaggaaactgagtctcagagatgtgacactatggagtcaagttcacaagataagtataggatggatctgggatctgtgttttatttggtcagactctgatgctgatgcttccttcactacataaaaagaaccaaatgtttagtaggggacattttctggatggagattccggtccatagatatgtaacgttaccaagaagttactcccatgaccctattttcacacacacaagcttacatctatatttacagaccatagggagtgactgccagagtttctccaacacattgaatttcacataaattatttatcttctgaaaggtcaactggttagttctccttctaaactaccttagtgtattccagaaccaaacatgttaatcaaagtgacccaaggtgtttgtggctaaagcactaactaacttgccatgtttcctgctgtgaggcaggaagtatcagcatggcattaggttgttgtgagagattcagctcttctgcagtgccttgtcaaacgacctgactggtcaactgggaaaatgaagttctcagggccaacatcgtatttgggtgtttttcttttaggtctgtatcaaagccagatttaagaaggagggtgtctacaaatgaacgaaagcagaggatgtctggggacaagctaaggacatttgtgtcccacactgcatgtattctgaatccagagaaaagagagtgagttgcagtctcctgagaaggctatccaggctaaggagcctgtgatggtgaaggtggataatttagccctctgagaagtgtagacctgtcaaaaaggagattcgttaattcttcaaagatatggttgtcttcaaagaacagacatccccagatttaaggatgatggggtctcttgacactgagaactacattcagaaatagccaaacaagaggaaaggagcaaagaggaagagaaagggagggaggaaatgagaggaagtgtttattcttaagggtgaaggtagtggtgaagggagtagaatttcctgataaaatacagaaattcaaatttaagtggcatcatgtatttttattcacttaatctggctgccttagacaggaggtcactgaaatctggaaatgagctggcagagtccagtccagagctaccactgaggcaggcattgtcattcattcatgtagtcagcatttgtttgttcaataaatattttttgagcatttattatgtgccaggcactgggctgtggttgtgagatacaatgagatcaggacagacaaggtccctctacctttagaatttacagtctagtggagaaaaagggaaacagtggaataaaaaaatagataaataattatttagcaaagttttactatataccaagtatttactgtattagtagggactattaagcactttgtcttgtttgttgttcatgataaattctgatgttagtatatacaattattatccttatttacagataatagactaagaattgaaggcacagaaaagctgataattagtctaaggtcacacaggtagtaaaactgacataaagggaatcaatggagttctaaaataaaaaataaacaaataaataacaacggagatctatgttagaaagactggtgaggaaagtctctctgagaaagtgacatgtaattaagacctgaggggattagaaggagcagcctaactgtgagaagagctgttacaaggacattccaggcagaaataacagcaggtgcaaaggcactgaggtgaggaaaaaggtgaggcatgttttaggaacaaacagaagcctactaagaataaaatttagtgactgagggggacgaagacctgggaaagaaacgcaggaaataagacaatacagagacttgcagactctgataaggactttgattgtattccaagtgcaatgggaaacattgaaggaaatatactaatttgcatcttcaaatatactctggattcggtgtggagaatggatggagaaattgggaggtatggaagttgagctcgacaatcaaaattgaaataacagcctagaaacataaataatctaaaggaaatgtgatgaaatatgaccttttgggagactatgggaatgggtctcactggggggggggtcaagtctccaagccaaatgcatcttttatttgaatcaaagagaaaagccatatgacaaggatgaaatcagaatagtctttgataaaggttctatgtggatacaactatgaataaagatttagcagtacctacgaaaatgaaaatgttcagactccatggacccagcaattctgtttcttggtcgtggcagacattgctgggaggctgagtcctttccctctcactacctcccactgcagaggctggataagctaaagttctcagcttccctttaaagcaatggttgaacatgtgacagaagttgtcattggggaacttctggaaaagcttttgctttcctaatgaaaagggaaaaattcacctgctacccttctgtgcccataagaaaggactctcctcaggatgagtggctaaacagttcagagaaggtgacagcgatgggcccacagtccttggacctccaatgatagatatctccattggatacctggaggcaggcaaggataggccatggaagggttagttctgcataaaaaacgttatttaaagctctctccatcttttgcatctaagttgctctgactagtgtttatctgtcagtgaaaataatgatggggatgtgtactgtggcatgtaattaatagaggttataatggaggcaacaggatatttactatttattttaggcagacaggggtatgataacataaagaatagcagagaagggatactaggaagaatgaaagttatcagatccaagttggggtgtgtgtgtttgtgtgtcaattatagcattgcctcttctcattttgacttaacgttgtgaatttctcataaaaagatgacttgaaggaatttctttactctggattttggtttctattaaaaactaaaacggatgcaaaattgccaaagtgctcatgggactaacaggttctaaatctgggagtgggtttcagcttataattgaagatgacaggtgtccagagattgtatgaagttatggttctaaaggaagtacagttttacataaacctggtattctacaggaaaaaatgttactcttgaaatccaaacacattataatcataacagggcagaaacaataagaacatttaggggtatgttaggttgaccttagtgtgtagctcttccaggaactcttgagaagtcagagtttttatttaggtcctttgtaatctggaatgcctttggtgggcagtgaatggcgattattgaaagagttgactgatagaatattcctgacttttccccacatttatttttagttttggttttggtcttgaagacatttttcttaagatgtcttcaggaaaaaaaaaaatttttccacattgaaaactttgttttggctttttcgagtttaaaattcggtgatgggaaaacttgctcacatcacaacaatgggattaagtgtgaggagatgatcgctgtgggcagacaggcaggaggctaaccccacgaagggctaaactaaaagctgagtaagagctccactaagaagagctctttgaactgttctgggactggctagggccactaattgtccttgggttgtatatgaagggaaaatttgtatcagggacacaaatatccttgtcctttgtatagcatctatatcatgaaggatattctcattttttaactccattttcttcactgaataatattactcaacctgaaagaaatacaggggaaagaaacggagggacatgcattctcacagtgaatgtaattaaatgtcctcctgtctagtttttcaagttaaaggttctgagttttgtttccagaatattcaactggtactaaaagcatcatgaagtccctcatatttaattaaatggtgcattattaaaagggggcacactctatctaggttaaagaggtgataaacagctatagaatttcatgtttctttctacttggtattatatgtcttgtttcctttactggacagcaaacttcttgggagaaaggatcatgcctgaagcatctttgcatctcccctaacatctgtttgctaagtgttgaataaaataaaagcttgaaagaatgaatctgtaagtaaaaacatgagttttttagatttattaaaaaacatttagtctaaagatcactaagtaagtttataggaaaagcactgaaattttgagctggaaattctaatatgcaggatgcctgatgtgtttttcccccctaattgaaagaaagataaagatggaattgctggtacaccataacaccaaaatgttcttaatttttttttcagttttgcaaattctcatgatttgattttcatccaggactgtcagttgagacatctgataatctaaaagcattcagagaattaggatcccatatggctcgaaaatatttcctatccggcaggaaaaagagaacataccatgaaaataatactggtatatccttcaatttatgtgtacaaggagcataaataaatttaaatcattattcaaagtataataattataatgatcataaggttgattataacaaccaaaataaaaagaatatacagttcttcataatcatgtgacattataaaaaatcagaagtatacttcaaatcaatgatagtaatagagttgtgtttgtctaacagaagcaacagtcattagaaatgagcacgggattaggagtcctggcttatcactaattaactgtataaatctgaaaaggtaatttaactcccttaggtcttaattttctcaactgagccatgaaagggctagaccagatgttcccttttaacacggcatctgttctggaggttctaacaaggagtacatctactcatacactcctattgcctgaagaataattaattcttcttgctttgggggaaatgtcattttcttcagataagtgttcagtattgagaggtgcacttacataatggtgagggagcaaggagacctgggcttagtcatctaatttcaccaacaaaattattactaacaataacaataacggctattcattgagagttaactgcaggccagacactgtgcttttatcctctgaacaattctataaaatagatatcgctattatcatccccattttacagatgagaaaatggaagcataaagattactaggaacttggctgagatcacacagtaagtggcagagctgctttggaaatgaagatgggtgttggaatcaaattcccctcaccccactggcttcccatagctttgacaagtgtcttctgcatggaattgcctcagagatctgatggatggagtctttctctgccagcccagtcgtctccatgaacctcctttcctacaatttctacccagggattgaggattattaataaaaagaaaaggaattgagtgctcctgggttcaccttacagctctgcactttaatagcagtgtgactcaggatcagcaatcctctttctttgtccgtacaatggggataacactaatgcttatcttttaaggatatggtgacataatgtttatgaagttgctttataaactctaaagtaaaattgctaaaaataaagcatgcctgctaggaactactttttttttttttttttttttttttttttttttttttttttagaacatagcactgtaaatcttctagtttcatgttgtttttgctggaaatagtctattctgaaagaggcagcatgtgtgatggcagaaaaattcagggttcccccccccacccccagctctgccatttacttagctttgtggccttgggaaagtcacttgatctggcatcccacagggtcccatactctacaggccctgcatttggggtttaatttctgtggttgctgttttgaagttcttcctaatttttttctttgagtttgtgtgttataagtgaagtctgaagggacaacggagcatgcgctgggcttggcaccttagatcatgggaggtcttgcttcctgctgcatctccaggatgggttctgccagagaccctcttcattggtctctctatctttagtcctgcccaacctccctttctctgttgagtcctaaaattgctgccatccttcactcctagcaggagtctgggtgccggcagagggagggcttgggtgggtcactcaaacccatggcaccttggggccgagcatggcatcgcccatccctgccctaacaggtagcagcattccaaatcaaatgggtgaccagccagaagctatcccaatccagatatcaagcatgtcctgatgaagagatttaaaaatcctttgcggggtgggggtcccctgtctgctatggatggaggtaatgtggcactggataaaagagatgcctggttagattttctgggaccctgctctatccaggacactgtggtagtcaggagagtgttgggggcctggcagtggggcacctgtgccctgcataggaggcacggtccagggtgcttgcatggggctgcactctcactacaagtgtcttgtgccttggaatgctcctttggctagctccatgcctggagcattctccctccttctaaccgtcctgggtttggcctgtatttgtcttttttgaccagatcaaggcatcctttggataaaaacacaaaatataaactggggaatttggtattccttcataggagttaaatgctttaatattttcatctaaaagtaacattgcacaatataaaaatgaatgacaaaattcatgctaataacataaaattttaatgtttctttacacagaacattaaatagtaaacaaaaaacaccatgacaagtctaaagagagaccacaaaaggaaggaaaaaggtttgtacgtatttttaatggcactctttcccctgccttttgaatagggggccccacattttcattttggactgagctccacagattatgtagctggctgcgctcccaggatgtaaggtttgcataatcacctggtccttgcttcacttcacaggtatatttgcagcagctctgcttgtagttggtaagctcagttaagcaacatagttggactgacttaagaatagcttaccatccaatgatctgtggctttatctttacctttccaagtgggtagaaaaggagtaatgggagccattcccttggaaactactgaggtcatttaaccctaacaaggatgatgcttcactagatgttaattagagatcatttccatttttagttttagttctagaggttgccttaaaaattatgagggcaacaggaaacactgaacttgcctagacttctggggcttctttattcattgacttattcattcacccattcaatcattccctccttcactcacactatcatttcacaacatttactgaagtgctatcatgctgcccacactttaagtatggagaattcaaaagtgattgaggcagtctctctcctaaagaagctcaaagtcactgggggaggggtaaggtggaggtgggatcagaaggcatataaagagattatttttattattgttttgagacagagtcttgctatgtcacccaggctggagtgcagtggcatgatcttggctcattgcaacctccaccctccaggttccagtgattctcctgcttcagcctcctgaatagctgggattacaggcacatgccatcacgcccagctaagttttgtatttttagtaaagattgggttttgccatgttggccacgctggtctcaaactcctgacctcaaatgatccacccgcctcagactcctaaagtgctgggattacaggcgtcagccactgtgcctggtcaaagagactatttttttgatgcagcacatacaatgattatggctgtacagagaaaagattcctgaagtacacagctttggatcaggaaagacattttgggaagcggaacatctctgctacctgctaaatgatgaggaaaagttaaccagaatacaggcaatgcttgaagcaagagagagaaggcactgcgtggatcggttgcagcatgaacaagggcaatgagaaaagaaacggtatagtgagagtgaaaaccagaaagcagtttacagttaaccaggtggaagaaacagggagggagagaccaggtagccagccttgtaagcgatgatgtgaagtgggcttcatcctgtggttctgggcagttggcaagttgttttatgcctggaagggagatggctggatttacaatgtagagagcaaactccagtggctatctgaagtgtggatttgaagggctaaaactggaggttggaagcccatttaaagagctcttgcagccataatacaagagacaatgaagatctggactaggacagcagcagcaggaatggtgatgtattaaagaaatactatagagccaaaactgactgaacttgattattgattaaatataggtattggtagaagacaagtgttaagaataactgtcagcgctcttgtttgggtaactgatggttaaggagtcaggtgagaaatagactttcagaggaggtagagggtttggaggtacagtgttttgttcttgtttttgagacagagtctcactctattacccaggctggagtgcaatggcatgatctcggctcactgcaacctccacctcccgggttcaagcaattattgtgcctcagcctactgaatagctgggattatggatgtgagccaccatgcccagctaatttttgtatttttagtaaagacagggtttcaccatgttgtccaggctggtcttgaactcctgatctcaggtgatccacccacctcagcctcccaaggtgctgggattacaggtatgagcccctgcgctcagccttgaggggctgtgttctgtttgggacatgcttaggggcctgtggaactggaaggaggggatgttagcagacagtgagaggaggctgaagtttggggagaggttcaggctaatgttgtagatttggggatgatcagggctgaggtggtagctgtatgaaatggataaatgcagcactgagaagaaaggggaaatgccatgagagaaagaaggaaaagatgaagttaatgaggaaaagagggagagtgtgtcgtgtcagatgccaagagggtaacgagtttcatgaataaggatatgaaccaactgttaaatatggcagagaagtcttaatggaagtggaaaaggccctttggtttggtaaaatacagcagctcatgaggaccccaggaggagttttccattatgggtacaaaagccagattagaggattgtgagacaaaaggggtggagacaatgaatgtagacgattgttttgagaaatctgaatgagtaagggaggagaaaatgtgcagcacagctggagaaggaacaggatcacaggaagttgctttattttcttcttcttcttcttcttctttttttcactcgtaagaataggaggtgactgggtgcactgggtcatgcccgtaatcccagctttttgggaggctaagataggcagattgcttgagcccatgagttcgagaacagcctaggcaacataggaaaaccccatctctacaaaaaataaaaaagttagctgggcatggtggcatgcacctgtagtcccggctactccgggggctgatgtgggaacatcatttgatcctgggaggcagaggttgcagtaaactgtgatcataccactgcactccaggttgggtgacagagtaagatcctgtctcaaaaaataaaaaactaaaaagaataggagactcttagctgggcatggtggttcacactgtagtggtggccacctgggaggctgagatgggagggaaaattttttgaggtcaggaggttgaagctgcagtgagctatgatcacatcactgcaccccaacctaggcgaccgatagatatgtgttttgaaaacataacgctcagagcaggttgaaaccctgtctcttaaaacaataattgaaaaaaaaaaggagacacttaagcaagtttgcaggcagcaggtaaagcactagtggagagggaagttggatccacaggagagggaaaggaaaactgctggaggtaggaggggtaggcctggggtgagataaagggcctggaagagggaagcaaggatgggtgaggtgtagaatccttactcctgaagcccttcactgctgatacttctgctatccttggcatgtgacaattcctcaagctgaggtcaatgccactgtgtcaattgcatagcaattctctttcttggggattcctataaaaactccctcataacaattccccaagtctctagtcttaccttgacgcccctcagtcttacacaattccttgctattttgactagtttgaggttacccatcatgaactccttcgacatctctcctatcttgatttatatactcttcttggtctcattttttcctgcaatattaaaaattctactgatctttcaaggtccaactcaattgatatcccttatctatgtctcactttcatcttacatatacatttttaaattacttgatgtcttttatgttatcttataagctaatttaaatacttcttaaaacaaggaagggattcaatcaacctatcaatcgtcatgataccctttcctatctcatcttcttttcatcttcttcaactttttgactcatttttatatcattcctctatgaaactattaaaccccttaagggcaagtaaatgttttttgcacctgctctagtatgacaatacattatacataatacctacctactacaattaataaattgtaagctcctggaggacaagaatttaggagttagctagctagatagagatgaatacacatgcagagatatatttacattctctcaagtataccaatttaatctaatacttactatatacttgctagcaattagagatatataaagataaataaaacaaaacacagtctctgtcttccaagggtgccaatccagtgtggcaatcagagaatgagagggcttgaatgacatgctgataaaattggactgtattctgctaggtttcttgcagaacttagggcagaggatattaatagatatgtgttttgaaaagataatgctcagagaaggatgaaggatgaatttgaaaagaatgagattgagggtaggcagatctatgagggggcttttgcaatagtgtagatgacagataataaagatcaagtgagggcaagttggttacagatgagatattgagtgtatatgcgtgtatgtgtatgttgggggagtgaggttgtggtgcacaagaataagtgtccagaagttatttgctaatcttactttttaaaagacattaaatggtaaatagtagtaataactatagcttattacatatcgtgtaacacattcctctagactggccttaggcaatattgagatctgttccatttcaccacttaggatcctctaggcccgattttggcactttattctatatgatcggctatttgttcttctcttattacttcaggtctcaagttttgatcatcctatgagcccatatatccttcagagcaagacaatgtgaataggcatcgttgcacttggtagagggttaggcaaatagtggatgccaaataaatccttgtggaattgaatggtattacctggagttccctgaaggttgtacatcctcttactccttggcctttggaacgtccttctctatacctggaattcttcctctctctctttacctcctctgactactgtctctttacctcactttgaccttcctagttctgtttatcacttcctctaagagttgttgcttgatgcccctgcactgggttagcagattttgctaagtggtccacagaatcacctacttatgtgtttctctgccagctctataaagacagaccagactaccttgcggtaatttgttcagtattttatccccaggttgagcacagcacctggcatacagtagacattcagtaaatatttgttaaatgaacatggttttgtggggttttatttgtaaatctgaacattttgaaatttgaatcttcaaatagctggacataaagtgctagatccatccagacgaaagaaataatgggagaccatctagaaaagtattttgttctttatgctattaaattcagtagaaattagttattatattttttgaggactgttatgcaattaacactctggacaacatgaagacagttcagatttcacctttctatcctgccccccaaggacatgcaaaatatctgcttgggtacccgttttttcatgtgtacacactagcatcttcagttgataagttcctgtggggcaggaacagtaaacttctcagaattagaaagcaaaagtgacagcaaaaacacgacaacatcagaaagccagattctatgtcagaaagtcttaggagttgtagctttagtgttctgcagacaacccaatgtcacaggaaatactaattcccttgctctggggcatttattaaaaacaaaattttttgggaggccgaggcgggcggatcacaaggtcaggagattgagaccatcctggctaatatggtgaaaccccatctctactaaaaaatacaaaaaattagccaggcgttgtggcgggtgcctgtagtcccagctactcggtaggctgaggcaggagaatagcgtgaactcgggaggcagggcttgcagtgagccgagatcatgccattgcactccagcctgggcaacaaagtgagactctgtctcaaaaaaaaaaaaaaaaaaaaactaaaactaaaacaaaattttacttcctactgcctggtaccatattatgcagtagagacagaggggttaaggaaatcaggcatagtccttgttctcatgtagtttgtagttaaggagtgagagaactggcagtgacctgattttgaagaggctgattcaggtcaagacccaattttgaagctggtctccaacaagaagagtggtttctaggaatatagctctgcacaagcaaatacatatcccttagacagtctgtgacatggagtgaaaaaccctccctgacagatcctttactagggatctctgcaagggctcagatctctacttcaatagaaatgctcattggtactatctgaggacgatttttccaagaggcacaaggagatcaattactactggcagcctaatttgcaagataaagaaatttcccattattctagtatcttcgcaaccacagtctacttcagcatcatcagccgacatcatggcatagtggaaaaaaatttggaatagctaaaaagtcacagattagaagttctcatagctgagatgctgctatgtgcttcttgttaaaatccagggttaggacaagggtcagaggattcttgtccttctacacttgagtggcctacagccatgtattcttctaaatcatgttttgaatttcgtcttgaaagataatgttttaagagtgctaagcttatatactcatacaacagaaataatatgtgtgataaagttgggcaagaagtgcttttaaagttgtcggtttctaaaggtgtctttttttaaatgggtacttaatagttatacctatttatgggatatatgtgatatcttgatacaagcatacaaagtgtaatgatcaaatcagtatccatcatctcaagcatttatcatttctttgtgtaaggaacactccaattctactcttttcatcattttggaatacacaagaaattgttaatcatagttgccttattgtgcttcaaaaaagttgtcttttaggttgtcttaaaatttggttacgaattgataacactagtcagaatcatgatttatattctgtagatcatttttttccatttagctttcagttataatacctcacagaataataaagcttgataggttaagtgtcttggtcctgactatcttgagaataatggttggagcaagaactatggtccagacgtctgctctagctgcaatgtttcccctccctactccattacaccacaatgatggatgaatgacggatgctgcagcagaagtaattacagtaaactcaagatataaaaacaattaatatagtgaaaatatataaattaataataaatataaaatacatgcatctttaatattaagatgtaatataatttataaattaatatagcaaatacagtaatatctaatggacagtgaccccatcaccccacttttacacgtgcctctaagagccatttcttatttttgaaggggagcagctacaccctcactctttgggttgcggtgccgtgtagaagtgatgagaatgggaaactgatacactcctgcacagagaagccaatctgaatgccagatgattaagtagaaacctccaccatgctgcctcagacttacaaatgaagtgcaaattaaaatgttagatagacatactcaacagcctgtaacatcacaaggactgtctttggggtatccatttctataaaaagaaaatctggcattcctttttggaacattaggccaaagtagaggataatgagaacagaaatgccttatgcagtcttaataatctttctactcagaggattcagtggaaactagtaactaaaaaagattagccttgcatcaagaccgagctatccagaaatcgcccggcctgggatgcagattcagtcacttaagtgagttgtaacacaggctcacttgtaggtttgccacaattttcttgcaattcagttccttcctctgtcaggctgcaataatgagatgaattcctgcaagaagtactcccagaaagacacagggaggtctgagtagataactaacacagatatctagagaacagaagtgctagacgaagagagaaataaacacacacaataattaaaacaaagatttttttaaaccatagcgacattacacttatctcaatctttaaaatccaggatatctatatctttgtgtatttctcactgaaactttccctgggcctcccaggaagaacataaagaataaagaataggttcattttcttacagattaagagatgtgaggctcaaatgaccttatcctggtaacatagctacattactgcaagagcagcatctttaatccctatgattcctactccagtcactctttaccagtgaaccatcaaagtaggtgatgatgctgaaagaggtacagaagattcagcttgtgaagataagccgaatgacagaaaatgcactttgtgcaaacctccatgcagtgatcacaatgcattttagccagtggttcagttctctctctgtccaactagactatgtaccttgaggatagaaaccatctgtccacctaatgtccccagtagtcagcacagtaactaacacatagtagtcaattaatatttgaagaacgtataaatgaatgaatgaaagcatgaatggatctggaaaagttgccatcaggaattggggccctgaagaaagaatggggttcataaataacattcagcaatcatagtcactgaattgggtactaatattagtgaaaataatagagacagtaaaaccaattataaatagataaagaaggtagtgcttgttctgttttgtttcataaaagattgacaattttatttatgaacacaggatttgagctaaaaagagaacagataagaaggtaggtgactaaagaaatggttgccgagaaaaagtatgaaacagagtttagaacagagaagaggatacagagataattgtaaaggtgtttgacagaaaaagggaaaaggagaaaagaaaaagctttcagtaggacactttatgggcataatagggttcttctttagggcatttcggaagttgagagagcaaagatgagaactcgagagacatggaatggacaaaagagaaagggaggtgagatacatggtactgatcactcacagggaatgaggaagggaagtaaatggcctcaaagaagtcatagctgtcatcgagcagcaaatgccttctgtcatgcaggtggaattaaagcttaaatgtgaactgatggtccatcttcagcttctttctcttctcgctctgatacctgccctcaaggttgctccctggctggtcagggaactcacactgagctgtagaatgttcccaggctctggacctttctgtactgttattcaaccatcagcacttgctagcttctgtcctattctctcaggatgcctgtttttattaaatgacaaaggaagttaattggttcatcaagtagagcaattcctattgtgggcttagctggctactagttaccttgcctattacatataacagcagtgaaataaacataaaggaatgaatgggtgggctttcattacgtgccaggccctgagctagatgcagcagagtatggcagaacaggacatgggctttggagacagacacacccaagacagaggtctggtccataatttcctagctataagcttgaggaagttatctcctagggttcttggattcttcatctgtaagatatgaagaataatttcttcaccctcaatttcctcctctatgaaatggagataatgttgcctacttcgcagggttcaaaatacatataagtgataataatgttatttactatttattcatttatccccactttaaaaaggaaaagctgaggcacagagaagtaaggtgtgactaaggtcacctagctgggaaattctagagctggcatttaaatctagcatttgtctttatgcacttacccaacatactatgtcatcttaaccaatacactaaagcatcattagatgtttccatctacagcctcttacagtggggaaacagtttgatattcaccaatctcatttaaccctcacagcacctctgtgcagtactaacatcttgctttaagatgaggaaaggaaagctcagagaaggtaaccgtggccaaaactcaacataggcccagagaagggaacaccagccaaaactcaaagagctaattagtgacagaacttgaaattagatgtagggtttatgaccacaaatataaatataagaaagagagccaactctgggcccagagtagatgcccacatctttactagttatctaggtggtatttctacattgcttttaaagttctctgatagcaaagctgaaacctggctaggtgttgtaagatagatgagaaactgcaagtcaaggtgtgagttcaatgagtggattttaactcctaacttcaggagtactggtcaattatcctttactgagtggtgctatcagcccacggtaaaataaattagatttttaagaaggtgcagaattgccactataaaatcagataagcctactgcagttgggaataaattctatcatagaaatacatcttgcctgatatcaaaggaagccaagaaaccatgccaagagttggatgaaaactgacattttctgctgtggagacagaagtggtagcactgattggagaattatattttgaagagttctaaaatatttatcatcattctaggtcatttattcatttacccttttaatgctcatttcttttgtgccactaggtcgagcttaaaagcaaagaatgaaaattcactgtgtttttatatattaatatgaagcaggaagtttctctattgcttggtttgaaaaataaaagcgtttctgagaaatattagaacactaaatgttctttcagaaacatggcttttgtcattaataaggatgctgggtgtatctaagcgtgttatgaatttgtacttttttttgtttgataacttcctgtaacttgaagtatttcaagaagggaaaaagctgataaaaactactaaaattgccattgcttcactgtattgattgccccattatgtttctttctagacttgactcaggcatctccttctccaggatgccttttctgctctccattctaattaagatggccttcctctgtgctccaggagcatttacacaaaccactatccatcactgcccttatcacactgcatcgaagctatctgcccgcacatctgtgccccctggaaggcaatcaggacaataaccatggcttatattccacctggtgtcctcagcacctggcatggagccagaactcagcaaatttttaccaaagaacaatgaattttaaaacctgactatagaatggcagaatgctccttctgcctccacgaaatttactttcaagttgaacaattttattaaaaattccattttctaatggtatcagagacctgcaaagctaaagaaaaagcaagtcttatttccaggtcagaacttatttcccaggtcctcactatttggcttatataatattaaaaggtatttttaagagtataatttctatttctcaggcttgaaggatacttttgttagtgtcctcatagctttctattttggctttgcatccagagaaatgaaagaggcttgactcagctgccgcttaatactgcacaagcctgagagagaagactattatataagctaatgtgtattttaaggtgtttttttttttcatagccaatacctaaatgccaccttccaacctcatgaaagtgctgaaccccagtgtgtgggaaagcgaggtcccctacacggctctgtattccttataagtataaaaaataaaagcagttgattaagggttagcaattttcttttctttctttacacgtacttgtaattcatttaatgcaggaagtgggctgagttttcttgttctttccaattcaactctcagggagctttcttgccagcctgctatggttaccatggcaacaaggcgatggtggcagtaatatgatctcatatgccttgtgtcaatagcatcagatcatcacgcttgaggataattttgacaataagcttcagatatagattcaggatatattaccatttgattgatttaccagaaatactgagcaattacagccttaaacttctaataaaagcatgttcacaaaggttagcgtttttccctagatgacatattatatggcattctgaaatttgtaaattgctttcatatatctgcttcaattctcattaggcaggacagatataatcatccccattttatagaagaggaagtaaaggcccgtgcaatgtgctgtgtaaggtggcaaaagcaactccacagtgaagctgaaacttcaacttgaggcttctggcatcagaatcacactttcctcatgcctgtgttaagaattcatgggtattatcaaaatgttcttagatgcataggttagaccctggaatgtctgaattaaaataatgtaaatgtatctgtgataaataactactagtttgagaatattagtattttatatttgggtgatgcttcatacattttatatctcccattacaccttcctttcctaaggcttttctgatactagatgcacaaatagatgcttatctctttctcccactgatcaacatcttgtcttttttgttgttgttgttattagtgacatttatttttccattgtgagttccttgaaagtagggatcatgttattcattcttggaaggtccctgatcctggcacagtatgtatggatctgttatgtatcaggtactgtacataatatgtaccaggtacataacagatacaccataaatgcttgttgcttgttaaactgaactcatctgacacccacaaaccccatgaggtaagtacagctggcattatgatccactattttaataaagtggaaatagaggtcatggatatatcatgggcaatttaattctttccactcccagccatgtgctctttccatgtcgtcctgtttgctttattctttcattgtttctctttcattcattaattcatcaaacatttattagttgctctttctatatcaagcattgctacagataatgggttacaaagataaataagacacaatcctcagcaccaaagggctcacagataatgcagataattttctgcctaggcaagtagtaaaataaaaccttatatggaacttcgagtatgcattatattatttcccaactttattggctctttaaaatgtatcttgagaatatgtttcaagtccctctttaatgcagtgttttagaactggataagccttgagccattgccaatatagggtgatactaattctgcatcttcgttttttttcttgggcataaaatcagcatttccaacatcccacagaatccctaaacttaacgtgtcctcaatgaaactcagtatctgacctgaacgaatgggaagtggcagaaagaggcagatggtcagggtgagatgccagactctgccgtttgatatgacttagggtcagttacaccatctaggggtttcttcattagtatctggcacgaaacacagtgttcaaaatacttcttaaatgtattaattaatgaatgagttgtcaaagaggatgaaaaatgatgacataaaatagggatacctgaagcagtgttagcattagcaggtactcaataaacatcttttaaagagtggactaaatatatacgattcaattccccttcctgaaacatattaaattgccaagacaaaacttctaagttatctttatgtctctttccacatcatagagtcaggtttatttcacctctgcaatgtcttggacttgtgcctttctcttcatccaatagcatgatttgatccaacccccaccctttcactagtagactctcagagaaggcccttgactgaacttcctctctttccagggtctcccattccaccttactggtgaaactcttatttttaaaggataactaggagtgtataactcttctggccagagattttgtattgatttgtatattctaattaagaaactttttagaatggtaatcaagatcctctaaaaggtgatctttagttatacctatagtcattcctttccatatactctaggttttagcttcccctacacacacttttggacttttaagctttcttcctgtattcctagttagtggagtaataacagctttgtaatacttttgcacaacactttgcaatttgtaaggaactcatatatgtttataatgaaactttgtgataacctcagagtaggtggatatgatcattttcatttcaccaattaggaaattgaaaatcagagagttaaatcatacagattctcataacctttatgagaattctattggaaaatatttgtgtctatgatgattgtttaaccatggaatacttgaatcaaactctttaaattaacaactgtgacttcaaaatgctaacgattgacatttgttcagctcgttagcccagaggctaatcatgatgcttttcttctgcatagcaaaagaaactatcaacagagtaaatagacaactacagaatggaagaaaatatttgcaaactatgcatctgacagaagtctaatatacagcatctataaagaatttaaacagggtgggcatggtggctcatgcctgtaatctgagcactttgggaggcggaggctggtgcatcacttgaggtcagaagtttgagaccagcttggccaacatattgaagccccatctctactaaaaatacaaaaattagctgggcgtggtggcatgggcctgcaatcccagctactcaggaggctgaggcagaagaattgcttgaacctgggagatggaggttgcagtgagccgagaccgtaccactgtactccagccttggtgacagagcgagactctgtctcaaaaaaaaaaagaacttaaattcacaagaaataaacaaataactccattaaaaagtggcaaaggatataaaccgatacttttctaaagaagacatacatggagccaagaatcatatgaaaaaaagctcattatcactgatcattagagaaaatgcaaatcaaaaccacaataagataccatctcacaccaatcaaaatggctattattaaaaagtaaaaaaataacagacgctggtgaggttgcagagaaaaggcagcacttacacacgatgggatcataaatttgttcaaccattgtggaaagcagtacggtaattccttaaagagctaaaagcagaactaccatttgactcagcaatcctgttactgggtatatacccagaggaatataaatcatcctcccataaagacacatgcatgcgatgtttactgcagcagtattcacaatagcaaaaacagaatcaacttaaatgcccatcaatgacagatggaatgaagaaaatgtggtaaatttacaccatggaataccatgcagccacaaaaaagaacaagatcatgtcttttgtgggaacatgatggagctggaggccattatccttagcaaactaatgcaggaacagaaaaccaaataccacatgttctcatttgtaagtgggagctaaattatgagaactcatgaacacaaagaagagaataacagatacttgggcctccttgagggtgatggttgggagaagggagaagagcagaaaaaataactattgggtactaggcttagtacctgggtgacaaaataatctgtacaacaaaccctcgtgacactagtttacctatgtaacaaacctgcatatgtaccccacaacctaaaataaaagttaaaaaaaaaatgatgttcttggctgggtgcagtggctcacacctgtaatcccagcactttgggaggctgaggtgggtggatcacttgaggtgaggagtttgagaccagcctgactaacatggtgaaactctgtctctacttaaaaaatacaaaattagccagctgtggtggcgcatgcctgtaatcccagctacttgggaggctgaggcaggagaatcacttgaacccaggaggcagaggttgcagtgagccgagattgcaccattgcactccagcctaggcaacaagagcgagactccgtctcaaaaaaaaaaaaaaaaaaaaaagatgctcttaagctggattgcctgtgtggaatcctggctctactatttcctagctgtgtggtcttggatagattacttaatctctctgtccttcaatttcctcatcattaaactggggataccaatagtttctattgtgtaggattgctgcaaggattagtgaattttatgtgcgtaaagtgctaggataatatctgacacatagcaagcactcctaaatgttgctacccttaaagacacaacctaagaacttctttggctagtccctggtctgagaaggaaaatcaattccttcctcattggtgctaccttgtttgggtcttctatactggggacactatagctgcctcagggtgttggctcaggatagattcagaatatctgaatctacttattgggagcagtcactgagtttctctaagcctcattcaccatctgaaaacacctggataataacagcattttacatcataggattgtggtgatcattttattaactagtacatataaggcatctagtgcttggcatggagtaactaatcagtaaaatttagtgactattactgttacataaatgttttgcccatgatattttgaccttcttgggttaggacctgtctttttcgttatctttatgcctatctttgttgcttcttcacagtagatttaaaaaaaataaacatttaaataaaaaagattttgcttatgagtgtcttggctatatgggctcttttttttgttccatatgaaatttaaagtagtttttttctaattctgtgaagaaagtcaatagtagcttaatggggatagcattgaatccataaattactttgagccatatagtcattttcactatattgattcttcctctccatgaacatggaatgcttttccatttgtttgtgtcctctctgatttccttgagcagtggtttgtagttctccttgaagaggtccttcacatcccttgtaacttatattcctagatattttattctgtttgtagcaattgtgaatgggagttcactcatgatttggctctctgtttgtctattattggtgtataggaatgcttgtgatatttgcacattgattttgtatcctgagactttgctgaagttgcttatcagtgtaaagagattttgggctgagatgatggggttttctaaatatataatcatgtcatctgcaaacagacagtttgacttcctctcttcctatctgaatacgctttatttctttgtcttgcctgattgccctggccagaacttccaacactatgttgaataggagtggtgagagagggcatccttgtcttgtgcccattttctaagggaatgcttccagtttttgcccattcagtatgatatgggctgtgggtttgtcataaatagctcttattattttgagataagttccatcaatacctagcttattgagtttttagcatgaagggctgttgaattttgttgaaggccttttctgtacctactgagataatcatatggtttttgtcattggttctgtttatgtgatggattatgtttattgatttgtgtatgttgaaccaaccttgcatcctagggaggaagctgatttgattgtggtggataagctttttgatgtgctgctggattcagtttgcctgtattttattgaggattttagcctcgatattcatcaggaatattggcctgaaattttattttcttgttgggtctctgccagattttggtatcaggatgaggctggcctcataaaatgagttagggaggagtccctctttttctattgtttgaaatagtttcagaaggaatggtaccagcttctctttgcacatctggtagaattcggctgtgaatctgtctggtcctgggcttgtgttggttgctaggctattaattactgcctcaatttcagaaattgttattggtctattcagggattcaacttcttcctggtttagtcttgggagggtttatgtgtccagggatttatccatttcttctagattttctagtttatatgcatagaggtatttatagcattttctgatggtagcttgtatttctgtgggatcagtggtgatatcccctttatcatttatttaaatacaaaagatttttcaataaaaatgattaaagtagcaggatagaacaatctttgcagagaaaatcccaaactctaagtggatggatgctgagactgtatgcaaaaacgctaaattctagaaagagttaaatttgaaaatatctattcttattacaaaatattgatctagtggttgttgggaaaatataaatgtaccatataataaattgggtttggattattaaaattctattaccttgtccacaatggaagcaagaatataaatgactttataaaactaaaaagttttaaattttcttctgtacattggcatatctcacaaaggaatggaattggttacactgcatatgagaacattttgatgcagtataatcttttattgtgcagctttatatagcaccctttcctgaaagagtgactgtacagcgcctggtgttctaaatccagtcgctaactcaaaccttttcactttcataaagaggttttgggaatgaagttaatattccatttaccaaactaaaatataatattatgtgctgcaatgctgtgagcccacccacccaccagactgcagataatcttctattcatatgctcaaatcaagtactatgcatatttctagctcactatcaaaagtaactgcacatatacacaaagaaaggatagaagaaaatgaatgagcagtcaaaaatgactgcaggcgactttaacaatacaagatcagccatttttgacaaatatttgatttgaaattcactgatcttctattaggactcaagggctggcaggagtaacgaatttcctgagcttctcttatgtatgttcagaagtattggatcagtttttggtctcggggtaacaacaatagcagcaaaacagtaacagcaaccaacatgcactgagtttacttcacaccagcactcaggcagaacttctgcttcagcagggtgaataagagcccccaaaggtatcagatcctaatccctggaacctgtaaattatgccttattaggagacaggaacttgcagttgtgattaacttaaggatcctgagatggggagattaccatggattatctggatgggccctaaatacaaacacatgtatcttataaaatagatggaaagggagctttgacagacaaaagaggaggaggcattgtgaccacagaggcagaaattggagtgatgtgggcacaaatcagggtatgctgacagccgccagatgctagaagaggtaaggaacatattaccctctagagcttctggagggaatgagcccctgctgacaccttgattttgcccaagtgatacttattttgaattcctgttctccaaaacttggagagaagataaatgttttttttagccagcaagttcatggtaatttgttacagcagccatgggaaactaaattaagcatccaaccattgaactaatatactaatatattgctgaactttggttcattccttcataagcctcccaaattcttgatttctttgttctgtgggggctgctgctggtaagagtagagctattaaagcatccttccatgtgaagcatcacctgctgacatttttgcagaatcccttccattgtcagccctacctacttacaagttgaaattgacacacaggtgcagtgagtcaaggtctgacttgaatgctttgcttttctctcagtagattttcttaaattcagcaagtcctcacttaatgtcatggataagatcttggagattgcaactgtaattgaaactatgtataaagaaaccaatttgaccacagtcaaatcaatataaacaagagttcagttcctatggtatatttctggtcaaagaaagtaatcaccaaacttctaaataaagaagcaaatacttctaatattaaacatcaaaataaatgggagctatacatacatttaagaaatattaatgaaaaggaagatgatgatttacccaattattccagttcaaggtcgcctgtcccggcaactcagggcaccaggtgggaacgcaccctggacgggacaccctcccatcgcagggcatactcacacccacattcgcactcactcagactgggaccatgtagacttgccaattcacctagcattaagcacatccttgggccgtggaaggaaaccggagtgcctggagaaaacccatgcagtcatggggagaacaagcaaactccacgcagacagtgacccgggctgggagtcaattttttttcttatcaacatcataaggaaacagcattacaggaaatggtgtaacttgaggacttgctctatagaactacacatgccattatttcagtatgtttcttttcttgtttgatctcattcatttgcacacttgaatccaccaataattaaaaacatctgtgaatataatcaatacataagtaatgaatttattgtttctttgggccagaaaactgttaagaacttgttatatgcaaggcattggtttagaaaccagatattcaatgataaattcttgacctcacttaaattcttattgagatgaaaagaaatattatcaagtcacaaacagtacaaagctgggtgtgaaaatgccataaggagaagatggagacaacgctgacattcagatttctggcttaaatgactgaaaaaatagtgatgccatttactgacatgggaactgcaggagaagcagcagatttgggaagagcagtggatttgaggtccctggggggcatccacgtggaaaaacaggcctgatgttaaggagagagaacttagaggttttgaaattatctgggcattggtgataattaaaatcctaggaatggaactcattgctcctggacattgcataatgggagaagaaaagagaggcttagaaaaagtacagggctagtaaagcgtatcgcatattaagagaatgatgactaacctaatttgagatttaaagggatctgataggagataaattaaaaatcagttgggtctatccaaagaggataaccctatatgccagcctccaaaatttagactttttttttttttggtcatatgtattgagtcatagttagaggttttaatttggggactagtaggattatagctatgcttataaggtaaatccagggtagtgtgtaggatggacattagagagaaaagacagaggctgaagagttgagttggaatgttaatgtgatgatctagaattagaggtaatgaaggcctgaagaactgttttaacagtgtgtgtatgtaggtatgtgtgtgtgtgtgtgtgtgtgtgtgtgtgtgtgtgtattttccccccaaatatactaaataaaattggtatcaacatttcttatcaacactatagggaaacagcattaaaggaaattatgttacttaaggtacttgaggtttgatgttcactcaaacacttttgagtatttatttctgcattaaaggtcttgcatttcatacatacaggtgaaaaaagaggaaggcaagatgtcaagagaaaaaaatgtggcatatggcctgacccagtttatttgttgagaactttgtggaagcaggatcagtaggatgcgctgcgatgtatcctggcagtggagaggaaagttaataataaccatagccacgggatgaacagtggctgctcactgagtgttgctaagggccatcaagaggtgaatgaaaagaattatccttttgttcccttcatggagatgctggcaaatgaactgaatttaactcaatgaaccacaaagcctaagggtaactgttttcctttgtggtttgcttattgaaagtcactgctgagctgatacgggtgttggggacaatgtctttgaccttggagttcttaaaaccatcctcagactcaatgaacagttggtaaggttttaggaatgtcctagcaaaagcactctggattctgcaggcaagtgggataattcctgaagtattattttaaaaattgtgtgaaacagtggaaatacactatttggagtcagatagatgagggtttgagtgccatttctatcacttggtgatcctgagaaaatcagtctccttaagccttaggcaaaatggggataatgatcgattttgtgaaaatgttaataaaataatatatggaaaaataatatatttgaatttatagatgagacttaatagataaatgtgactgccctcccatacttaaggtcactaaaaatattaattaagagtatgttgaatagaagaatttggaaaagaaaatcaagctagagagaatgggagaaatttccttaagaaacaaaacataaaattttattaggactatttgatttgcttaactgaaactctatcaaaagccattttctggtttttacatgaatcttcaaatatttctaatcagcagtttttctcttaactgccactcagcttttggttggatgatgcagagatgtaggtgtttcgagtaactaatacaattcccttctagggtatgttgcagggtgccttaacttactgtgtatgcaaggtaaataactcctaatatgagacaacaaacaaaatacatgtctaatcaattcagaaaaatgtttaggaagctccataaacatgttttcataaacgcttgctggcagccaacttgcctggctttcagagttgctataacaaccagcagtcctctcagcagccttggcactctgcattcttacatcttttaataagaaatatcattatcttgtctgggctcattagctcaattatttaaagcatggtactagtaaagccaaggtagagggttcaaaagtatgcattagcaagaaaattctatccatgtgtcctttgccaaggcgacttgttcattcattcattcatttaaaaatatttattgaatgtctgccatgtgccaggttctgttctaggagctagaaataaatcagtaaaattaaaaaaaaaatatatatatatatataaacatgtatataaaccaacaaaacaacaacaacaaaaaaccaacaaaaaaaccccaaaaaaacaaaaataattaagatgccagttttagtgatgtctatagtctggtttgaggggcaagaagggagacagatgctgactaagcaacaaattaatatacatgtagaaatacatgtagagtgagaacaatgaagacaaagcagggaaaggagacaggtgctgtgttagggtgaggagaaagtgcctcttgatatggtgacattagagcagagatttcgatgaattgaataagaaaagctgtagctaagtcatggaagaacgttttaaacagaaggttagcagggcacaagctctgaggtgagagtgtgcttggccggatcaggaccagccaggagacctgtatgactggggtattagtcagggttctctaaagggacagaactaagtggatagatgaatatatgaaggggagtttattaaggagtattgactcacaagatcataaggtgaagtcccacaataggccacctgcaagctgaggagccaggaaaccagtccaagtccccaaacctcaaaagtaggaaggtagatagtgcagctttcagtctgtggcctaaggcccgagagcccctggcaaatcactggtataagtgcaagagtccaaaagccgacgaatctggagtctgatgtatgagggcaggaagcatagtacaggagaaagatggaggccagaagactcagccagtctagtcctttcacgttcccctgcctgcttttatcccagccacactggaagttgattagatggtgcccacccagattgagggtgggtctgcctctcccaacccactgactttggcaacaccctcacaaacacacccaggaacaatacattgcatccttcaacccaatgaagttgacactcaattgtaaccatcacaattggagtggagtgctcaagggaagaacagaaggtgatgaaatcagacaggaagagatgatctgtccatgcagggtcttggaaaccactgtaagggattttagattttattctgagtgagacaggaaacgaatgcagagttctgagtaaaggggtaatataatctgacatctactttaggaaaaattgctttggatccagagactctacgtaggggctcaagaaggaaaggggatctgttaggaggttattgcaattaaacagaggagaggtgatgacagcttagagcaggtgccaaggatttaagaaataatcagactctggatgtttttagaggtagtgccagtgggatttgctgatgaaataaatgtgaagtttttctcttgagcactagaaaaatgaagacagcatttccgccctggggaagactgaaaaataaaagcatgcacaaacttatttgtgtgcatgtgtgtgtgtgtgtgtatgtgtgtaaggcagaatggagttgtggatgccttaatgttgagatttctgtgagacatctaagtggatactttcatctaggcaactaaatgtaaataataaaatctctttatagatttcagagttcaggagagatgtctgggctaaagatacaactgtaagagtcatcagtttatagatgtaatgtaagccacgggtctgaataaggacacctaggaagtaaaaatgatagagaatagaacacaaagaactgagcctttgggtaatacaatgttagacttgggaaagataggggaggggcatccaaaaggagagaatgagaaggaatggcctgcaagatggaaaaaccaagagataatgggggtattggaagaaaattaattcaatatgaaggaatttatcagttaagtcaaatgctgatgataggtcatataaaatgagggctgagaattgacaaattcggcaatgggaaagtcactgatgactgtagttagatcacttttagtagggtggaaaagagaaaaatttcctgttaaagagagaatagaggtgaagatggtgattacaagatcttttgggaggttttgctataaagtgagctgaaaaattggacagtaactgggggtaatgtagggtaaacagaattttaaaaattcaaatgaggacttattgtgacatgtttgcatgctgatgaggataatcgacagagaggggaaaattgatgatgtgcgtgagagcaggggtagtgaagcctttgagtagacaagaggggccacatagtttaaatgtgggaaatttcattcattcattccaaaaagttaagcaaacatctaccatgtgccaaatacacagctaagtactaggaacacagaaatgaataaaacatggttcccattatcaaagaagtcatttctttgggagggagaataagcattttctctaattaataattcacgttcaatgcagtgatggtaatgtcagagaaatgtacccagggctcttttctgggatcttttcattacagcatgctgaatcttgggctgccatgtcattagaagcctagattcaagaccttcatttccatcatgcattgacatgttctgggctgtactactgatgagactgatttaggcaagagttctgggcatgaattggtgctgtggctgcacagataaagtcgaggtgatagatttgagaactgtgtgctaggtaaatcagcaatcctggtgattggttgacttgaagtaaggtaaagaagagggaggctcaaggataactcctaggtttcccatatttagttttatcctggaagcgaggatgctgataaacagattcctaacaggtagcgtgggtggataagaagaagaatctgggcccttttcttaaaaaaaattaaggtctgataaatacctgatactttcaaaaatatttgaaagcagccagatatttctgtctataaaaagaaaaaaaaaatagacctgatctctataggatgtcacaaacgctcaaaaaataaaagataggaaagactaataatacaatgctagaacactttttgatactacctaagagacttaagaaaaaaaacaccaaacccccaaaacacagagttcttggtatgatgtatttgtttttccatagaatggtttgagaaattcagtgaaaattaattggaacatgtggttgtcattcacatggttccagactttatgggcttaataaaaacattatgaatagtttttggagttttgggagaagcgaacatggctggtctaggtatctgcttttaggttaatccctctacgcaggaagtttcacagtgtcatacagtgcttttcaatttttcccactcaaatgctcccactatcagagggatgagaatgagcttccctggatggcagaggaagaaagggggtagggtagtctgagggtgtaacttgaagtttcaagttgcaaacataaagtttcctttaagtctagtatttcaatttaacagtttagcaaattttctgtgcaattccgtaaaatattcatttctttcatatagaaataatagagtctccccctccccccaccttaccctgctctgaatcactgagtaaaacctatgcatggcgaagatatgtcatgttttatctcatgactttgattgcatccttgtatcctgtcacaaagcaggggaaggggaaagacacagaaccaagtttcaggaggcctggactcttctacgccagttcgacatttattttttaattttctttgcactctacttatttccaagaggagttttggagttgctgtaagacttttagaaaatataaatgatctgtgccttgatttccttatttctaaaaacaaagaagttactctacatgatctctatattcccttcttatcgattaagagtctacccacttttggtccaagcaaaatgttaacagggctagtggatggtggtaccaaatgtatactggtaaccgatcaattaacattttggaaaaaatggaatattcagctaagatttgagtcatgatggaaaccttgaatttaaaaaaaactaaccttgggagattattagaacttagaatccacatatttgacatgtgctgtaaaaagaggttatttcttgagaagtagaattgcaactttctgctgaaaaaatatcaatcctccaaggcatcctcagtaagcccacaggcaaactcccacctcagcagactgaataatttgcctataaaatatcacgttgaatttgggaggctgaatatggtgggaaaagtttcatgtaggagaggacctgccctggagatgctcgctgaggtggcaaaggcaactggactctcaaagtagtcctccgtttaacaacatccctttctcaggtacttctctcatctgcccgattacttttttttttaaagcctgacaggaatgatgcttccagattctgagatggtaacaatgatctaaatagactgtcatcatttatcagcattcacaaagagaaaacagctatgaatttccagtgggaaaaaaaactttagaatcaaaaaagcaaaaggtacataatgctgtatccagtgaaaacttataaaagtgtaatgttcgctttaaacacaatacaccaccctgagagggttgccttcagtaaggaattgttttcctctgggaaggaaatcactggcaataccaaatctataaggagtgccttagaaacttggctgcaccaagggccgtgtagttttgggaaaactcagcctgttttctttgtctctagacattttttagacttgataatccctcacatgggtgttggggtgtcttcaaggtctccaactctgtgctgtacttcgatcagcaaatgcttggggagaatttctgttttgattgcatctgccatttgcctccacaaattagacttttttaaataaaatgtaatccttttttgctgagacaaggatgaacacaatttattttgaaaagatacataaaatgtattataaaagacacaatgtgcaaaccagaaattgaaaactaaaaacgaacatcacctacacagaaaattctaagttcttaaaccagttggttgaacgaccttgggcaagttgtttaacttctttgaatcaatttcttctttatctgtaaaataaatacttataatcgtttcaagaaagtttattgactagaatccctggagccattcaaacagattcatattagccctcagcgtggctaatggcttcatctcaattctaagtgcggcacatactttcttgaaagtattgttaagtatttattttatagatgaaaactggttaaaaactacacagtagctgcatactgtaatggattctgaaaaggcctagttcaaactctgaccttctataaataacattgtggcctgccatatgaaaagacagtattgctagtgtcctgttgctgcatgggtgatgaaattaggacacggaccatgaatgagttgcctgattctgaatcagactatcaggcagtacagaaggatgccttcctctaagagttcattatttcctattagaatgctgtgtgtgctgcacatagaattgaggtggagcccttagccacactgatggctaatttgaacctgtttgaatggctccagggattccagccaataaacagaaacttgtctgttcatctgtacattcctctcaaattggttgaaataaatcctcaacacttgatgtttctgacctggttcacagatactcaggagcagcctgtggtatagcattatgagaaattttccagtctgttgagtagaagtaatccaatcctgtcactgtttgtggtagaaaggagagagaatatagagatgagatccaagaaaacaagaaaagttctgaggcctagaagaagtggaattctgtggcaaaaagtctggagaaactgaatttgagtttatggaaaaagccaaaagacagaacatcctggagaatagagccactctttgactggaagcttggaggatgattgtgagtagaatggcctatgtctaattctacatgcaggaggatggagcaggtggggccgtttcagggccaggaaagggtctcccttctactggactgggatgaaacaagagccaaggaacaaattgagttgcagtagcagatagaggaggtccagtctgagggtaaagcatggtgtccaagtagcattcagcaatggcagagcataaagtagatagttccaactggtagcccaagataaagaagcattcaaatgtatgcctgtggatggtgttcccttcccacaaggcacagaggattctgggtcaggcatcactcagagttccagagggaagggtatacatctgtcaatgcatagcaggtctcagttattcagcccaaagcaaaccattggctaaaacctttgataaaaagaaatgtgacatgtagcatggagggtggggcaagactgaggctcaggaatgggacagggcctgtcagaattaccagaagtgaggcagcaccacaagactagatcagcagcaagagttatttgaggtgcagtcacaaaaggtgagttagaatttaaatacatgccactttgggtctgatttggtcttaagtgtgtaggccaaggctcagtcttgaggtagagcatgatctcatttgtggtaagttgagagtatgctgaaattcagcatgaaaatggagatcagagatcctccaccttgctgtcagtctagacagagactgaaaaactgggttaaaactttaaagtctttatatcttggatatggagataaacaaggtaatactgcctggataaataggggaagaagctatcaaaatggtattgatctttccatttaagactatctattaccattcatctcttcaacatttgaaaagatgttcagtataacattgggattttaagtgatgattgtatcaaaaaatgataagtttaaaacattttaaacttatcagtgcacaagaacgggatgaatgcttatccagtatttctttctgtatttattatttgagtaaatcatgagtaataggttggtcccttatttaaaattttagttatggtcaattttaagaggaacacaataatctttttttttgtcttctgtacagttatatcaattttagcagtttggtgtctagttttaccaatgctattttatgatctttgccatttgccatggtacaatgtgtttaaatggcacatcaaggtatactgatggttgccatttgcttaataacttaaaagtaatccagcaatttcttccacttttatttcttaacatatgattttgttttgtgaaacatgaaagatgagtcttatatttaggaaccatttggttgggaagctgggagagtaaaatttaattgattttttttcttctgcagctcttgaagaaatagcatgtgaatccagattaggtggcatcatgtatatttttgtaaaaggaatttttacttgcttaggctgaattcatccttataagcctccctcagccatccttaattcctccctttctctcactcctgaagtcaaggattactatgttttattcctttttctgctgcaatatcccggactcttctctgtccatcactatagccacatcagctaataagctcctcttcctgtgtccttcttccctctctactcatcctctatagtgccatcaaagtcagagtattaataaacaaatcctgacatgtcagtgtgcttactccccacattttgaacggattaagttcaaatgcctcacaggatggcatttgaggtgctgatcctaatttatctttctaaccttgtttcttgcctctttcttccattcctcacatgcaaacactgaactccagtaacaccactttgtcttctcaacatactctgcactattgtgtcttcatgccccttggtacatgctatttcctctgcccagatattcttcctgggcttctgtacctgttgaccccttcaactcatcctttaaggactggttcaaagaccacttctgtgacatcatccctgattcccacagagttaaacaagacttctatgacacgccacagcatctgaaatacatctgtgctggaaacttctactatattgccttgtaatgatttgttagtgaacctctctcttccacttggtctgtagctccagaaaaccagtggctgtttgttgcctactcgtctttgctttattcttccttctgcctgtccacctgctctcccaacatccaggggccaggacagtccctggcacacaatgaacacccaacaaacacttggtttaagcaatgaattattatcttgcacgagatttcatgagtctctttagttttgctttcttaacttacttaatgcttattaagatgacttttcactttcagttcttcctgtttgattccagttcttagtcatgtcttccccttggcacaaaactgattgagcaatatatgctgaagcctcactcttcaaatttcatgacaaagtctgagggtcccaggactttggccaagcacaaatagtaagtgtctgggaggcatcaactaaattatctgccagtgaaaatgctctgtcttctttgtctcagttgtttatgcagaacaaccaaccgttcctgtaaagttatttttcctaatttttagcctaaacttttcaatagatacaggccatttctccctgtctcctcctatctcctcatcttctgagactgtaaattatcctgtaacttcatttataatgggaacatatttattttctgtgatgatggctcccctgagcctttctttttcttagctacataaagttaacttcctctgtggcaaattaaggacagattacaagcagcctgggaaccgggctccgtcaccacagggggccgcctactcagcctccttctgttcagccatgggaaagatgcagctgctaagccagccgggtgctgggctgctctccccctgcctctcctgatccctcggagggagttgagaagtccctttctccatcagtctctggttggtgtctgatgctctgttttctagcctctcttcttctgctcctcccctcccccagctgcctaccaactccttcccacccccaggccagcagtgactgcctccaagactccccctccttccagcaccgcctcatggtttccatggcaacagaaaatgttggtgggaagcaaaaatgctgaactgcaactcgtgttggggctgggaggaggaggtgaaatgtgggcctctctggaggctgtagaaaggtggggagaaagaagccaggtgagaagccctgagaagaaaggaccacgaggctcgaaaggaaggtgcattggcaagcggggatcactttgatcagaaaaatcagctaggaggaagaaataggaaagagttataaaaagtaatagagaatcctgggccgggtgaagtggctcacacctgtaatcccagaactttgggaggctgagatgagaggactgcttgagcccaggagtttgagaccggcttagacaacatagcgagaccttgtccccgccttcaaaaaaaaaaaaaagtaatgaagaatcctatatatagtggttgattgagggattacgttaggtataaaactgggaataggtgactttatattgaaggtgagtagtgaaagtcaacaaacatagtggccaaaaaaaggggggcttgagagtttaacaataatatacatacatgaaaaacaaaagtaatattaacagatctgggcttgtaaattaactattgtccttacttatcagccaagtgttacttatcttctctgagccttagtcttctttttgcttgtctattaatatagtgttatcaatatccacctcaaaaagttgttgtgaggatcaagtttaaataaagcacataaagtggccactcatatagcaggtaaggtaggaatttttcttttaaccattgtatgaggttgaggaatggtacttcaaatgggtcttggagctggaaacttaaaattcattgaaaactgtgccttgtcatatatttgatttttgtatttatttcaattttccatatctcttaagtatatggcaacatggtttttttttttcttttttttctttttctttctttctttttttttttttgagacagagtattgctctgtcgcccaggctggagtacagtggtgcgatctcggctcactgcaacctctgcctcccaggttcaagcaattcttccgcctcagcctcccaagtagctgggattacaggaacatgccaccacgcccagctatttttttgtatttttagtagagacagggtttcaccatgttggtcaggctggtctcaaactcctgacctcaggtgatccacctgcctcggcctcccaaagtgctgggattacaggcgtgagccaccatgcccagccagcatcatgtgactacgtccctaagtacatagtaccatggcaatatttagtgttaaccccttcataaaaaataagaagaaccatcctttccttttaaataacctccctgtctgtgcttttcaagaagcctgtggtgttgactcattctctctcctttacagccacaatattgttggcatcataacttctcatttcttttctctctcttcagtgaaaggggttgctgcagaaattatgttctaaacccacaatcatgtttataatggtccacgaatattttttgactgaatgtctgtgtcatcacttccttcagaagtccaaggcaagaaaagctaagaagttgtggcccaactagagatgcccataagcctatttactccgggctgtctctttgcaatcttagaagatgtcaagttactgcagaggctctacttcatgcctccttttcctgaaattgggacaataatagcaacgatgataactagcgcctgaacttgttgttccaaagtgcctgacatgaatggaatcatataaacttcaactcaacccaatggaattagcatgttgttaccgtgacggtttccacatgtggaaactgaagcacagagacattaagtaattttcttaaggtaatatacctcgtaagtttcagggctggaatttgaatctaggcagaatctacctccttaatcatctccactgtgctaccctctagggaagaaatatctggaactgtggcttgatgatattactactgctttttatagacaacgatttttttcctcacttggtatcatctaatgaataaagaaggaacgtgttactgtacttctatttcaagatgtgtactgagcccattggtttatcttttttctcctcttagatcccagtaaaaaaagctaaaaaaagaattcatgatctaacaataatgaggataattggagaaaagctatatggatctgggagatttcaataaatttccagaagtcagaaagagcgtggaaagatgatgcagtggggcagaggtagctttgggctagtgtgtttgcagagggtcctgaatcaaaaaaagagcccaagttgcccatcagaacctcggaagtttcagtctgagagaatggagatgggatggaggaggagatagagaagtgagtagaaaatgaggatgaatttaaaggtctgtgtattgaacagctgcccacctgcctgtaacacacatatccccaccccaatctctctttctctctctgtttctctctgtctctatccctttctgtctctctctctctctctcacacacacacacacacacacacacacacacacacacacacacacacacacacaccaggcatttaccctccattctcaggtcaaaaaggaagtaaggctaactctctaaagacattttaaaaagcctttctggggagagctggagcaactagtacagtggtgtttgggacaccctgatcattatagggacattctgctcaccacaacacaaaacctggaaattaaaaaaaaatgcacacagaatttccagtttgcttttccattgcctcttcctgaaatatgaacagaaaatcacaaactacagtcattagaggatagcttttagcacgagcgacaaagatcaaatgggaaataatgcacagcagaaaaactaactcaaaagacaattccaataatctcaatataaaaataactaacctctaactggtgtttctaacaggttcaaaacaatacatcagaggaaaaagaaaagggtgccaaaaaaggaatagagaaaaagagccttgagaaattgaaaatattattgccaaaattttaaaaatctatttaaacattgaaagcaatctcctagagtgtaagatgaaaatacaaagagttggtaaatgtgagcacaaggataaaagacatggaggaatgatggaagaaatccaacacctgcctaggaagatttcacaaaaaaggcaattgaaacgaagagatagatagaaatgatcaaagaaataatagaagggaatttcccaaaatgtacctttatatttaaagtgcctaccaagtgtggaacaggatgaaaaagacacccactcagtcacatcttagtgacacatcaggacactgaggataaagagaagatcctgaaacttccagagagggagaaaggtcaccgataaaagaaacaacgtcagactcctcatcaaacacatcaaacactgtaagacaagagagcattgtcttccatactcagaaaaattacatccggccttgaatgacatactaagccacgctattaatcaaccacaggggcagaatatgggcatttttagattcacaaagggttagaaattaatctttcatgtatttctcagctgtttcttttataaacagttatttgaatgtgtgctctggcaatatgaaaaatgacacagggaggaaagcatccaagaaacagtggattcaatggaggactgcaatgaagagagtcccaaaatgatgaatgtgtggcagtctcagagaacaggtccagcttcggacaggaagactaaggattaatgtgtggcagtctcagagaacagcccagcttcggacaggaagactaaggagatgggtcccaggaaaaatgtagatcagaaaaacagatagtatgatggagactatgaaaatcttaaggataaagtaaagataggaaatgcaagatgaaggaaaagtaatcagagatgacaggaaagattaaacagggttaaagattaaacaagattaaaaaaggtaagttctaggataactctaatgttcccagtaactgtgcaaatgggtgtaaccatcattatcatgggtgccctgcctctcaggacccaggtatggggttttcattcttgatacggcttcccacaccccacgagttggcatagaagcagagaaatactttcaggtcccaatgcaagcttggatgctgaggacttcagcagggaccaccatacagtacagatttccctgtgtgcctggcagcactaaggtctctagtattatggggtgacaacaggagaagccaatccagatggcaatggaatttcatgctggctttgccatggagtaaaaactaagttgacttgaaacacacacacaaaaaaattatattttgtcgcacttgaatttgtgggctaagattcagtttgcaactgtagtgtgggtagaggaattaggagagagaagagatgatagtattgacaatgtaaatcctcatctctcacatcagaatgtcagtaaataatatctaaagttgataaagccaaaattaagggcatttgcatgttatatggagataaccaccagaaggactaagcacagaaatattgaaagtatttgcttttggagagtggggctgggaacagggagaagaatgcaggaaatggtttgtattaaagttttatttgtatatttgtttgaatgcttgaaaattatatatgtattatttcattttttttaaagtgtgctcctttctgtcaattttactctccttgctacagtgtagttaagttgtccttggcatcattgttcctgtgtctatgtagaccacctgttttggaagaaggtgaggttatcaatcaaacggctaaccagtcacaggcatctactcattcacttgctaagctccttcctcattctcgtttccaagagtgctttcaaggacacaagagaagaccctatttagtgctgtcattgtcttggttgtgcggtaacaggaagcagagaagccttaatttttagcatctagacttcagctccaaatactgccattgaaatgggaagctctgattacagcttctaaagtgcactgttttctctgtgctacagaactgtcttctgaattagtatcaataaaacgctttctaacaggatctttgacaccagaagtcaccactgatgccaatgtaattaccatccctggacgctaggccttgtcaggcagcacagataatcacctacaaccaggggccaacgattacccagtcagtcaacgacattgactgctcactgggaggttctgcacgagtaagagagaggagaactgcaatgtcctttcctcaaagtacttcaaactaaacagggctgagggtgtggaggggaaggaaagcagagattcacacacatcaaaagacagaaataaacaaacctatccattctcagttacacagagagggctgtggagatctgagttggcgcagaataaaaatggacttttgcatcgcctggcccctgtttggtaaaaacctccttggttttatgtatttcctcttttcattttttttaaatggtgttatgtatttcctcttttcatttcttcccctgcccactaactgggctcaactactgaataacccctgtgtgccatgctttttctgtgcttccatactaattatatgctgttccgcttgcctgaaagctgttcctatcactcagccctttcagcttgcaaatttttctaatctatcaagaggtaaacctgacctcttctgtggagccttgcctgattcactccattttaattccaatcagttacagtgctgtgagctttgtgagaggagggacagagtatattatcatttgaaaataattaaaattgttaatagatgtaaaacacttagaatagtggtgcctgaaatgtaagcaaatgtgtttattattattattattagcatcattactatgatcaatgtttgtatttagaagccctagcataacatctggcatatgaaagtggaaactaagcaaatgtttctttgtttgaattcttggaacatttcagacaaactgagttttattgatgagaaggttgatgggttttcttggcagtggtcattattccaaggtgaaagtgaggattattgctttagctattgcaactgagaacacagaatatcttttaagaagcagaagctctaataggtgaataaatcattttggaggataggaggatattccagatgatatgaaactattgaaaacagatttgctgttggttttcagaaaatgtactagccctcaggaagatgggcttgtttggagagatacctaatgtaacacaaataacttcattttcttcagcattatctggaatagatggttaattagtctcagacagctgtttccatactcacccgcctttgctgtctgtgtgatgtgcacgtgtgtgctgtcatctgggtgagcctatctgggcacagtgacgggtcattaagctgtcttctcatatggtgcatgtatagtgtctgaagcacagtttcaggagacaggtaacacttccactcagagaggcattacatgacccctagggttgtcaatagatccgtagctcttttgctcttcaaacactacatgcattttgacatctcaccatctttgttcattgttccattcactgttatgtccttcaccccgttctttactgcttacataaatacactcaagcccacttcctccagagatttcaccatcactccagctcatagatatctcttccatctccatcatattcagcttgctttcttctttctttgtctctccctttctccctttctctctttctttttctttctctctcttttttctttttctctctgtctccctccctccctccctcaacctctctctctctatttttctgaaacagagtttcactcagtttcccaggctagaatgcagtggtgtgctcagagttcactgaagccttgaactcttgagcttaagcaatccttgcgcctcagcctctcaagctgctgggactataggccaccatgcccagctaatcaatctttctttctttctttctttttctctttgtttttctttccttccttccttctctttctttccttccttccttctctctttctttcttcttcctctctttcctttcctttcttccttctttcttctctttctctctctctccttctccccttctctcctttctctctttccctaccttccctccctccctccctccctccctccctccctccctcctttctttctttctttctttctttctttctttctttctttctttctttctttctttctttttctttctttctttctttcaagataggagtctcactgtgttgctcagactggtcttcaactcctggtctcaggcaatgctcctgattcagccttccaaactggctgggattacaggtgcaagccactgtgcgcagccagtcatagatttctaacactaatttctccaatagttacattttatattgtgaaaacacttacattgttggcttttattaacatttgaatgtgatttgctatttgctgttaagtatgctagtcttagctccctgagtagactgttggatctttaagcagatgctgtactatggctctttgtagtttctaccacatttagcacagttagatgagtatataggtacttaataggtgttcccttaggaatgaatggataaccctcctgggatccattcaaaaggattctcctgagaactccttaacaaaggcttatctactttctagtttagactgtcaacacatgctaaaggataaaagatgcagatttgaaacacatagatttacattttaaaatgctgtggcatatttgttaatatacttcacagtctgaatgcaagtttaggttagttacccttgaggacaaagctactagactctcgaggattcaaatagtctcataaaaatcatcacaatgttatcattggtagttaagggaacattttataataagtgggtgtctttgagcatgtttcctagggaaagtgctaagtgcaatctagtccatggaagtcccacagtactctgcgaacaacctgcactacttcatggccacttcacctgaatggctcagttctttgagtgtccatgtagtcaactaatcagtctgtggtgagtaagagtaaattaaggtgactaactttccaaagtcctttaaagttatttgatttaaggtcgctgagctaggtggtttatggatatttcagtattcctggaataattcatgtaagctttttccttgtatccaatatattatgagggtaagagcaatgaagccctgtgccaatttctccatttcactggctaatcagtaattctaacattgtttgccagctaaatggaacaggcactcttgtcaccatcatgattcattgcctactgaaagcacagagctggccttaatctaattcttaataaaaccttgcgaactaggtatactgtctcaatttgcacacggaaaacagatgttcacgaaggttgagggactggcccacgatctcacaccaagtaggtaaagaaccatggaagcaattctgtgccttaaagtgcaattgtctttctaattcctgtggagcatgattgtcttttccatgctgaatctaatgattacaaatatcaaatgagccctaagcatggccctgtaatcctactccattctcctagtaaactctccttcccactctctgaaacaactttttaatatcttctctatccttatatcttctacatccttacagcattattcactagaaaacagaaaccatcagaagaaacatatttccatattctcaatgcctcatataccagtcatgatggtacccactctctctgtcttccctcctgttatcacaggaatgtccccattagcaaccaactctccacttggctctggatcccaacctctctcatctttattctttccatccttctttcttttccaatatcaatacctctttttctacctaatcattcctttcagtagccaaacatgactccagtctctcctgttttaaaaaattcttccctttgccccacaagtcaccctttagctattagtgtatttccgtactcccattatcagaaaaacttcttttgacagttgtctactacttcttctatccaatgcaacatggcttccgtggctctcatttcacagaatgtgctcttgttaagttctccaggagcctctgtgttgccaaattcagtggctacttctctagtctcatttctttttttttttttcaccttcaacttttattttaagttcctagggtatatgtataggatgtgcaggtttgttacataggtaaatgtatgtcttggtggtttgctgcacagatcaaccaatcacccaggtattaagcccagcataccttaactattcttcctgatgctctccctcccccaacccccacccctgataggccccagtgtgtgttgttccccaccatgtgtccatgtgttctcatcattcagctcccatttataaatgagaacgggcagtgtttggttttctgttcctgtgttagtttgctgaggataatggcttccagctcaatccacatccctgcggagaacatgttatcataccttttcatggctgcatagtattctatggagtatatgtactacattttctttttccagtctatcattgataggcatttcggttgattctcatttgatctctcatcagcattctacctaactgataactttcccatggagcaagtttttcccatggagcaagctttcccatggagcaagcttttggtagcattctacctgataactttcccatggagcaagctttctaaacactttgagtttgaggggtcagtagaatatataggaggtagaaaactttgcttctgttgagtatcggtgaagtaacctaaggtgaaagtgcagagtgagaagagaagagactcaagggctaagcctgagggtacaggcggaagcagggagggctacaaggaagactgagaaggtaggaggagataacagagacaaggttagaagtcaaggacaaaaagagttgtcataaaaaaaaaaaagtggtcagaatcaaaggccagagaaagatcgggtaaacagggactagtaaaagtatattgtctttggcaattgagagtttattggttgccatttataaataatttcaggatgatgacagaggctgatggtattaaggcctgattgtatttttctgaagagcaaaccagcaagtgtaggcattattttgggaggcttggttatgaagggaagaagagtaagtggatagtgtctagagcagaataagaattgaggaaggttttgaaaaaaaatcaggttatatctgagtttgctcagagagggtagagaagaaggcttccctaatatcacagcattatgcaagaactaaaaatagaatctatttcttctgcctccaagataattgagataatacatgtgtaagagtttaaaaaactataaagtacaataagaatttgatatagtgttcttctttccactatattacaattaattaccaggaagtcaatggattgcatttttaactatataacacaccctttaccccactccctgcaacaagaacctcactgctatttattcagcagttcttaaatgattgatttgttgtggatgatcttttgcttgcttccttttgaaacagtgagggatttctggatgtttgccagcctgaatattcctgtttacttgtcttaggctaacagataactggatgggccatattgttatacaggcctgatgaatgccaaatgttcagctctatctctacaggattacacctttctgaaaaaagaatgtataatataacttctgtcaaataaacttgagatacatttgtttctagtcctcagatttcaagatctcccttaagactttggaaggacaagcctaattctctttgccaggcatgaaaccagacattagcttataaactcaagatgttccataattctttcaatatgaattctaattatctttgctccttctaagagaaggtaaaagtataacaatgtgaaatctaattctatggactcaaggggcagaaatcagtgacctgatattcagaggcctatattaattatccattttatttttctcacctctgtaatttgtaagtagagttgcaagggctcttgttcttcagttactattttagatcatacactctcaaatgaatggatagttctcaatgcctgcgatgcgcttgattcacacagactagcctaggttgtctgaaatgaagtcagggagacgcatgcaatgacctgtaaggtgttgtttctgtgtctttgtagcctgagttttcttgtggataaaaatctatagccttttattatgacagctcattacaccacagaaaaaactaaactgaaagatagatcatgtcttccatgatcactgctactgtttgatgtggtgtctcctgcatgaatgaaatgactgccactcagaaggtctcatggtctgagaacaaacttgacctggaaattcatctgtatttttacaaccctgtgtatggtgagaaagtttccttagtctagactgcttaatatctgtataaggccatttttttcttctctctcacctctcttgttgatactcctctgaatcatcatccacccaagatcaaggaatgctcacgctacttttgtttgtccagggctcagatctttctcagctcactcagatatgttgccccagtatctcttattgaaaacttttccctatggactcagattgacctcagtttaaatcttcagtgctttggaccatatatttagtctttctataactaagttttgcccttgtaaaactggaataatactacatactgtgtaacatttgtgagggggtaaagataatgtatgtgataatcatataacaagttcttgataaacaatagttatattattaaattggctatattttttttctttctataaaacattacttgcctaatcatcaatttccttggagtgcttctatcaggtagttatcaagtgtaaggatggaacccaaataaatatttcttgtaagtgtgatttatttaggtactggaagaggctgcaaaataaaatggaaagagtgtagggctagaaaggtgacaagttcctggttctggtgttgccagttctcatattaaatagcagtgttatctgtatatgattacccatctatgaaaaactctaagttattagaaagattgaattcatcattgatgaaagagatccttcaggcatctggaatcttatgtaaacctcacgtagactgagtttaattcaattaaataactatttattgaatgatcattatggactgtgcttggcaatgtgggggataataaacaaaggctacacatatacacacatttattgagaactgttatgagttgaattgtgtcaccccaaatttatatgttggagttctaacccctagtagatatgtggatatagatacacatcctagtagatatagtaggatgtggccttatttggagatagggtctttacagacataatcaagttaaaatgaggtcattagggtgggccctaatcaaatatgactggtgcatattcgacatgcacagaggaagagatttgaaacacaaggagaaggtgaccaaggagataggtccagaatggctccttcccttatagccctcagaggaaccaaccctgctggcactttggtctcagacttctggcctccagaactgtgagacaataaatttctcttgtttcagccacctagtttgtggttctttgttgtggcagccatagcaaactgatatgaagacctactatgtgctagtaactgggaaactaacactgaacagggcactgttatttgtttcaggggaagaagtttggaaaagaagcagatacttcagtcccatgtaataaacctgctccaagagaagtatgtacaaggtgtcatgggaggacagtgaaggacagttgagtattaccaaaggcttgtttaaggctcctcagcagggacttctaagccaggcctttgaagtaagagtgcaagaatgagtgcaagaagcaagagttctgggcagaaaacagtgtttatatgaggcagtgtatgcaaaggcacagatatctgagcaggtgtggcactgttgtagaactgtaagtaatccaacatggccagagcttaagagcagtgaaagataaggctggagaggtgagcaagttccaggtcagtagcggaaggctccctggagcaaggggagcacctagaaccttgaggtaggtcttccttgattagcaatcgcgaggacataggctatgttaggtaggagggaaactgtaaacaaaagtgaatgcgtatatttatttggcagtgagcattctggtctggttaaagcagacatcctcttgacaagcagagcaagcaagtgagaagctaagaggtaagataaagtctctcaaaggaccagaagtatgacaaacggagtgctttgagggcagggctagtatcttgtttagtgcttgcagtatagcagtggctcaagaaacaatcactgaataagtgaagggagaagtggtgaaattctgtccttttactgaattaagcagggacttttaggttacagaggtttggttttgaaatctaggctctgctggcaatttttttaaccttgttgagtttcatcctctttatttctaattgtgagtatactaatattgaccgtattggtgagaattatatgggataatttatatggaactatatagaattatgggtatactaatacttagcatgggataatttatatggaattttatagaatatatggaactatatagaattatatgaaactatatagaattatgggtatactaatgcttacagtatatggtgagaattatatgggataatttacatggaaatatatagaacttaaaaattccatttgatcaatatttattaagaagctactatatgccaagccctgtggtaggctttaggactagaaagatgaacaagacccaatctctgcctctaaggaatttactttctgttagggggatggggaagcagacatctgaatagataaaagaactgtgatgcaatagaataaggactagcttagggctaagaacagagcaccgtgggtgcacagaggagggacagttacgccagccagacggcaggatagtgttggggaatacttcctgggggaagtgatgcttaagctgattcatgaacaatgatacgcaattaggtgaagaaggaagaaaaaggaattccaaacagagggaacaacaggcttcctttgcagctgtgtttttctagttcctgtgcctgtgcaattccttgctgaaaatatactctagtcggcttggttaaagcaaaaacaccctctctagctctcgtcagactcctgaaggttggatcgtgctctgaacagcctcagctattggctggcttctctttaaactaaacaggccttcagaaacccttcatgtagccacctgcctgatctcctcactccctttctcctgctttctttcttttcttcctgtccttcctcggtatctgctttcttcctcctctcattaaacatttcctatgtctacatgtgtaaactatgggctgtgcctggagatacaggggataaaagcatacatctaactcatgaggagctcgaaactgaaagtagggtcagcgagctatggcccattgaccagatccgcctgtttttgtaaataaagttttattggaacatgcccacgcccatttatctatgtactggctatggctgctttcatgctacaatagctgtgttgtgtagttgcaatagagaccatgtggcttgcaaagcctaaaatatttaccatctggccctttacagaaaaagtttgctggcccctgttctagtgtttatatatggcagaagtggtggggatagatggacaagtaaagaggtaatgtacccctgtaagataagtttttcaaaagggtactatagaaggagagttcctaacccatacttggagattgagaaaagaactgagagctaaaaaaagtgacaagtacgcttagagctaaaggataaaaaggagttaagagggaaaggaagatcattcttggcagagacagtagcatgtgcaaagccaggcaatgaaagaaaaacatgcagttctctattgcaaaaagaggaagcggtgaaagataaggcaggaaaatcagtttgggccaggtcattaaggatcctaaatatgaaaaccatattaaggattttagaaatgccctataatctctcccataggtaactgagaacctttgaaggattttaagcagagtagtgctaaagcaaatgtgtgctctagaaagatcactctggctgtaggatagttaacatttactgggcatttattctatgccaggtctgtgctaaacgctctttgcatttggaaatatctattgagtagctggacagcactgggaaccaggtagaaagaggtgaaacatggagaacagatatggatctatgagaaccagggatctccctaagggatgaaaaggtgtagagcaccacccttatttggaggcatgaggagaagtagaagaacaggggtgattgcaaaggggagtatactgtcatggaacacaaacggggagtaaataacaaggaggagtggatagtgaaaatcagatattgtaaagagagctaagagaagaaaagtggaagaacaagcagggggcagggaactggtaagaagcagatcagagctgacttaaaagagagcaatttcagcagaaaagttgagaaacaagctggattatagggttaaggaagtggttggaagtgagaaaatggaggtcactgccactgaacacttgtttgagagatttgtctttttaaagaagagtagaaatatgactgtggctggatttcttaaaattaggctgtaattcagcagctttggtaacttttctgattcatgaggtaaatttctcatctcaaatatctggtcatttgaagtaatactggagatcaaattacgcaaatatgctgcatgactaaattaaaggcctattcatgtgagcattagttagtaatgggagttgtattatatactgcattattagaaaatggggcagcatattttaatgcttaaaaatttaatcagagcaacttccagaaggaggaaaaggctcctttttaacacaagatttgaatcatggcaatttttttttttttctgaaagccattcttctaagatggtcatccctgcacatgccctcatttctgactttctgctgcacaagcaatcagtattcgtgcaaggctaatgggatatacaagaacaattagtagctctgccagcgccaatattgtacttgcctctttaaagagctcaaaatattaaataacaattggaaagaacatttcttctagactactcattagattgattttacagatgagtaaactgaatcatagagaaacaagatagtggaaatgagaagtcttactttggttctatctcacaccactgtaaggctgtgcctattatatctgtaattaagctgttgtccagataaacaataattcctgcttggctttgacttttagataccaacagatatttaaatgccggcagttgaaaaggttatttttttttctttcaaaagtgggtttgtaactattggcttaaattattttagaaaactatagctgtactttcaacataaggccacccactcaactctgagcctagactgtttgagaaataagaaggtataggaaatttggcaggtatttttctcttgtatctttaaatctcagtaagttcacaaaattttcctaaccaatattggaacaagaaattatcacggggggaggggggtgactaatctcaccttttaaggacaattaatttttctacttcacaagtttaacttcttatttggatcacaatatgctactaagatacttaaaaggtcattttttcaggccaactgcaaatgatgttttcattatagaaaagttatgtaaaagtggaaaagagatgtaagtccattaacgtgtaaaatgcaccatagcaatgggaaaaaagttttaatgaaatacgtatgagctctatcatgcgcaaatgttttgttgaaatggatgactccaagagctctgtggttccacttcagtgtctaataggcactactcactttaaccttcagcaagccctttatgaatgctatccacccaagtgtatgaaaatgccaattcatgtagggctatcagtattattgttatttcttattctgtaaaggctgcattttgaacattttaataagggtcaaagcattccaagtcaatctagatggcaattgttagaaatgcaggaggtgctttaaaaaatgagttggtaataatttcattcttctcccattttgattagtttataaatataactgtcagctagttatcatggtgaggttattggtcagtcctcctccaagtaatataaactccttaatacagtcttcagactatgaatctaccataacattgccagtgttttgatatcatcagtatcttcatcttcctttatttcaagctatgatagattttacctcttctattatctactgtaatttgctgctgacacaccaattgctagtaaatacatatgttgagcgatggtgattatgtgaagaatgaggggcaagatccctgtggtgtagtgtgtgtgcacccatgtgtgcatgaagaaacgtgtgtatgtgtgatgtgcatgcaaataatataggtctgagggaaatactgtactccccttgaaggtaagggtcatgtcttattcactgttacatccctagtacttaacactgtctctggcacagaaatgatatctaaggagtgcttgctgcatgaatgagtgaagggtactaatggtccatgttcccattggcaaaataaggcttccagtttaaaaatgagactggaggtccacctacaacaatctgttgtgctttcagtttttacaggctgatttctacgcacacagcattatgctgggacttgtgaggaaagcaaggaaactgaatacacagaacttggacttgagaagctttcagtctaattggggagacaagatacatacaagtgaaaacttaactcctaattctagagagagaatcatggcatgccaaatgtatttttttcatgtcaaatgtaaccactgcgtgagttcaggagaaaagagcctgttctgtactgcagccattaaagaaagctacctaaactaggcaagaattgagttatacctttgaggataaaagacagcagggaaggaaaggaaatgtctgtccaggaggagcgggtagagaatacagatgagcaaagttattaagataagaatagattctttgggacttaaaatttaggaagcagtcattagactttgaaaaataaatatgatggtagagacaaatataacaaggaaataaataagcatgcacattttgtatagtaatcacttcatacctaaactccttggtgaaaaaaaatgtcgaaacttagacacattctctatgttgcaaactcaggggaagtgagtgaaatgtcagaaggcatggcagcattcccagaggttagtgagtatcaggtaggctttgccaagcaggagggaggtgatgatatttgacttctgaggggataaacaggtaaggtgggatctgggcagattttcagacaaaagattctgttgtgaaggggcttctggttttaacatagatgtgactctccttaagtcttaggtgacctgatgtacttctgaaactattcattgattgtacaaatttctatttattttacatttttaagggcacagaaggatctaaactatgtgcacaactattctacaaaccaaactgaaaatcaaaatgaaatacacaaaggaaaagttgtttgaaattttgtctttaagatacagggaaaaaatcacacatcagtaaaatcaaggataaatatcagcctgaaggaggagcaataattgacaaatatttaaaaacaattgggggccaggtgtggtggctcatgcctgtaatctcagcactttgggaggccaaggcaggcggatcatttaagatcaggagttctagaccagcctggtcgacatggtgaaaccctgtctctactaaaattacaaaaattagccgggtgtggtggtgcacacctgtaatcccagctacttgggaggctgaagcaggagaatcgcttgaactggaaagatggaggctgcagggggctgagatcacaccactgcattccagcctgggtaacaaagtgagactcccactcaaaaaaaaaaaaaaccaaaaacaaaaaacaactggggtctttcttttctaaccatatctagacattggtgaaaatagtccttattaaagataataatagctatggagataaatcatccaagtgttgcatttatgtgtgagagtatgtatgtagaacagatttagcaaataatttttaaagctttcaataaatactttaagtgacttatatggacactttaaatgcacattcattaatggattcttgattgaataaaaaattaactcctgaaaatatttcctaaataaagtacatctatgcatggatgcactatgatgtttcaaccaacattaattatacccttttgatttctactgtcttgttcaaaaacactaataagacatgcactacatcatagttaataggagtgtggtgcttgttgcttaggcaacaggaggaataaatgcaggtcagaatgtgcttcaagaaaaacaaaagctagaatatgatactgagtggagactaagcaagtctaacagatttttcaccacattaaagaaatatgtttcttagagcaagccaatcatattcatgtgtttaactaagtttgcaattacataaattagattatgtagatcaataaataatttttataaaggtagaaattaatcgcttatgatactagtagcaaataaatggtgtataacagcatgtaaagcactaattgattataccacttcatgatttgcttcattttcataattaattaactcctctaaatggcaattcaaagtttttttaaaagataattctgtctcatgaagaaagtatttgattggcccatctaagttaataatattttcttattttctagaaaattataccaaatactttgaattaaacaagtaaagaatataatctatgattagaccttggttacatcatgtatatccaggattttgccttccatataaattttgaagtgcttatacatgattcattcatgaataatttttacgatctctctttgaatgcttatttgaaacctgtttgattaacctttcagttcgaggctttcaaaaaggtattatatttgctcataagtgtttaacattcagaggaaaaataagctgaattaaagtctttcagcttggccaaatgatccaggaaatccaaagacctaacttctcatgggaccagaataaatttggacaagggtttcagggttgggaatgagaaacccttatttcaagtagacatagggagaaataattaagatattgaaatgtacagtaaacataaataataaaaaaagacttcaattctgtttgatagttcttctaattcttaatgccatctgtttagtgtcctaagtctgtcctaaatctgcccagtgttctaagactttcatagcaattgaagaactttcacttttttccatttcaatacccaaatatcttgtctatataaccagtgacagtacttgataaacacaagaaaaataacagtagctgcatatatcagtataaaaaaaccaacaaatcactcataaagcattctgtgcatgcaattacttagagctcatatatcttactatatttatgtcttttttatttttaaaaactcttgggcatacatacttttggagaaggagcagaagttgaataatgttaataatcttcaaatctataatattcaagtcaacctcagagaaaaataatctaagatagaaattaaaaaatctaatcagctgtcactattgtgttatcatttctggtactagtaagctgcaggtgtcagccctattactgtatttaggcagggctattacttatttccacaagtcatttgtgtgttacatgcctgtgttatgtaggtctctctaaacttagggatcagtgatatgtgtgatgggtacttaaaagcaaggaaaggtaatagagctgtgacgtagcttaacaaggggaactgatgagcactgggggaggtatgggaatgattagaaagctgaattgtcggtttgcacagttccccatcctccttcctcacctatatgcaaaacggtggaaagttagcacatgccaggtttagattgcatgtagaccagaattcagaagtacatgactatacttactccaccaacctttctttctaaatattgacagctaaatgaccaaagtgtttattttccacctaaagtaataaacaatacttcatcgctcttcaatcagcaagtggaagtaaacgctctccataattgaccatctgaagcagtttgctaatgaactgaaggttgtccacatgatttaaactgcttattgaacaattatcaggaaaagaaatgatcttcacaccataaacacaacaaattgtctcattaaccactaaatgctgatgctcaagtgaaataatataagaatcaagaattagctgaagagtgatataatccgagtattctaagattacaaatttatttaaaaaatcataccaagaatgacagggagaatatcaatattaatcttctttcactgcctataaatagcactctcaccagttcattcatataacacatatgtatatggatacatacagatctcattttttagcaagagtctatatgtacacagcaagttcagtcctaagggcatccaattttccaatgcagttacatatataaatctgaccagttttggtgcaaatcaggctgcctctgagccatgtaagacacataagaagcaaagacagacaaaaggcagctccgtggacacagagagcttcttaccataaactgcacattgtcaaatccattagccatcaggtggttctcgtactgaggtagcccaatgctttccaaccattgtcccactgtttggacagggcatctgggtcctgtaagaggatgaagagggaagcgtttaagcagggagtagccgtccacggggtaatagcggtagtcctgggctgagaggtggcattgccacatcatgcccctgggaaagttgctatcaaaggagcccgccagcttgacagattaatgttctcagcgagagagcaaagtcagaagtaaaacatagtttgccaggcaggctgtggagtatgacttgatcctagctccacatttcttacatattaatctttactaccgaccagtacgtcatacagcccccaaaaccaggcagcagaagaaggcatatcaagctgtcagcttgggctggtctgcgttctatgtgattgttggagtactccacaatgagcaatgcacggccggcagccagaattcttttttatcaagtactcctacactcatcagtatgcagctccatgctccttgctccccctcgctcgctccccttcattacccagcccaggctacacctcgcattttcaataatagccatcagataaggcagattttttttgtctgcaagctgtaagcctgctgctgctgcttcctcctacacacccatccaagcgtcaatcttgaatgatgagagcagtcaaaacaaatgcagaaaatagcaagattcaaaagcaaaccaaagtgcttaaatctgaattgaatcttcatactggttatacgttacagagctatttgttgtggaattttacgtttcaaaagacaccaggaaatgcgaagcttgaactatagcttataacagagctcacgacaggttccctttctccttttcctttctttcctgtcttttcttcttcctttttaaatggagcacagataaacgtttctgatctgaagctttgcagtgtttggagaataattattctgtttctttaccatgctatagcaaaataagcctctccgagatatatatttttttcttttttgaaatactgcaaaatacagaaactgcatcgcaatcttgaagtcaagataatttatttcttgtttgcatggtttcttccaaacaaaagtattattaggcacaagaaatcctttttcccctctgatatttataacccaatctaccagggttaccattctaaattagctataaaggtaacattaactggatagattttttttttaataaagaagatgagccctaacccaaaataattcaagaataacagatgtaaatgtgtgagttttactgaatggcagatagactgagtaatttatttaataattgggagaaaccagggattaagaatagaacccacaggactagatcatcagaagaaacagactcttaagattgggagagaacttgcagaaaggttagtctaaccttcttcctaacgtaggcatccctggctaaaatgttcctagaggaatatcttccaacttctacttgaatactgcctgtaacagagctcttactacttctcacgaagcctcaatttattagaaagatatttcacttcctaccttgcttctactcactgctccagctctgccttcggagaagcacagattgagaacagtgcctcttccacataaagagctttaaaatttaaagataactctctcatccccccagagcagccgcctggcacatagtaagtgcctaatacaaatttattgaataaatgaaacatcgcttttcttttttcctcaaacctcatctttctctgtttcctttctctttttaagggcattgtcaactttcctggcacacagacattaaacctcaaaacatcttctactcctctttcactactgaaatcagtccccaaattctatcatccctcttcccagtgtgatccattcccttgattctatttcctgttttaagtttacagaactgccacctacattgattttgttctcatagttcaggcccacctagcctagtgaaacaacgacttctatattgatctttctacctctaatatttaaaaaatcaattttatgcatggtgtcagaataatccctttaagacacagttttgattactactccctgtctcaaaacccttctgtggttttctgttgtcttcaaaatcaactcccaactcctctgatgacattttggggtcttcatgattgactgcagttcatctaactttatttccacttttccactgccccagacaggcaggattacttgctggtctctaaaggcagcccataatgggctttggttggttttattatgtccccacatttctgtccatttgttggctttgaatcagttgctatttccattatgaaacctcttctaatcttctctaccacgaataaatctctttcttctctgtcttaaatggcatttttagaccctctattgtaacagatattttctgccttcaattttagttgtttgtgtctgacttattttttgaaagcaggcaatatgctttgctaatatttcacatagtaaagattcagtacatacctgctaaacaaaataatgtaatttcatgatccaaagtacaaaaaattctattttcaaatttaaaaaaagttttaactctatcccaagtctctaaattatttatttaaaataagataacttgttttttaaacagattttttcatgtctgtcttttagctcatcatcctcatccactttttgaataagcagccctgggtggactgcatagtacttgattatattttgttgctgattggtcctggatcttttaataacatcaaagagtttgtagtagtttatgaatcaattttaatagattctagttgctcaacattacctataggagaagctaaaaacaagatactatttgtccctggccagctctaaagctgttacaaggtggaagaaaaggaaagtctcaattatagcttctcctaggatcacagccacagtgcttcacctggtcattttgaattataaatagttgaatatactacatggaaattgagcaaacacgacaatgacactttggcttggcaaggcacatgctgattggccagctcttcaaacctgtttcatctgttaaaatgcaaaccaggggccaagtacctggcagagcacgatacacatcctgcttattaaataaactttgttaaataaatgcctgagtaactaaatgaataaatgatattggaaatgcctttcttgagattctcatttcttagtacagagagagggaaagagggagagggaagaaaaaatgtgtgtgtgcacaaaacatagagagtggactaatagacactggagactcagaaagggggagggtgggagaagagtgagggatgggagattacataatgggtacagtgtacactatttgggtggtgggtacactaaaagcccagacctcaccactttggatatatccatgtaacaaatctgcacttgtacctcttagagcaataaaaataaataaaattatatattacaaaagacagtatatttgtggtggggattatttcaaggttcagactgctatataagaacacaactcagagaaaatactggttatgaactactttacaaaatttatatagactgcctgaattttattcttttaggtattcaatccttcaatttttattcaataatttttacatgttgacaaaatgttataatatatggaggaagtgagctgggagaggatggggtgaggaaggtataaaagagagggaagaaggaaaaaaaagaagaccctgagtcatgttgtttgtttgcggttttgttgaagtattttctcatgagtcaaatctctaaaagaatcttggttcaggtctgaagatcactctgtaacagtgcttaaatatattactctctttacctaaaatacttttatggagtcttaaaattcttaaagcataacaacacactaattaggcaggaacttttattcaactagaatgtctttaagttccaaaagtgagacaagaggagggaaagaagaaactgaccattattctgggctaccatgtcctaggcagtgtggtgtgaattattatcctgatttaccgtaaggaaactgaagctcagagtatgtggtgaaaacaggaattttctttgtcatagtcttttaaaaaataataattctaggggttttactcccataatggcagtgtgaggagctccacaggtccaagccccagtcaaaaaacttaacttgaaaattataaacaaacaatcaaaaaaccctacacaatcagaaaccaaaaacaatgccaacaaaaaccaaccatcaaagtctttgcaaagtgtcctaagagcatataatgtaaaaatgtttattccaaagacagacactaaaacttggtaaaaacagattctgagattctgtagcacttgagccatagctccctctggcccctccttccctgcaactcatctccatagatgctccactttggatggatgtgtccaagagaaagggctccccttctcctcaaatcccaaccaagcggcatgggatctcatcaaaaggagcaggccagcatttccaatttcctctaaatctaagctgtagaggttcaattcctggtgagtgtggctgagaggtcaggggctcctttcttccacccagaccccattcatagaatagaaagttcatcccagctgggtcaggccaaaaatactgggatcttcactgccctcgactgcttacatatagggtagaggttccatgcccagaaaggtaaactaggaagaccagaggctatcattcttgccccatgcctggaagagtggctcaacgattttgcttaaagggagagtcagtttataagaacaaaaagctctaaagctttcccccaagaggttgacttatttgtttgttttcaatttttgttttggatttagggagtatatgttcaggtttgccacgtgcgtatattgtgtgatgttaaggtttggggcatgaatgatcccgtcaccaggtactcagcacagtacccaatagttagtttttcatacattgtccccctccatccttccctactccagtagtccccactttctattgatgtcttcttcatgcccatgaatacccaatatttagctcccacttataagtgagaacatacagtacttggttttctgttcctgcattaatttccttagaataatggtctccagctgcatctatgttgctgcaaaggatataattttttttctttttttatggatgcatagtattcaatggtatatatgtaccatgttttctttacccaattcaccattgatgagtactcaggttgatgccgtgtctttgttattgtgaatagtgctgcgatgaacatatgagcacagatacctttttggtagaatgatttattttcttttggatatagacccagtaatgggactgctgggtcaaatggtagtttgttttaagttctttgagaaatctccaaactgctttccacagagtctgaactaagtgacattcccatcaacagtgtataagtgtccctttcttctgtagcctcaccagcagctattattatgcctcttagtaatagccattctgactggtgagaaatggtatctcattgtggttttgatttgcacttctccgatgatcagtgacgttaagcattgtttcgtatgtttgttggccacttgtatgtcttcttttgcgaagtgtctgttcatgtcttttgcccatttttaatgtggttatttatttttatttgttcaattgtttaagttccttatagattctggatattagatgtttgttggaagcatagtttgtaaatattttctcccattctgtaggttatctttttactctgttgataatttcttttgctgtgcagaagctctttaatttaattaggtcccacttatcaatttttgtttttgttgcaattgcttttgaggatttagtcataaattcttccctaaggctgatgtccagaatggtgttttctaggttttcttctaggattctttttttttttgagatggagtcttgctctgtcacccacgctggagtgcagtggtgctatctcagctcactgcaatctccgcctcctgggttcatgccattctcctacctcagcctcccgagtagctggaactacaggcacccaccaccacaccaggctatttttttttttttttttgtatttttagtagagatggggtttcaccatgttagccaggatggtctcgatctcctgacctcatgatctgcctgcctcggcctcccaaagtgctgggattacaggcatgagccaccacgcccagcctcttctaggattcttatagtttgaggtcttactttaaatcttgaatccatcttgaggtaagttttgtatatggtcaaaggtaggggtccagtttcattcttctgcatatcgcaagccagctatcccagcataatttgttgcatagggagtcctttcctcattgcttatttttgttgatttgtcaaatatcaggtggctgtaggtgtgcggctttatatctgggtcctctattctcttccataggtctatgcatctgtgtttgtaccagtaccatgctattttgtttattgtagccttatagcatagtttgaagtcagggaatgcgatgcctctggctttgttctttttgtttaggattgctttggctattcaggatctttttggttcaacatgaattttagaaaagttttttctagttctgtgaaaatggtagtttgataggaatagcactgaatctgtagattgctttgggaagtatggccattttaaccatattgattctttcaatccatgagcacagaatgtttttccatttttttgtgaaactgaggttatttgacacagagtgtgcggaagtttaagcctaaacgtgttatcaaaatcaatggaggttacacagtggctcattcctgtaatcccagcaatttgggaggctgaggtgagaggatcacttgagtttgagaccagcttgggcaacatagcaagccctctatctctacgaacaattaaaaagtagccagagatgatggcatgtgcctatcatcccagctactcgggaggctgagatgggaggaccccaaggctgcagtgagctatgattgcaccactgcactccatcctgggtaacagagcaagaccctgtctgtaaaaaaacaaaccaaaccaaaacaaaaaaatcccccccaaaacccagtggagatattctggtgacaaacaatcaaaaagtggctaatagctacagtagggaaataagctaaatggtaggttagctagttttaaagaaacagagaaagacagttatgaagagccctgttgaggtcaaaagaaacttcaaatactagcttcaaaaattcctccttctcaaatttaattggagcagactctggagcaatttatagctgacggattgtcaaaaacaatagagcaatcagcaggcaattactggagtctaatatctggatgtgatatcaaatgagatagacaacagaaagattaggaaaagagacaaagagagccctgctataaccactgccatcccaaaactgtgcagatggccaaggctacacccttgagaggataaatacaacgtgatgcatccatactattgactattacttgacaataaaaataaatgaagtgctgatatatgctgcaaattgcatgaaccttgaaaacatcatgccaagtgaaaaaaaaaagctagttataaaagaccatatattgtataattctgtttaaataaaaggtcaagaatagacaaatctatagagacagaatgtagattaggggtttcctagggctggagaagtgaactgtggaaagtgactattaatggatttagggtttctttttagagtgacgaaaatgttttaaaattgtgatgatggttgcacaactctgtgactacactaaaaacaactgaattgtaccttttaaatcagttacttaaattatatatatgtatttatatagtatatcagtagatttaaaattattgaatgatgatataaaataataaaaacaaatcttaaaatttctttaaatttacaagaacaaaatgcacatacataattgtatataaaacattggggttgtttaatatatattggtagttttagtgctctgggttttttttcttctttagttttcttggttaccccttcctccattcttgtcctgcaatctgcatcatccatcctccctgcaaggttattcatgttaataaactggtatgtatattcatatatatttacccattttcaaataacacacacacacacacaaaggcagatatgttcggatatatacgtatatgggagagtatttttggcatggtttcatcaaaatgaaattataccactcacttttctgaaccttagtttgctcatttaacatcttataaaaattctactggccgggcgtggtggctcacgcctaatctcagcactctgggaggccgaggcaggtggatcacaaggtcaggagtttgagaccagcctggccaatatggtaaaacctcgtctctactacaaatacaaaaattagccggacatggtggcaggcacctgtagtcccagctactctggaggctgagggagaagaatcacttgaacccaggaggtggaggttgcagtgagccaagattgtgccactgcactccagcctgggcgacagagcgagactctgtcaaaaaaaaaaaaaattctactaagtaaatgagttttaatttattatttgttggttatttgtaaaaagttaaaatagttatttttagttattttcaactttttaaaaataactacataatagttcataatgtggataaaccacagtttattcagttctttgcctgatatctctaggatatctttgcctgatatacatccttttattttctttttttaaagatttttattttgaaataattgtcaatttgcatgaaatgatagagagagtgattctggatagattttcttcagttttctccagttgtgacatcctgtatgactttagcacagtatcacaatatcacagccaggtcattggcactgaaaaaaatccactgaccctgtttatatgtcctgtgttttacatgcactctgtgtgtgtgtgtgtgtgtgtgtgtgtgtgtgtgtgtttagttctgtacaattttatcacacgtgcagaccacgtggccatcatcacagtcgagacaccgacagcaccatcataagaatccctcctggaacttttttttatggccatagccttcttcctccctttcccattttttgacccctggcaactactgatctgtgtccatctctatcattttatcatttcaagaatgttacatgaataaaatcatatattatgtaacattttggaattgggatttttcattcagcagaattcctctgaaatccatacaaattattcagtgtgtcagtagcttattttttcatttctgagtagtattccatgatatggatgtaccgcaccatttacccattctcttccagagtggctgtaccattttacattcccattaatagtatacaaatgatgcagtttctttgcatcttcactagcatttggtgttgtcaatttttttatgtagtcattctgataggtatgtactaatatttccttgcggttttaatttgtatttccctcatggcttactatgttgaacaaaatcttattgcctgtatctttttgttaaaacgtctgttcatgtcttttgctgttttcttcattggattgtttttctactgttgagttttgagaattctttacatagtctagatactaggaatttgttggactttttatcaatttttttatggatcatgtttttggtgtctatcccattatttttaactttaaaaaatgagcatttaaaaatgtgtctcataaatagcccagagctgtaatattttaatctgaagttttaaaatacaatctctaatggcttacattttaatgggcaaatacaatttggagtaatgacaatcatgcttgattttatccattccatcttatgttcttatttatttacattgttgtttcctcattttccttttcttcatttttggtactctggtaacattcttattcattctatttttctctttttaactttgtgactctgagatacttctctattcctttcaaggttactttatttttccctgctctaatgatcagatatatacttttctatgattatttgaaaataagttaccaattatttccctctcaaaaacgctctatatccttcatactccagtaaaattagaccctcagaatgttttcctttcttcgttctctttttcctacaaccacatgtgatctctggaatgcttttcctttacccatctgccttattcccaaccagttcctaggttttgctgataatcatttagtaaacattttcctagtcaattactagaatttcctcacagtatattcctcctatttaaagagtctttatttaatatttatgttgcacactcccagttggtttatacatttcagtttagatttaattattgtaaagattcattggtcaccactatttcatatccttataaccatcttaatcttgaggtttctgtttccatttgtttgtagtttagttagaatagtttctcatatattcagaaaatattttaaactgattaatcataaaagcagagtgaatcacaatttgtgagatgcaggtaaaatggtacttggagataaatgtatagcactaaatgcctatattagacaggcagaaatactcaccactatactagtaaggaacaatgtctaccttagaaatgacaagaatttcaaatcatttatctcagaattcactttaagaaatgaaagtaagaagaaagataactccaacaaaaataagcagaagtaaggaaataaagatcagaggggaaataaatgaaacaaaagatcaatagagaaaaatcaatgaaaccaaaagctgttttttgagatgattagtccaactggtaaatctctattcaggctgaccaggaagtaaaggagaataaagaagtaatcaataccgggaatgagagaagtgacagcaaaagagtttttatggatataaaaagaataaagaaatgttatgaataactgttagtatcagtaaattcagcaacttagatgaaatgacaaattcattaagagaagcaaggtaccaaacctcactcatgaagaaaagttcataactgactagctctctacctattgaagtaattgtatttgcagttaaaatctttatacaaaacaaaacaaaactccaggcctcaatggctctagtgttaaattctaccaaacatatagtgaaagaaataatagcaattctacacaaactcttccagaaagttgaggagagagaatacttgccaacttattctatgaagccagcattattttgataccaaaatcagatcaagacattatgagaaaagaaaactatatgtattagtgtctgtcataaacatagatgtaaaaattcttaacaaaattttggcaaatagtatccaacaatatatacaggatgatacaatatgactaagtgaagtttaccccaataatgcaaggtctcttaaacatgggagaatcaattaatgtgattcatcagattaactaataaagaaaaaccatataatcctctccgcagatgcaagaaatcatttgacaaaatccagcatctacttatgataaaaactctcagcaaaatagaaagaaatttcttaatcctgataaaaaggcatttatacacaacctacagttagtaccatactagattgtgaaagactgaatgcttttctgttaagtttagaaacaaagcaaggatgtccattctcaacacttctacccaacattgtactggaggttctagctggtgcagtaagttacaaaaaagaaataaaatgcattcatattggaaaggaagcagtagaactgcttcttgcttctattcccacatgacatgattttctatgtataaaatcctgtgagacctacataaaaactacaagaaataataagtgagtttagcagagttgcaggatataagatcaatatacaaacatcaattgtatttccctacactaacaataaacaattggaatttgaaataaaaaccaacataatttacaacagcaccaaaactatgaaattctaaggaataaaactgtcaaaagatgtgtcaagaccaattaaatattgctgggaaaaatcatacaggacctaaataaatggaaagatatactatgttaatgaattggcacagtcaacattgttaacatatctgttcttcccaaatatatctatacattcaatttaatcctaatcaaaatcccagcaggtgctttgtttggtagaaattgtcaagatttttctaaatttcatatgaagtgcaaatgacccagaataaccaaaacaacttcgaaaaaaagaacaaagttgacaaaggtatactacctgactttaacacttattataaagacatggttatccacatattaggatattggggtcaagatagacaaacagatcaatgaaacaaaatagtggtttcaggaatagtgtgacacacagagggtcaactgagttttgacaaaggtgaaaaatcagttctgtaaagaaaggagagacttttaatgaattattctgggaaaatagaatacctatatgccaaaaaaaatttaatccatatctttcatcatatataaaaattatctcaaactgtatcataggcctacccatacaatctaaaactacaaaatttctagaagaaaacttagaaaaaaacttagggaaagtcttaaccttacagtaggcaccagaagtacaattataaaagaaaaaaatgataaacaactaaaattttcagactcttccctttgaaagacaatattaagagaatgaaaaacaaaatgctgattagaagaaaacatttgtgaatcatgtgataacaaatgtatatccagaatatataaagaactctcaaaactcagtattaagaaaataaatcaatttttaaaaatgagcaaaagatttgaacagaatcagagaaggtatatggaagggaaacaagcatttgaaaagaggctcaacatcactagccattaggaaaatgcaaatgaaaatgacaattagataccacttgttagaatgtctaaaatcattgccaaatgatgcgaattaagagaaactctcattccctgctggtgagaatagaaaatgttacaaccactttggaaaagtttgatggtttcttaaaaagccaaatatacatccactagatgacccagccattttactgctgaatatttacccaaaagaaataaaaacatatgccatacagagacttgtataggcatgtttacagcagctttatttgtaatagccaacaactagaaacatcctaaaagtccatcaacagatgaatggataaacaaattgtggcatatctatacaactgaatattactcagcaataaaaaggaatggatagttcatacacacaagacatggatgcatgtcaaaatcattttgcacagtgaaagaaaccagaccaaaagaatacattctgtatgattccatttatataaagttctagagagtataaacttaaatatagtgacagaaaacagatcaatggctccttggggatatgacaagattggtaggattacaaaggggcaaaaggaaacttttggggctgatgaatatattccttttcttgattgtggtgatggtttcacaggtgtgtatacatttctcaagtatcaaaaagggtacactttaaatatatgccgtttgttgtaggttaatgatacctcaataagcctactttaaaaagttaagctgggtgcagtggctcacgcctataatcccagcactttgggaggctgaggcgggtggatcgcctgaggtcaagagtatgagatcagcctggccaacacagtgaaaccccgtctctattaaaaatacaaaaaaattagctgggtgtggtggcgggagcctataatcccagctactcaggaggttgaggcaggagaatcacttgaacctgggaggcagaggttgcagtgagccaagatagtgccattgcactccagcctgggcaacaagagcaaaactccatctcaaaaaaaaaaaaaaggaagttaaaaaaataaagtagaaaaagaaaatacagaatgatgaggagggaagcaacttattttagacagaataatcagagaatgactctctgaaaaggtaatatttaaacagagactcaaaggtattgagggaacaagccattccagcatctaggtaaaagctctaggcagcgggaacagtaaatttgaggaccaatgacctgctctatattgtaatgccatggtgatcctgagggggtgaaactcagtggtacctcaattttggcatgttcttaatatcagtcttcttgtgtattgcatagccattgaagtcctaggagattgagataaatgtgttatttcaggacactgtctgaaaactgtcataactgcattaaaataaacccataatattagtttaggtatctaaaattaatttattcttttaaaagtaaaaggcagctaatattctgattaatttcagacatctcttaattaggttcgagttcattagggggaaaatacttctttttatactttattcatttcttcagcattcactgatttcttcaataaatatttatgttctaagcattttgccaggcggtggggagatagctttgaatatccatgtacttgtggaatttatagccttgtggagaaaatgagtttatcatttagagaaatgtcctttgagatgagagaaattaaaacttagagacatgacttcctattgtgaccacatagagatgagaaatacattagcaaaaacactacctgatttaataggtgttacttggtaaaactctgatgaaacagttaaggtgagtaaaatgatttggcagaggcagcagttaattatgtttgctaagcaggaaaatgacatttggaaaggatgaaggaaaacttctgaacaagagttttaaaaaaaagatgaagaaactggctgaaccctccaaaatgtaataactatctgtttatgctagcatcaaggtgactgacataaggcacatacttttcaaagaatgtgagtctttctagtgatcaaagccatagaaaatagaaggtagctaatatttattgggcacctactatgggtctggccttttatatatgttatctcattatgtaaaacaacatcaaacacatattgagcatttatttactgggagtcagcttctattctaaacgttctacatgtattggctcactttattttacagtaaactagtagtactattgttatcatctccttttatagggaatgaaaataagatacagagaagttatgaattgtctaaagctgcccagttaaaacttgaaccctaagtagcctggctccagagcctaactaagctttcagccactactctatgccgcttctgtgttccaggtgcacaggatgggaaacttgtccttttgcaggagtgagaatgctcatccatacacgtgccagcaagtttgttttaaaagggcttcttggggttactttgttgttgtttattctccttccccccttcaccttacattcattattcttggcttctaatgtgaaaagccatgagaaaaggcaggaggaaataacaagaggtgggagaatagtaaagcccatcacctggatatttttatttcatgtcagcaaagggctctgctgtgattttgaaatattgcagcttcagtgctgtttccacatgggtgctcagctggtctgcaatgcatggatgcctgtgctatgtgtccagaagacagctgccttgatgagatgggggacagtgtggaggtcggtagcccagactctcgagccagactgcctgggtttgaatcctggctcttttccatgatttaaatatttgctgcttctatttttaatatacagcaatagacttgtttctgggggcttagttgttctttggaagagtgaggggggacacctcaccccatctatctcatggttttatttgaagctgaaatgaaatagcacgtgaaaaaagcactgtaacttagagctatctcaatcgtagggatatattgttatctttactgccagtaaaatatatacctgtgttgttcattcagtccctcgaccaagagactggtcctgcgccatcagtgcatttccttgcccagttctctttgtttccaacagacaaaaatgcatggggtgagcagtctggccaaataacaggaaagctaattgtaccgtgaagtgatcagaattcccacacccatgatgttgttgaaggctttgtcttatctaatatgcaccaatagccaggtcttcagcactaagcagcctggtctttgcaatttatctaaaagtaaaaagagaaaaagcaatgtggggccaagagtggcaaagacaggatgattcttatttctaccgtaattagcaaaagggacaattagttattttaacatattttaaataaaggttggttatttttgaaggtactggtttaaaaaaagcacataatttcttaagaaggctatgcccacattggggaaagaaactgtgtattccactaataactaaagtgctggtgtctatgtgagcctgcctttctgtcttttacatcttgtgatacaggtataggagctaggagtgaatagtattcatttctgtaggacagaataagaaagatctcgactaacaaatctatttttaactagtaagtagcagtatctcatttttccaatcctaggtgtcctctgatctgagaattataaactacatgtccttcttccttatggagaaaaactgacagtaagaattagcaggaaaagagacaacccataagaacaatgcttcctcctgataaaaggatagccattctgaaattcaaaaatagaaatgcaaagcagaggtagcagacaacagaaaaatgaaagggattgtcattccaagaattggggaatgctataggtcaacaaagttctggatcataacgccgagatttaaataggaaaatactccaagattatggtctgatgttaaaatgctaagggaagtcaggagcttggattcaattttccctaaggccttgcattttatttctaactaaaatttcatggagcacttaagaaataccagcctttacaaaacagatctgacaacttatgtgctggggtatggtctaaaataggaaatgaaatttaagcctaaaatgctaaaatcttttggcagacaacaaaattatatatataggccatacctgattggaaaaaaatagtaattccgttgattttgttcttgttttcccttcttttaaggttgctggcaagtgtttgaatccccattgagaagaaggtgatcagagaattaagtcattgagccagtctgtgtgacagcctttgtgttaggaccagggaggaaagggaacatgtcccagcctcaaagattttagagtttagtgaggaggaaattaccataaagaatgatcagtattatattaaagatgtgtgcaagatatataaaatgttgaaggaaggggaggatgcttaacttggcttggatagagagcttatagaggagaccatctaatctgtgccttgaagacgtagtaggaatttttgaggcaaaaagaaggaagatggtgttccaggcagagggaacagcatgtgcaaaggtatgtttgaggaactacaaatgattcattattgctgtacttcaaaggttatatgtgcatgtatgaggagggaaatctgcacagaaatggaggcaggataagtaggaaacagacaatcaagggacttgtgtgccatgaaaaagagaactcttttctttcctgagaacagagagatttgatcaaattgttgttgcacaaacatcccctggaggatgtgggagatagacgaatacaggaaagaaactggaagtggaaaggtatagaaaacctgcaaggctctttctcttaaagagcaaatagacaaaatgacctaactaattattttaggagacagtctttaatgcagaggggcctccaaatattcttagtttcctagaacaaagtaagccctggttcaacagctgactggacttcctgtgaaagaaatttagtctgccatgcctcagctgcagaagtcagacatgagaggattcttcccatagagaagacttggtctaatgttggttcaaacttagcttgatagccatggcaaatgaacactctttagttgctagaagagcaatgttaaaatttcaggtgtttcgtgtatgctttacaaagtgatgaaaaataataacaatttttttaaaaaagatgatagctgagaggattaaagatgttgataaatacagaaagtgcttagaacagtacttgcatatatgcactgaataaatattagtgaaaataaatattagctataacaataaatattgactatatattattagctataataagtatttacctataataaccataatacatgtaataatgtattaataataattggctcctgaatcagaaacaaatttcaaatagtcacctctctgaataagttaggtactatctaaaatccatgaaatctgtgattttgaaagaactcatcaggaaactctggttcagtttttacatccatcactcttcagcagatgtattaagattaagtatgaacacagaagaggcactgaatttatttttttcatcttagcctattttaactgttccgaaatctcatgattagagtaaataccttctgtgatggatgcttatttaccttcttgataaagtcaactggtaaatctctaattcttataaatcagaagccagaaaaatgtctcaacctgaaaattaatgcttatttccattttctactaatattgtgaaaatccagggctaaaaactggtttctgcttcatttttccagcaatcgtaaaatgtttctttgggtaaagtgggataaattttcagagaatttgaccctcaattctgtgtgtatttttcacacttaagacaatcttagaaacttcacatgcaggaaatttaatttatttcatatagaagcattggctgaaaattataacataaaccaaaaacaaagaatagagctggcttaaaaatgttgaattaacagactaaaatatatttatactataatataaacatataattaggtaatttaaactaagcattgagattcataatgacccaaagtctgggggtagaaaaagagctttcttttcttctgttttctatacaactcagagccaacctgggaatctgtcatggacagttatattcaccaccaagcatgtgtccttctcttctgataaccacaattttccttgggggatttaccctctcattactcgtagttcctgtgcttgggaggagtttcttgcctatcatctactgggataggtatatgaccaaaatctggtgctgtcggtggcttctgagatggctgcattgattcttagttccttctactgaaggctttgtgcaagtccctcccacttgaataactttcttctaattaatagcatacctcaaaattgggaagatgtcacttccattattagattacaaagttctgactttgatcttactaagagatcctcttccttgctggtttactaggagatcctcttccttgatgaagcaagattctatgttgaggcccgtgccaaggaattgaagaaaatctatggccaacagccatctaagaaaggaggccctcagtccaacagatcaaaaggaactgaatcctatcaacagccatgtaaatgaactttgaagtgtatctcaggatgagccttcagatgagccccttgccctggcctacacattgactgaagctttgtgaaagggcctgaagcaaggacccagttaagccatgtctagattcctgacccacagaaattgcgagattataaaatgtatgctgttttaagctgctaaattttgtggtgatttgttatacaacaatagacaagaaatgcatctgggtgctttttatgctcccctggccaaaatgtttcattcagagttgaccacatgatccaactcagtacaataaaagttagggtctctctccctctgctgtacacacagggcataagattgcaaagacttaatcttggtggtattggaagtcttacttgaaccatttggagtctgaaaaggaagccaacatagagcataatagagtagaaaaatggaaagaggctggttcctaataaccttttttgagaatccagaatcaagctgcaactgaaacttgaatttcccttggatttttggatatgcccctttatattttacaaatataaaaaaattatattttcaaggtatatgtttttgcttaaaacaatttgagttatgaactaatatactacatcatgaaatagtcattgaattcctcttcttgcttttgtcttgcaaataatattttattctctctataaaacagtgattaattgttaatagagttaagaaaactgatgctcaatgaaggaattctctacttcagtacctgtggagtctaagataaatttttaaaaataaagtgctaaaaatcagctcagtagcatttacatagctagctgatgttggatataagaacattgacatggatttgaattgtatagtcacatgcattttgttttttaaaataatatagagacaaaatttccaacatgttgctttctactgtgtccacagaacccttcattctatgctgaattctactcaaagccaaataacatctttaagtttccatggacattgagcaaagtttcccagattctaccgtggttgtgttacaagttaagtattccttatccaaatgcttgagaccagaagtgtttcaaattttggaatatttgcatatacataataagacatcttgggaaagagacccaagtctaaacatggaattcatttgtgtttcatatacatcttgtacacatagtctgaaggtaatttaacacaatattttaaataattttgtgcatttaaataagtttgtatatcttgagccatcagaaagcaaaggtgtcactatctcagctgcccatgtggacaatctgtggttgtttggcatcatcataattcctgattctgaaattatatgctactgataagcaatctttttttatacttactcaacacaagtacttcatagtaaaaaataggacataccattaatacaggaaaaaataatgtgttcaggttagctaatccgcatagtaccatcaccagaatacctgcatcagctgttgaagaagagcaacaacaaatagttgcaggcttccaggctccacctacgatgctgtgttttgattgaaaggtttctgtacactgtgttttattttttatttatttacttatttttaattttacttttgagaccgagtcctgctctgttgctcaggctggagtgcagtagcatgatctccattgactgaaacttctgcctctggggttcaagtgattctcctgcctcaccctcccaagtagctgggattacaggtgcccatcaccatgcccggctaatttttttgtattttcagtagagatggggtttcaccatgttggccaggctggtttcaaactcctgacctcaggtgatccgcctgcctcagcctccctaagtgctaggattacaggtgtgagccaccacacttggcctgtgttttatttttttaggtgggaagaaacatcagacacaggtgagagaccaggaagtgggtcctccagggatcaggaggcattctactggttggctttttaaaatgtttcctccagagtcatttgcctcatttacaatgttttttgtcttttaagtttctctttgatttcataaactgacatgatttcttgttatgaatgcatgctgctctagaccttcaacaagtccatcacacattttcaccatgtcattataggcactttttcctcagtatgaatgtcatcttcatcattactacgatcatgatcaccttgattcagaaccatttcagctgcttcaggattggtcaatgaatgcacaaatggagcctcaatgttaaaaaaacttcattgatatgcacttctaccagcttactgattgatatagtttgaatgtcaaactatatcatgttgaggtgtaatccctagtgttggaggtgtttggatcatgggggcagatccctcatgaatggcttgggccatccccttagcgataagtgagctctcattctcagttcacatgagatctggtcattaaaaagtgtctggcacctcctcctaattatctctctctcgatcccattttctccgtgtgagatgcctgctccccctttgccttccaccatcaataaaggctccctgagagccccccagaagccaagcagatgccagcaccctgcttcctgtacagcctgcagagccatgcgccaattaagcctcttttctttataaattacatagtctcagatgtttctttattgcaatgcatgaacagcctaatatactgatagactctgaatgcatattttctgcatatgagaggaggtccaaaatcatttttttcacacttgacatatgggaatccttcaaagtaccaatttgttcatcatcatcactgaacacagccatagacaacaggttgtaccaggcatgcaaaactgtctttagtcactatgttccaagtcttggcaacagcatatacagtattcttcatgttaaactcctttacgaaaacgtccatgcccatacctctgttccctgacgctagcatgctgtttaataaagtgtttttatatttccttttcattgacttaagggtaccctaatcacatagctcaatgaatgaagtcacatttgaggaaaattgcatgacataaacttttttttatgagaatttcacctggaggatgagcagaacagttgttaaggaataacaaaatattgcagttgttattcagtacagcttccatgcagtgagcatgagccgctggtacaaaatgtttgtgaaatcaatcaggaaacatgtccctgatgatctatgtctttctgttagcataataacagaatggtaagaaattcactccttgaaaacagcagggacacaagcttttgcttaaaacagcaagtttacacttatgtatgtctgctgcattagcacatcccagcagaggtattacccttggcctccttaattcctgtctaggctgtctcatcagctgtggttagtgtcttcctggggcaataatggcaataatgccaaaacagtgatgtttcatcagcattatagacttgttctagcatcagattttcacaagtgatgaccttggcaaacttgttactaaatttttttttcactgctttgtaatcagcagatgctttactaccacaatctttacaagtctaatgctgtgtctcttcttgaatattcatggttaacttcaattttcagttcattgtgatagatctttgtttgtttcataatcagaataccattaagtggcacgtgttcactgcaacaccaacagatccattccttccatacacaattgagatattccattttggctttatgcagtgtttttctatttttcattatcttctgctcatcactttcagtatagaacttgaacagtttatcctgctatttcctcaggtcatatccagggtcattccaacgccatactcttctgtaagatgcttcacacattcaccaatatccaatttctccaacagcttggctttctgtggcatagacaaacattaattcttcctctttttaaaatcatgattatccatacccacaggggtgtctgtaggccatttggactctttcaacaatatctttttaccacgaagcagagattaagcaaaaaatccacaatgggtaatgcacatgtcttggccccacacaggacatcatggcacctcatggggaacctgctgttggcatatccaattaacacacatgctttcttattacctttgactggcaggcttgttgggggagaggaatctgggcaggcatgtgaatatgttgcaattgaagagggctgggggccctttttacccttggggatgctgaataaattaaaataatttcaggcactatcaactttgttgttgtatttataacaatgcagggaatgtttccccaaccttttaaatgtttgttccctattgttattatatttttctgctttgttcattatttattttatatcaaatatggtttcattgaaaataactttatatgcataatttgcctaatagatcataaataacttaagaccattcatgtaataagataacaaaaataacaatatttttgtagttttagacgtgctttaaataaaatagtaagaacaaaagttcataaaatcttatcgaggtcaaatgctagcccagttgttgatccaaaaccagatatctcttcaactcaccctaatgaactatcaatgactaatcataaaattgggataataaaaataatgctttagcatgataaaggaataccaaatatagagacaatgtagaaaaaaaggttagcagtaataaaataaaccttggctataacattcatttctataaactatagtaattatctagatcaaatacatattatggattgactaagtgtgatgatagaaaatgggcttaggaaggatataaatttagttgaggccgggcgcggtggctcatgcctataatcccagcactttgggaggctgaggtgggcggatcacgaggtcaggagattgaggccatcctggctaacacggtgaaaccccgtctctactaaaaatacaaaaaaattagccgggcgtggtggcgggtgcctgtagtcccagctacttgggaggctgaggcaggagaatggtgtgaacccaggagatggagcttgcagtgagccgaaatggcaccactgcactccggcctgggtgacacagcgagactctgtctcaaaaaaaaaaaaaaaaaaaaaaaaaatttagttatctattttaaggaataaactgaaaagacatgcattgtgtcatttaccttaacaaacagtttacaagagtgccatgcattctctttcctgccatccttcttgacttcaatagcattttgtaaaagatgatggtttagggccatgtaacagctggcttagtatattagctctaggaaattttcttaacaaagagcagactcctaattatgtgaccatgggaaaaactctctatgaatctcctttctcatctataaaattaggaaaatctgtaaagtgagtacctatataatagggttgttgacagattaaatgtgataatacttaacaacagtgctgacatatgataaatcctcaataatgctaactgtaattactattataatatcactgtgactattgttatttattattagtatcatcaaaattatttggcatttaaggttctccatcatttgggcttaatcaaccccaactgcatttataataaaccctaggctgtaacattcatttctatgaaccctttcctccttgttatgagaatgcttccttctatttattcattacctgcctcatggcttcttgcttccctgtttttgttcatgctatcctttctacctataataatctgtggctccctcatcctttttgccaatttcctcctggctttgtgctactgatcctttgaggtcctttcatctcctcagcaagaatttctaggatacttccagttttcttcttcttataaactcccatagtacattatttatgcctcttacaaggcattttaaacttttgatactgttaaaaatgtacatatacattgcatatttttcacaagactttaaacacctagatgatggaagccatgtcttaaccatctctgtgtcccacacagtacctagcagaatgccttgcacaaagggggctaaacagatattctaaataaatggtgattataggaatcagacatgtaatttttgcttcattagaagaatcttctaattaactggactaagcagtgcttactttcccaaaaagttgattatagagactcactgttggaggtttgtttcttaggtaatcaaggctgatcactggatttctttgattttcccaagattggggctaatgcctgaaattggggaaagttctttgagggaaagggtttttttttttttttttttttaatctgaacgaaatttcaaaaaagggaatgcttcttacttgaccaaaattgaaagcaccatgggataaaaatttctgagttatgagtctcaggggtccaaacacaaaaccccaaagcatggcctcttggtttgctgactactttgaactgaaggacactgaaagtgcctcagaagcaaggtctttctgatcctctcctgccttctttctccctctccactttctcccccaaagcaagccataaaacctaggaaggtctctgacctcctcccctccctactgactgtcctcatatgacagatgtcctgtcccatatctggggtgaatctgaacaaacaggcctaagtttctccccagtttacatccattagagtatactgttttctccaaccatacttctacatgactatccattcttcatcaaatctaagcataaaaatatagctttccttgggtttgtgggtgttcatttctgaagccttgtgtgtcacataaactttggttaaataaattcgttatgcttttctcttgtcaatccatgttctgttatagggatgttaaccatgatccttgcgataagttaggaaaaagaagccttggcttttttttttggctcccaataccttgctcacagaataaaactttataatttctcataatatgtttttcttttgaaagccccaaccatccactgagcttgaaatctatgttttatttctgaaggctcattattctagattttagctttcatttggacaatgatcaaagagaaacaactttcacagcctcaaggtaaaagattgtaaacagcaaattagtgaacaaaagtatttttctttagttttatcttaaatgtataagaacaaaaaccaagatggccttcacaagagaaaatattccttttccaaataatattggctaatttgaaattttcatattcaaacaaatttaattttgtgagtgggaaaaacattttttcaagagaaagttttaggtattttcttattttttatttttttgtgggtacataatgggtgtatatacttatggggtatatgagatttttcatacaggcatacaatgtgtaatgatcacgtcagaataaatggggtttccatcaacagaagcatttattctttgtgttacaaacagtccaagtacactcttttagttatttttaaatgtataattaaattattatatttaattatataactaatgatagttaccctgttgtactatcaaacaccagatcttattcattctttctatttatttgtacccattaatcatctccccttcctccttatcctcccactacccttcccagcttctggtaaccatatgtattagtccattttcacactgctataaagaactacatgagactgagtaatttataaacaaaagaggcttaattgactcacagttccacatggctggggaggcctcaggaaacttataatcatggcagaaggtcaaggggaagcaaggcacattttatatggtggcagggcgtagggactgccacacacttttaaaccatcagatcttgtgagaacttgctatcatgagaacagcatgggggaaaccacccccacgattcaatcacctcctaccagttccctcccccaacacatggggattacaatttgacatgagatttgggtggggacacagagccaaaccatatcatcatcttactctctatctccatgagttaaattgttttaatttgtagctcccacaaataagtgagaacatgcaaagcttttccttctgtgcctggcttattttacttaacataaggacctcctgttccatcgttgttgctgcaaatgacaggatctcattctttttatggctgaatagtactccattgtgtatatgtattacattttctttatcaattcatctgttggacacttggttttttccaaatcttggctattatgaatagtgctacaataaatgtgggggtgcagatatctcttcaatatattgatttcctttcttttgggtatatacctaggagtgggattactagatcatatggtagccctacttttagttttttcaggaacctccaaaccgttctgcataatggtggttctaatttacgttcctactaacagtgtacgagagttcctttttctccacgtcttcaccagcatttattattgcttgtcttttggataaaagccatttaactggggtgagatgatatctcattgtggttctgatttacatttctctgataatcaatgatgttgaacacacttttatatgtctctttgccatatatatgtcttcttttgagaaatgtctattcagatcttttgctcagttttaaatcaaattattagattctttttcctgtagagttgtttgaggtccttgtatgttatggttttaatcccctgtcagatggagggtttgcaaatattttctcccactctatgggttattaattatatgaaatatttagaaagaaaacaatagttgcatccatatctgaaaaatttagagacactgatgacatgatgaccttcattccctaatgtttttatggatgatctagatatcacaagacacattaaagaaactacactgtagggaatattcaacagttggattgagcttatgcagcgtttcccaaagttttagaaattccatcagataacaaaaggaataatgtccaataagaatcattggtcttaggtgcagtggctcatgcccgtaatcccagcactttgggaggccaaggcgggcggatcatgaggtcaggagtttgagaccagcctggccaacatggtgaaaccccatctctactaaaaatacaaaaaattagccaggcgtggtggtggtcgcctgtaatcccacctacttgggaggctgaggcaggagcatctcttgaaaccagaaggcggaggttgcagtgagctgagatcgtgtcactgcactccagcctgggtaacaagagcaaaactccatctccaaaaacaacaacaataacaacaacaaatcattggtcaaggaagtttgggaaatagagggcaaagcaggttaaacagatttctttaatgtagatccctgagactttgacatactaattttcctcatgaatctccaataagggttatacggcattgatgtttcctgacctcatatggccaaggattactcttgacttttttctgtcagagcaccttgaaggactgacaatctatgaagcacattttgggaaactcatgtctaatattatatacaaaggaggttaatgacaatatgcaatgaaaaattaatcaaaatgcagtttcatataaatcaaatatacatttcacttataatatcaaatataaaaaagacatagtcttgaagtaaaatgagccttatcatctcaaatgggtaatctggatattaattcacctgttgtttagaatcttattcattaaacaagcactcagtttttaccttctttgtgacaagcactgtgttcagtaccaagataataaaagatgatagtaacacaatatatcttcccatttagattgcaattccacagagttctaaaggtactttctttggcaaaatagttcaaaaaatatgtcaagagactatatcaataagttattgagccatagactattaaagaagtgggaggtcaatagaggagagataagaaggtttcatggtgtgcaagattggaatttggcctagaggactgataggaggtacagtttagctccatttgggttcaagcatagaacatgtacagaataaagaaaagacttagggctacaagttcatattagaaacatcccctagacctagagttagagatctagattccaattccagttctaaaagtcacttgctatgtgaccttagctatcttgtctatctatagattatggaaaataatgcctgttttgtctatttcaaaatatcattaggagaaaacacctatagatagcatagtatgttgttaatttttggagttcaaactatatttatctaagttcgtcaagagttagtgcaaagcattgcttacaatgtatcctcaatgaacatttatttcatgaaagaatgaatggataaaagaagttagacctgaatttcctctgccacttactaactaggtcatacatgaccttagttaaattacttagtcaccctgagcctcaggtttcgtatttctaaaatgagggttaaaaattatgcttatatcacaagattgctctggttaaatggaaattgatgaaaaattcttagcacagtagttagtatatacttttcatcacatatacatcctatatattggataattaaagacaattcatcaaatataaagtacagtgattgtgtttatgataaaaactatcacatagcagagaaggagaagtgagtgttcaacatgtagttgtgaactgacacttttggtccaagagctgcatcagaacacgatgagtgacacacaatgtgcaccataacatcaccaagaatgtgagtttaaaaagtatcagatcattgactgattcttcagaaggatcctagattaccatgccatttaaaaatatgtgtaagaaaagcagagctcaaaaattatgtatgagaggctttccagtgtacgttgagcctcaaaggaataaaataaactgaaatttagacatttactcacaacgattggtatagctcagaggtgataatctctggaaagagtattgataatgttaatcattttatagattttaaattggtttgtgttctactgggaaccaaagaagatgtcatgaaggtggctggcaagatggacgaataggaatagctctggtctgcagctcccagtaagatcaatgcagaaggtgggtgatttctgcatttctaactgaggtacccggtttgtctcattgggacggttagacagtgggtgcagcccatggagggcgagtagaagcagtgtgaggtgtcacctcacctggaagtgcaaggggtcgggggactccctcccctagccaagggaagccatgaggaactgtgcagtgaggaacggtgcattctggcccagatactacgcttttcccatggtcttcgcaacctgcagaccaggagattcctccagtgcctatgccacaagggccctgggtttcaagcataaaattgggcggccatttgggcagacaccgagttagctgcaggagttttctttcataccccagtggccctggaacaccagcgagacagaactgttcactcccctggaaagggggctgaagccagggagccaagtggtctagctcagtggatcccacccccacagagcccagcaagctaagatccactggcttgaaattctcactgccagcacagcagtctgaagtcaacctgggatgctccagcttggttggggaaggggcgtccgctatgactgaggcttgaataggcggttttcccctcacagcaaaacaaagctacaggaagttccaactgtgcacagcctactgcagattggtaaagctgctgtagccacactgtctctctagattcctcctctctggcagggcatctctgaaagaaaggcagcagccccagtcagggccttatagataaaacttcatcttcctgggacagagcacctggaggaaggggcagctgtgggcacagcttcagcagacataaatgttcctgcctgccagcgctgaagagagcagcagatctcccggcacattgattgagctctgctaagggacagactgcctccttaagtgggtccctgacacccatgcctcctgactgagagatacctcccagcaggagtcgacagacacctcacacaggagagctctgactggcatctggagggtgcccctctgagatgaagcttccagaggaaggatcaggcagcagtctttgctgttctgcagcctctgccgctgatacccaggcaaacagggtctggagtggacctccagcaaactccagtagacctgcagcagaggggcctgactgttagaaggaaaactaacaaacagaaaggaatagtatcaacatcaacagaaatgacatccacaccaaaaccctatcagaagtccaaaggtagataaatccatgaagatggggagataccactgcaaaaaggctgaaaattccaaaaatcagaatgcctcttcttctccaaaggatcataactcctcgccagcaagggaacaaaactggatggagaatgagtttgacgaattgacagaagtaggcttcagaaggtgggtaataacaaattcctccgagctaaaggagcatgttctaaatgaattgctaactagaataaccagtttagagaagaacataaacgacctgatggagctgaaaaacacagcacaagaactttgtgaagcatacacaagtatcaatagccaaattgatcaagcagaagaaaggatatcagagattgaagatcaacttaatgaaatcaagcatgaagacaagattagagaacaaataatgaaaaggaacaaacaaagccaccaagaaacatgggactatgtgaaaagaccaaacctacgtttggttggtgtacctggaagtgacggggagagtggaaccaagctggaaaatactcttcaggatattatccaggagaacttccccaacctagcaagacaggccaacattcaaattcaggaaatactgagaacaccatgaaggtactccttcatgagaagaacaaccccaagacacataattgtccgattcaccaaggttgaaatgaaggaaaaaatgttaagggcagccagagagaaaggttaggttacccacaaagggaatctgataagactaacaacgtatctgtctgcagaaaccttgcaagccaggagagagtaggggagccaatattcaacattcttaaagagaataattttcaacccagaatttcatatccagccaaactgagctttaaaagtgaaggagaaataaaatcctttacagataagcaaatgctgagagattttgtcaccaccagttctgccttataagagctcctgaaggaagcactaaacatggaaaggaacaaccggtccagccactgcaaaaacataccaaattgtaaagaccattgacactatgaagaaactacatcaactaatgggcaaaataaccagctagcatcataatgacaggatcaaattcacacataacaatattaaccttaaatgtaaatgggctaaatgacccaattaaaagatacagactgacaaattggaaaaagagtcaagacccattggtgtgctgtattcaggagacccatctcatgtgcaaagacacacataggctcaaaataaagggatgggggaatatttaccaagcaaatggaaagcaaaaaaaaaagcaggggttgcaatcctagtctctgataaaacagactttaaaccaacaaagatcaagagagacaaagacgggcattacataatggtaaaaggatcaatgcaacaaaaagagctaactattctaaatatatatgcactcaatagaggagcacccagattcataaagcaagttcttagagacctacaaagagacttagactcccacacaataatagtgggagactttaacaccccactgtcaatattagacagatcaatgagacggaaaattaacaaggatattcgggacttgcactcagctgtagaacaagcagacctaatagacatctacaaaactgtccatcccaaatcaacagaatataaattcttctcagcaccacatcacacttattctaaaattgaccatataattggaagtaaaacactcctcagcaaatgcaaaagaacggaaatcataacaaacagtctctcagaccacagtgcaatcaaattggaactcaggattaagaaactcactcaaaaccacacaactacatggaaactgaacaacctgctcctgaatgactactgggtaaataatgaaatgaaggcagaaataaataagttatttgaaaccattgagaacaaagacacaatgtaccagaatctctgggacatagctaaagcactgtttagagggacatttatagcactaaatgcccacagcagaaaacgggaaagatctaaaatcaataccctaacatcacaattaaaagaactagagaagcaagagcaaacaaattaaaaaggtagcagaggacaagaaataactaaaatcagagcagaactgaaggagacagagacacgaaatacccttcgaaaaatcaatgaatccaggagctggttttctgaaaagatcaacaaaatagaccactagccagactaataaagaagaaaagagagaataatcaaatagacgcaataaaaaatgataaaggagatatcaccactgatcccaaggaaatacaaactaccatcagagcatactataaacacctctacataaataaactagaaaatctagaagaaatggataaattgctggacacatacttcctcccaagcctaaaccaggaagaagtcgaatccctgaatagaccaacaacaagttctgaaattgaggcaggaatgaatagcctaccaaccaaaaaaaagtccaggaccaaacggattcgcagccgaattctaccagtggtgcaaagaggagctggtaccattccttctgaaactattccaaacaatagaaaaagagggactccaccctaactcattttatgagaccagcatcatcctgataccaaaacctggcagagaaacaacaaaaaaagaaaatttcaggccaatatccctgatgaacatcaatgcaaaaatcctcaataaaacactggcaaaccgaatccagcaacacatcaaaaagcttatctaccacgatcaagttggcttcatccctgggatgcaaggttggttcaatatatatacaaatcaataaacattatccatgacataaacagaaccaatgacaaaaaccacaattgtcttaatagatgcagaaaaggccttcaacaaaattcaacagcccttcatctaaaaactcaataagctaggtattgacggaacttatctcaaaataataagagctatttatgacaaacccacagcccatatcatactgaatgggcaaaaactggaagcattcccttagaaaatgggcacaagagaaggatgccctctctcaccactcctattcaacatagtattggaagttctggccagggcaatcaggcaagacaaagaaataaagggtattcaaataggaagagaggaagtcaaatgcctctgtttgcagatgatatgactgtatatttagaaaaccccatcgtctcagttcaaaatcttcttaagctgataagcaacttcagcaaagtctcaggatacaaaatcaatgtgcgaaaatcacaagcattcctatacatcaataatagacaaacagagaggcaaatcataagtgaactcccattcacaattgctacaaagagaataaaatacctaggaatacaacttacaagggatgtgaaggacctcttcaaggagaactacaaaccactgctcaaggaaataagagagaacacaaacaaatggaaaaacattccatgctcatggataggaagaatcaatatagtgaaaacgtccatactacccaaagcaatttatagatacaatgctatccccatcaaggtatcattgactttcttcacagaattagaaaaaacagtgctttaaatttcatatggaaccaaaaaagagcccatatatccaagataatcctaagcaaaaagatcaaaactggggacatcatgctacctgacttcaaactatactacaaggctatagtaaccaaaacagcatgatattgttacaaaaacagatatacagagcaatggaacagaacagagtcctcagaaatcataccacacatctacaaccatctgatctctgacaagcctgacaaaaacaagcaatggggaaaggattccctatttaataaatactgctgggaaaactggctagccatatgcagaaaactgaaactgcacccccttccttacaccttatacaaaaattaactgaagatggattaaaaacttaaatgtaagacctaaaaccataaaaaccctagaagaaaacctaggcaataccattcaggacacaggcatgggcaaagacttcatgactaaaacaccaaaagcaacagcaacaaaagccaaaattgacaaatgggatctaattaaactaaagagcttctgcacagcaaaataaactatcatgagagtgaacaggcaacctacagaatgggagaaaatttttgcaatctctccatctgacaaacagctaatatccagaaactacaaagaacataaacaaattttcaagaaaaaaaaaaacaaataatctcatcaaaaagtaggtgaaggatatgaacagacacttccctaaataagacatgtatgcagccaacaaacatgaaaaaaagctataatcactggtcactagagaaatgcaaatcaaaaccacagtgagatattatctcatgccagttagaatggtgatcattaaaaagtcagggaacaacagatgctggagaggatacggagaaataggaatgcttttatactgttggtgggagtgaaatgagttcaaccattgtggaagacagtatggtgattcctcaaggatctagaaccagaaataccatttgacccaacaatcccattactgggtacatacccaaaggagtataaatcattctactataaagacacatgcacacgtgtgtttactgcgacactgttcacaatagcaaagacttggaaccaacccaaatgcccatcaatgatagactggataaagaaaatgtggcacatatacaccatgtaatactatgcagccataaaaaggatgagttcatgtcctttgcagggacatggatgaagcaggaaaccatcattctcagcaaactaacacaagaacagaaaaccaaacaccatatactctcactcataagtgggaactgaacaatgagaacacatggacacagggaggggaacatcacacactgggcctgtcagggagtagggaactaggggagggatagcattaggagaaatacctaatgtagatgacgggttgatgggtgcagcaaaccaccgtggcacgtgtatacctatgtaacaaacctgcatgttctccacatgtatttcggaacttaaagtataataaaagaattggctgggtgcggtggctcatgcctgtaatcccagcactttgggaggccaaggcgggcagatcacgaggtcaggagtttgagaccagccttaccaacatggtgaaaccccatctctactaaaaatacaaaaattagctgggcgtggtggcaggcaactgtaaccccagctactcaggaggctaaggcaggagaatcgcttgaatccgagaggtggaggctgcagtgagccgagattgtgccactgcactccagcctgagtgacagagcaagactccatctcaaaaaaaaaaaaaaaaaaaaaaaaagtcacatattgtgatcataacagaggtaggtgtttgagctggtactcttattctgagaagcatccattggctttgatacaaattttattgttaaaaatgatttgaaaattgaaaattgtcttgcttgatttccctactatctttgaagtattttcagttcaatactttgaaatatttcagggttcaataaatcaatgagacatatggattatctagggagaatctatttgtttctctaggccattgaactgttggaagcacattaattattcatgatttcttctgattaacaaatttgtactatctgaaatacatgttcagtactattcaatactttattaaaagttatattatttactcctaaaaaccagagttgggtacataattatttcttttgttagcattttagagatataaaaggggcttatttctaataacaacgaagattaaccattacacaaggcattctagaaatgagtggtcataatatcacattttaaataattgaaaaacgtatacaaatatatgttgcccaaaataaagcatgacgtcaaccatctgttataatataacactgcattttcttacattctctaggtaaacattatagggactattatgtaaaaaaattccaaattattctaatagctctattcttaaaaccattaagaagattatctctgtttttaatattcaatataataaatacaatttgagtgcaaaagtttaaaaagttttatactatattttatataataataacttatgctactttactctcctagtattgcaagctaaaatcttttaataccaaagttactgaagaagagaaaaatttttaaattaacactttaatatattctgtcttccatctcttagacaacctgttgtcaaattctggcatctcttcctacttcttcagatttgacttttctttggattcatattgcataccttacacctgcaataaattatatatacctttaatatgcttattccttgtacataacagctatagctactgttgggctcagaacatgataccctgaaatatggcactttggcaattgagaagactgcagaagcaggaaggttgcttttactttctcctccctttttcttctaaagaacattcataaagagttatcgacctatctcacctgaatgtaggtcataagaacctcacaccacacaggtcctaccctatacccagaaactaagaaaaatctgaacaaagaggtcctggtaagttccttccagtttattacaaatagttcatatccactttttgtccaattatacatctacacaactgttcattcttcattaaacttaagtataaaaatacaattttttctggttctttgggtcttcatttctgaaggctcttgtgtcatgcaaaactttggttaaatacattatgcatttttcttgttatcttgtcttatgttgtaggagtgtcagttgtgaaccttgtgatgggtgaggaaaagatacttctttttctttcctagaatactcaatacatgttatatgaatgaattgctcatctgactttcttcctggcctctctactcagccactgaatctctggggacctagtgtaagaagacagattttccatgtatttctagttcttttttttttttttttttttttttttgagatggagtcttgctctgtcacccaggctggagtgcagtggtgcgatcttggttcactacaacctccacctcccaggttcaagcgattctcctgcctcagcctcctgagtagccgggactataggcgcatgcccccacacctagctaatttttgtatttttagtagagatggggtttcatcatgttggccaggatggtctcaatctctttacctcgtgatccgcccgcctcagcctctcaaagtgctgggattacaggcatgagccactgcacccagccatatttcaggctttaaatgaaatggaatatatattttttaaaggtaagtttaaccagaatacatttattcatgggaatttttttatttacacccatttgaagactaagctacatttgaaattgatatcatattgcataaacatatgaatacatgtatttgtctaacataaagtcttcaataaatatttagtgaatgaataaaagtatgttatactcaacataaatgagtttaggtcatttcctgatgactttgaggggtcacagatgtgctggtgctttccttgacacaactttctcttacccctttagtttaaatatatatatttaattattttaaaaatagagtttcatattttgagttttatttaataaaacagatcatcaaactcataaatgaagcttgtaaaacattttggaatgacttcatccacaaattttgaggaatgaaacaaaaaagaaatggatattaaaactcttaagaggccaatcaaccatttgtgttttgatattattagcaccccaattcaaacacacaaaaggttaaaaaataaattataaaacaactggggacatttggacatcaagtgggtcttggataatattaagcaattattgtttgatattccattaggtactgtaatggtattttggttattttttaaagttgttatttttacatgcaatatattaacagatgagatgatatttcttagactttcttcaaaataatcctgtgtgtatatggggagtgaatgcttggtatagaaggaaatatggttatttgttgataggttttgaagttgggtgataggaacatggatgttcataacaccattttctttacttctgtatatatttgaatttttcaaaaataaaaaggtttttttaatcatgctaataaaactatcagaggaactttgaaaacattggattcttgagataaagtggctttccagaaaaaaagtggcatgaaataaaatgctctcatactttgtttaactgatgtactttatttaaatatctttactatatattattggtttcctagttagctatgccaatatattagatggtggaatcatgacctatagctagctgagaattttaaattttactgactttattgactccatactcttcatggacactaatttagtcagacaagttacagaactccaataacgtaataaacatgttaagtgcctagtgtattaaatctcttctgaaaatctacctttttgatgattttgagcatggatttctaataactgaatgccatagtgtcaaatgttgatttggtcaaagatactgtttttgactggatcaagcaaaaacacttcccaaaatgcagcagcagcacaatctgttatattgcaatgagaaaaaaaaattggcaaggactataaaagttacttaagaaagaacttcacaaggagatgaagcacaaatggaaatgcctcagaaagtagaatgtagggcaaatttctaaggagatcacaaagaaatagcaaaagcttgtaggagttgggtcaaaaaagctcagcaggaaacaggatgccacatctaagaaacatgaaaggaaacagaaaaaagaattcttttactatttcaggaacaaaagaaagctaaatgacacactttgctccttcagtgaagagaaaaggaaatctaatggtccatgatagtaaaaatgcacatgcaattggtaatttaaaaaaatcctccttaaaagaaagataaagtagaattatcgagcatttattgagaggtgcaaaatttaaggcgcaagaaaatatttaaaaaattaatctaacataacttaaccattatgatgtgatttatatgcaaagatacctaaaggattcaccatccacatataatggaatattatgcagccaataaaagttattattaataatattaaaaaagttaataatatgatattaagtaataaatgccaaatcatgttgttgtctggaagagaatcgtcaaattgtcaacagtagtttttgctgataatattactggtgatttttatttttgtcatctatttattcatttgttggatattctgcaatgggaattacttttataatcaggcataacaataaaaatattattcaaagtacctactgtagtctccaacagttcaattccaagtagtccatttaaaggactcttgttaagttgccaataatcactgctttgataaatcaaatggatacttgctcttatttcctggctctgtgaagcatctgacttttttcaatgttccatgctaaaattctctgctcccttggcttggtagttctaatttaaccatgcatcagctgtcacctggaagactgcaatggctggctgtctttactacaagccattctgtcaattaccaccagggcaatcctgaccacattactccattgcttttgcctcttcaaagacttatcttacagaacatagagggtgagttgctctggatgctttctgtttttttttgtttgtttttgttttttttcttttttttaaattttattattattatactttaagttttagggtacatgtgcacaatgtgcaggatagttacatatgtatacatgtgccatgctggtgtgctgcacccattaactcgtcatttagcattaggtatatctcctaaagctatccctctcccctcccccaagctttctgtttattagtgacccaatgaaaagaaaaggacaactttgggtccagggattgtaaattgtgtcctcaaatctctatttcttgcttctgttctctcttaggtagttgtatctcataagcaaaagagcttcctctcagtgacagggatgagagggcagggccacagataattccaggcttatatcatcctacctagcaaccccaaagccaagggagatatcctctctcccattctctgtgtatgaaatccaaaggaaagtctctggttgactaacagtaccacacctaattgctaaggccaagaatgtgggcctgggtcataggtccaatctgaacggagagatattgtactatgattggtagcctgatcagaactacagcacttggaaggtccaagggtaagtgcttcaaagaaaatcagggataattaataacagaaaagagtaaggaatattggaaagatgaaaaaccaaatatcctttataaaaagtaatattcaatctccttagcccaacactcttagaatttcttggattggcctctgctcatgtttcttgcctcatctttcgccattccctcccaagaactccagtttctaactatgccaaacacttggatcttttctgaataggcagtgctaggcagaatagtggcccccaaagatgttcatgccttaatcctaggaacgtataaacatgttaacttgcaagacaaaagatacactgcagatgtgattaagattaaggactttgaaatggaaagatcatcctggtttacctaggtgggcccaatctaatcacatgagtcctcaaaagcagagaatctcttccagattcagataaccagaaatatggcaatgtgaaaagaactccatccaccattgctggctttaaaaatggaggaagaggctacaaatcaagaaatgtgggtggcctttagaagctggaaaatgcaaggaaatggattttttttgaaagcctacagaaagtaatgcaatcctgttggtattttgattttagctcaatcagacttttgtctcactttggatctattacagaactgaaagataataaatttttatcgtttaagcttccaagtctatggtaatttgtcacagcaataagaagaattatacaggccattctatgtcatgctttcttgattttgtactttctggtcatttcatgtaaaatatctatcttccacatctatcttccacactgatgcaccccgctcaatcccagcccacttggtgaactccctacccttattcaaactataactcaggtttcactccttctctaaagccttccttagcatcactcctaggaatatgtgactcctaggaatacttttttcttatggccacacagcactctgcattcttccgctatagtatttaaagtgctgtatgaaatttgtctcagactgtaaatttatattaggccagggactatatcctattcctcaatgtatatcacaggtaaagcatgttgagcacatagtacattttaataactgcttgtgtatgcatgaaaaatcattgcactggttactcactttgagatttatataggaatgagaaagagttgaaaactgaaaaaggtccagcatattttaaaaagagaacatgaatatagcactagggatttaacttctactgccacaaaaatgttggaaatcaacgagtagtaggtcaattgtcaaataacttgaggatagcaggtacatttttattatgagcaaatcttgtctaaattagttgtctaaactcttccttctacatcagtaactgaactgataaatttgggagtaagaaattggttgtaatcaatctttcttgatgtgacaaggctttagattgaattctaaagatcaatgaacttggaaaatgtggtctcttctctaatggcattaattaataacatctaatattatcacctagaatctggccaatacatttacatagaatcagcctgcaagagggtcctcaaatgattcttggcttctcatattcactcccttatgtagtccctcccaatactgaataggtctaacctgtgtgaccaatgggattttgaaaaagtaacaatgtatgatttctgaagatagatcttaaatgaattgctggttccaccttacttttttgaattgctcctacttctaggggatgatagataccatgttgtgaggacactcgagcggtcctgtggaggggcccattagagaaaaactaaggtcttccagcaaaagctagtactaaattgccagctgtttaagtgagccactttcaaagcagattccccagccccagacaaactttcagatgactgcatccctggccaattttttgactacaacctcataagagaccttgaacaataattacttagctgatccactctcaaattcctgacctgcagaaactgtgagaaataaataaaagtctattactgtcttaagtcatgcagttttagataactagttttagataacatgcagcaatagataactagtattctgcctatagaataaaatagacaaaagtcactataaactatttcctgtgttgttagccgtggttttttaaaaacaattattatcctttcactttcagccctagtcttccaaaccaataaacaagagtcttagaaggaagataacttcaaggcacatctgctccttttagattttatactaaaaacaaaataaagagccagtcttattactctactgccaattctcggtaataagtgacatttcctcctcccttgtgtctgtatttttttctactattgaggcacctgaaattggatgatgagatttccaatgtgcccttagaaaatgagaaagacatgacacactgtaactctcctccttataaggctcaggaaagaaatatacctttttgggcctctctattttcctgacagaaaaagagagagagatagaaggtagaaaagctatctgccatccttcagctatgatattcctgaggctcatcatatttttcttattttagagagtctgtagagggacacgtactcagtgtgttatatttgctcctttatgtgtgaccatcacagagcaaatgtcttgatgtcatctcatcaaaagcatcagagatgcttggagcagggagaagaaagggggtaggaagaagagagtgatgaaaaagggcaaaggaagaacaggagagggccaattgtgtagaaacagcaaacagcctgacttgttcaggcacaggccagaactgctcctaggctgttgagttaacacagatacactctggttaatgctcttaagaagatgaattaagtgaaacatttcagttctaacaaaagtggttcctgcaaaaaggagagatggggcacaactagaagaaaaatacttgcattctagtttagttcagtctcttcagagaaggtaacatattacagtggaactacatcataaggtaaatttcaaatcagataaaatatttatgattttgagaaaacatttcacatgaatctataaatacctagcctaaggtttactgctaccatcgtttacaggttaattagcgcattttgcagccttgccataaatctgcttccatttagatagaatggctagatggttgtctttagcatcctgaaatttaatagtagaactatgtagcagattctagtctttctaagcaggaatgacaaaatagtttcaaattattatttttttgtcatcatatgactggtaacatgtcattggcacttaaattttatgagtgtctatttattaggctacagaaataattttgttctccattgctctatgtataggtggggaagctagtgacctcttcaggggtggtttcagaagttaagggggtgtagccaaaacctggtgttatctccttagcttgtctaaattcaggaaagtcactggagaataaaaaagaaccaattttactataagacaatgaagattctaggcagttcttagaaataggtaagaaatctaagctccacaagggcagaagtctttgctctttttctttcctatgcactcaacaagaatttcttgactgtatgaaggagccagggaatgctcagaagaatctgtgactcatcaaaaggtaagaggcactgctgaataaggaaatagagtggagactgcctctctatggagtgccatttgagaagacatctgaaagaaagtggagacacaggctacctggaggaagcatgtagcaggcagtgggaacagcaggttaatggccctggtgtggcagtgagcttgacatgttcaaagggcaataaggagggctttgacatgcaacagagtaagggaagagagagtggcaggaaataagcaagagaggcaggtgagggcctgatcacgcatggtgtaggaggtcatcataagaatgtaggattttattctgaatcatagtaaggtgtcattgattaaagaatgtggtcaggccagcagaataagtattaatagtccatgacagtgacagactgtctttgaaaaacattatttcctgagtggaaaaaaaaaaccctagaaactgaagatacagtcaagtatcctatgagtactgaataaatactcttaactcactggtaggtggatgtgtttgaaaatgattactaaggaacatactgtgttattattcaagctatcatgatgggtatagatttagttttttaaagaaagcttcttatttctggaacagttgaataaatttattataatttccagagacccagtccttaagcatggagttattttagtgtaatgccaacacgctcctgtcttggtttaggtgagctttcaggtgtgcaggcaatttgcatgataaattttgcatgtatacatctcctctctcctttgctgcaaaggaagccaagtagtaaacagtctttcttagtaaatgttttgctgaaagaaaacacacatttacaagtcaaatcatgtgaaatctttgataaggaaaggatgatagcaaggtttattttacagtttatgctgaaaattttactgggaagaaataactaggctggttatttccagttacacaataagcagttactttttaagagctactgtgtaaaataaacactgctaagtggttgtaatatttgacttcattcattcattcattcattcatttatattaactaacatctattatatatgtaccatgtaccagggcactatgctaggagccaaaaataaaagaaaaattttaattacagctacaaataatccacagtctagaagaactcaacagagtacattggcttcttctaattccaaataaaaatagggtcagcatatgtcttcacactatgacaattggcaatagactgttaagcttcggctttctctttctatttcctcttctgcctttctgctgtgactttgtaatcaataggactattagcttaactggatacatcagctaataatccaacaggacaaatgcataattcttagaatcagtttagatggttgcccgcagcccccttctactcatcctctgaaaatgctgtagagttcactccagtgacctaccatccataaaccctctgtggctgttcagatgtttacacacattggctacttcacagaaagtcctatctctctgttaaaagagaaagtatatgtggctgaaatgatggttagttctcatttcagtacttggacgtcaagcagttagtttactgttgcttttgtaacttggaggcattccattctatactgaacacttctttggataaagttctcatctttctaacacattgttagattaaaatagtaatggaaaagtaataatctctccagcctacagacagctcttatgccactacatgtctatagtattgatataacatttttataacatttctgtttcagttatctattgctgtataacaatcaacctaaaacaacaaacactttatttccttgtgatattacaatttgggctaggctcagccaagtgcttcttctgttagtcttgtctgaggttactggtgtggttgtataccaccagtcatgccacttggggacactaggacatctgtatttgtctttattcctgtagtctcaggcttctccctctccaagtgtcctacatcctctccacactctctttctgcaagttggatgagcctcagacttctcaagagttccaagacttgttaaagcttagccccagaattaaaatacattacttctaccactttctattggtgaaagcaagtgaaagagccagcctagattcaaggtgaggaaaccacacaggaatgtgaatacttacaggcatggttcagtggaggtctctaatgtaacaactacacctaccttgactcaaataatctgtaaacctgcattagatctttagattgataaagagtttcaggagggtagggtgagctccttaccaaggggccatgatcagagtcctacctcttttgcgttgcatggttccaacaacacttcatttctagaagtcatcttacctttactcatcctgggccctttgtctgggacagcttttctactttctgacatctattgaagtctttcttctcaaaacttcaagctcaggctttatctcctgccagaagcctttcctgatgctttcaggttctgttaagacctgcttctttctttttttttttttttgagacggagtctcactctgttgcccaggctggagtgcagtggtgtgatcttggctcactgcaagctccgccctccgggtgcacgccattctcctgtctcagcctcccaagtagctgggactacaggtgcccgccaccaagcccgacaaatttttttgtacttttagtagagatggggtttcactgtgttagccaggatggtcttgatctcctgacctcgtgatccacccgcctcagcctcccaaagtgctgggattacaggcgtgagccactgcacccggccaagacctgcttctgagattctaaaatatatcctgtgtttatctctttcacggaacttattatattgtagtaaaatgtctgggcatttgtttatgagtttgtttcaccagctagactgtttacaatctgaagtcaggcctgagtcttattaatgtgattttgtcattctgtaagtgcccagtaataacatgttaaaagggaactggaacaggagaagtgtatgttgtataatctgatgtcaccccaaatccagcataattcaatgcatatattagtggcttaataaatattggacggttggttgaatacataaatctatttctgttagtcactacataagagatataaactcttattttggtaacctggtaaattttcagcaagcttcataaacatttcaattcctagctaggaaagaagcaatatgccttgggcacaacttttcaagtaatatcaatgtttagcagcatcaacctttcaggcaggtgtaaatagctaaaaataaaaattcatatccttctgaaatgctggctaaatttctgaaggaatgtattcatgctctgaaacacaaaaccgttctcttgcttctataaaacagaacaaaacctgtgggaaaccaaattactttgctaagtgtgacaaatccaaactgctacagagcaagagataacataaattaatgggtcttggaggcaaacaccaggagttattttgaggtgagtgaaatccgatctccatcctaaaaccacactgtgtttccatggatcaagtttttagttttatgctttttagaaaactatttatgcacaataattacagccacctgaatgccctaaataaacgtagcccagtaaatgcaggcgtgtgcttgaatggtgccctattgctttcaagtactttgtagtgggctgcatgtctgttttgacgattcccccctaaaacctaaaggcagagatgctggaagggtttgcattaccaggtgacacagtgcttgactttgataagccgttgctaaggcaaagaaactcctaaagccttattgagggtagcccgtggaagtctgtcacactgtcttatattatttttctttggatacaagccatttttctaatttaacccttgattttcttgagggcagtaaagttgtcttaggttcttttcacacagagagtgtttagaaatgtttgtggttgaaatgagtacccttctggattatgtttaccccaaaggagatgcattattttattttaatcagtgttaaagataatgtataggaggccattggataccactgagctcttgtaccaggccccccccaaaaagaaaaacaaaccaaaatggagtcactcatgctaaagttccacatcaccaagcaaaatctaagttgtttttctgaccttccaagaaaccaagagagtgcgagatgatggccaaatctctaaacaagccagttttagctggcaggattagaaattcccctttactttatcctttacaaggaaagtaacatttaaacaatcagtctgctttttgttttctatttttgctttcctcagcccttttctgtgtataaaccaatgtcctcttgctcacctcatcataatggtcattttattttagagaatgaggtactgcctgtccagaactgcaaataaaagcttattaagatctttatactaaatttttttgttgttgttgaaacttaatcttttgacaattctggcaaccaacaaagggacccaaatgacactgctgatgaatcccaagacctcttggggaacgcaggagagatgttactgagcccttttcaggtcccctgtcttcctcacggagccccagtctgttcctttcaggttggactccggtctttttgcactgaatctctggagcttatcagctttcatttgggggttactttgtgctgtaagagagcatttgaccttgaggtgccaagggttagtctgtgctctgagaaggtgcttgacctttgggtttgtgctggctgatgagttactggcaggagctgcagttttaaaggtgactgacaacagttgcagtaagtggttattactgcagggagtcagaactccagcttccaaaattcgtagagatttggtttctatcttcttaattgctttgtcttgagcacttagttgaggcatgcctcaggtgtctgacagggtcaggcagaaactggaaaattattggctaagttggtcaaaggcatctcagtgccaaagccacaatttgatcagtgggcatgatttgggcacttgagagctattagagcaacccaccaccaaaagataagactaccatgaaaggataagctgcatgtaaaatagggtagcacctatcagcctctagaaaatgtccgttcaacaaggtacgctgtgaaagcattatataacccaatgtggcacttccctcttaggctttgatttagactctgagagactcaacattcaatataaagatagttcctaatttataaaaaaactgagcactccacctttcagccacacttgccttttacactttattaggccccggaagcttcaaatacttacaaaaatggccaaatcttactaaagatactttagaatgacaatggccattatatagcatgtttcagatgaacaacactgcatttaagatgtgcatatatcaatgagggttctcaaattaggccaaacccagatgtgcagaagtttctaaaaagatttcaaaaaaaaaatttaatgggctcttttcaaagattgttttacagaaatcaagtgaaaagtttaatgattaattgataagaaaaattaaatctactatccttttcatttagttactcttccaccccgaaggtaaaaagaaagctaaagtgtttctaaaggttaggatctcaggtcaagcaggtttgcttcttttttagagctatccataccgagtccaggcacagagaatgttttctttgccccattctctaatgggctccactctggagtcagtaatgtagttaagaaacaagctaaatggaaaatatagcctattgaactagatcagtctctgaagtacacccttctggcatttagctggctatttggaaactttttgtaaaaaatttacatctataaagaaaaatcactagaaattcttaaagtgagagagagtactggtctaaacaagcctgacctttgatgagtttgtcttaactgggcttcccacctacatctttctttgtctagggtgaatggactcttagaagaatgatggttacgacaaggtctgtctggatttgtagatttcctctcctgtgacaaatgttaatcttccctggttgctggatctgtctttaggcaaataaggaagaatattcagaaaaccctgtcttgcattgtgctattctttaagtgccttcagttcaaagtaatcaatataccaaagtgacatattttggggtgcgattttctgaactactttaatggctatgtagtttaagaagcaattcgagcatgaatgttaagaatgagtaaatttacataaatgtaaatggtataaaagtttatagctgaacttgtcatagtttaaaaagtctttttcagtaactttaactcttaaagtcatgttaaattaatagatatttatgaaatatcagtcattcttaacaaaactaaagtattaaaatattaattgctgaacataagcttaaaatgtatacactttgatatcttgtttttatatcatatagaagagctcaacatatttaagtctgttagtaaacatgaaaaaattgttatatgaggaagcacatgtttctagaaagtataaaatttgtattcctaaaatgtttttgacagacagctcaaaattgcttacttcttaagattccactggaagttaaacttactaagggttaaaaattccaattaatatatgaaagctaaaactagaaataataaaggaagtaactccaaatatgagaaaaataagtaatatttttgctaaataaaactatgaggtatgaaagatgtgtttttgttaaggaagaaagagagtaatttttctcctaagtagaatgactagtttttccaaagtagaaaaagtattgaaaacacaactgaatgaataagaaatttgtagacagtttgttgaagatgaatcttgtgaaaggaactctataagggtgatcaagctggctaaaatgagaaaaaatgttatccatatgtttttctaagaattgagtattaatatcaaaagtatactgatataaaactagaatttgatctcctgtgttaaaaccacaaggttttctggaattattgatctgttcttaataggaaatagtaaaaagtttttctttatttttttaggtaacttgcctagaaagcaaagagtctgtactttatcaagatgattctgtgtgctttgtattgtctttattaggtctttgatgactgagaaaactgaatcctctctattaaagagctaagagtttttcctacaactaggtaacttactgtatttgcctttagagtcttttaattattactctggttaaactaatgactataacttcacagtgatctgtgatcctattttgatcaaatgttttaaaccatttgacattttttataaactttccaaaataaactaaattaagtcttcttgaccttgaattaactttgggaaaacctcaaaggacgtgtctctcaccttttaaaagagagatattaaactagttaggcttatttcatatgttaaattatatggggagtgttccaacaattgtatgtaatccctagaaatatatcagtcctaattctggttattgtgctaaaatgttgtatgctacgggacattgaatatataagtttctgataatgttaaggtcataccattggactgggtgagaagttccagaactctggtgaagaaactggaggcttcatgaaactgccaaccaagatcaagcagagcgagatttacttatgtaagactgaaaaactgatgaagaagagttatggttttttatggctttttaatttgaaacattacttgttattttaatgttttattttacagatttaagaaaagcttttttttaaacctatctatagctttcagcaatgtggtaaagtatacttttgtgaacaaaagttaaaacatttactttttcctctctatttgatctttccagaattcagaaactatttgtgaggattcttgtttttatggcaatatggttatttgcataaattcaataagaattactctctttataacatgatacaattggaaatactggttgcattactaaagcattgactgggatgtcatacctgagaatgcacatagaatgactctgtaggtactgtgggtaaagtctgaagtctgccttggtttggtttcctatcttccagaggttttcaaaagtccaatttgagattccttattaaaggttccagcaaaacaaaactcggaaagagcccaagtggtcactactttttctgcatttatgtaaataatcaggccaagttggatgagattaaacttattttgccaacaaattagtctcactccattttttgtaacaatgagggtgactctagagagaaaaattgctttagaagaaaaactgtagtaccactgttactagattgtagcctctttaactattttttgagtttttactatctgcctgtggactggactggatcctgaatttgtctagtttcctccaatatctggctctgaaaacaagacctgctctctttcttaagccctgtaagatgaagctagacaactcaatataaatttcaagaaacaagtctcatgcttgatgtgtgggccatacagagagttcaccaaaatgcccaatattgtaaccagagacattcaaactataaacaaggatgagaacttgatgatttcatgttgtggacagtgacagagcaggagcatcaccatcttggataagcactgtcattttaaagttcaccttgatcaaaaactgcctaaatccaaaggacatcagcctaatggctaaggtcagcctgatcacaaaccacaaataacatctctgaccaaaaacattccaaaccccttcccggcaagagacatgccagccctcatataacctcccctctggccagagagatgttagccccaagataacctcccctctgaccagagacattccaaccctgccataaacttctcccctacacagaaacattccaagcctgtgataaagctctctcaccctaaaactaataaatactcttagtccctaagagagaatgctcctgaccaaaattggccagaagcccctctcaggtttagtctccaaaataaacctttgactgttgagctacttttcgtgtttctttcctctttctttaactcttatatttggtgccaaatctgtaagagagaatgttcctgaccaaaatcagccagaagcccctctccaaaatatttattctccaaaataaaccctgtctttgacagttgagccacttgtcatgtttctttcctctttctttaactcttacagacagcttgtgcccagatgccaaaacaagactctgtatcataatgaaactcttagccctcttaatttttttcttatttatgcctaccattttttgctcagcaggatagacttgtagtaattttataatcagtagcttcttcaagtaacttacaaaattaaatcagattggtcatgtcaaacccagatctttacaaaacctaagggatcctttagtccacccagtgggtaactttggcaatatccctaatgcaattgctgttcaaattgtactagtgttcccttttatagggtaaaacttctagactcacatgtttttactccctgccttgctgacacttcttattgcacatgtataaatatagaaagtattgtagagactccattgcaaaaagttagcaaattggctacttggttaaaatgggtagattccttttctggctcattctttgttctattcaattttagttggtttggttcattaagaccctggctaaggtgcatactccaaactcttggcattcctaatatccttggcattatcgccaaaattcagaaactatttgtgaggataatagcagtctccctggtatactgcattccctcaaaagttttaaatgtttgcatgcagccatctctcaaacttcaaatggtctctattcagctattcagtcggtgtataacactaatcacggtttttgccattaaaagcaatggcaaaaaccacaattattttgcaccaacctaatagaatggcaaaaactcaaagaaatgcatgattatgaggacactataagctatgaatggcatgttgacttcagaaacccagaatggtggtaacttagggctaatgcccctgggggagcatgaccaaaagggggaaattgttaaagaaaatgtataggaagccattggctagcactgagctcctgaactaggcccaacagacccaattaaaatggagtcagtcatgctaaggtgccacatcaccaagccgaaagtaagttgtttatctgaccttccaagaaaccaggagagtgagagataatggccaaatccccaaacaagccagttttagctggcaggattaggaagtcccctctgctttaacctttagaaggaaagtaactttaaaacaaccagtctgctttttgtcatctatttctgctttcctcaactcttttctgtctataaacccatctcctcttgcttagctcatgggaacactgattctactttataaaatgtagtattacctcatcctagcattgcaaacaaaagtcaaatacaatttttaaactgaatttgttataattttgtcttttgacaccaggaaggacccgctccagttctgcctactacttgatcattctcctctttggattaaagctgtgtgaaacacaagaatgatgttgaacacatgacatcaagtggagggcaagccatgctaatttttgtggactggcccattgaagtggtattgagctagaattatagcctgtggccagaggagacctggagctcctttgccttgttattcttcttttcctgggggattagcaacccaagcagacagtttctttccttccaggaaaaccccaaacctcttggtgaagtgacaagaaatattcaccccagcgcacatcttcctaagaaggcccaaggcagaatgctagctctctcagtagttcccaggcaattcaatctgccacaaagtacaatgtagagcactgtgctacagggaaaaacaagcaaacagaaaaggaaaaaagtccattctgcatactgattttgtctaatgtggcatttgcacacttgggcggctacagtacttccgtgctgctgccagattaattcttcccaaacactgctcagatggtatcactcctttggccccaaaccttcactagggttatcgcctaaaaaaggtagcctgggagttaaaagtttgccatggtttggctcaaacttatatttccatgtgtcagtcctattatttcaaattccaaccaacaatcttctataatttttttcgtacttttccatgcctttacacgtgtagagattttttttttttcacttgtaagtcaaaagcctagctaggcatcaaattccaacagctgactttccccctatgcaaacatactctgaccttgccagctgacagaagtatttccctcccctgaactctgctaacactgctttgtcacagcattgcattttctttcttgtctggtccatgtttgttcaatctgctggacctataccagtgcctactgtattatgggtactcaataaatgttcattgaatgaatattaatttttacttattgtggtctttgcattgatggtttctttgtaagccaaatataacatttatactaacttatcatttttgagggtcaaagacaatttccaggtttcaagaaatgagggctctggggtctcttcaacacttgcaggcctagagctggacttgtataccttgagacttccctgctataggcagatgtcattgaataatattagtgtgctctatttacagagtgcctacgcttgtgctaaatcacttcacattcatatccctagttctcctagtgacatactgatgatgcctatctcatttttagaggaaacaaacaatgttcaaagatgaaggtcctttcccagagttgaatgtaaagtgagtaccagcgtcaggattcacacctaggtcagtctggctccaaatctagcttttttcctaccatcccacattccttctttgaattgcttcacagtttctatggaagtttctgctatttctctgtctttgtctctgaggttcatttccactcctgcagcttcacaaaagcccaattacacctgccagtgacctgctttgtctaacaggatttttgatggctatagcgtcatttcagcatccgcacggcctgcttctctctacccagagcacagctcccaggaggtgctggaagcctggcagcgggtcatttcagcagcttgtttttaccacttttcagcacaaactgctttatttcaaacattgctcatcactcacctgcctgcattcccccttcatcttcccttaagtctgtctcataggcctgtaagtagaaattgtggcaactcccgaagtctagcagcactggggaagagtagaaaccttactgtcagacttgctaattgaaaatttggggagaagtccactcagacgtgtctaaagcagattacctttgaagtacttacaaagaaaggttttctgagccttgaggtccataatggggatgtgtatatggagagcgggaaaggagctctttatactcagagagctgaactatttgcaagtgccaaggccttcccttgagtatggttaatgaatcaaatagaaatattatttcaccagttctaacatgcccatttatttttcatcttaacattctgtaatgggaatgtggcttacatagacagtggtagaaccattatttgccaaatagcagtcatcatagttgtttctgccttcacctgagtatcaaatacaccagcaataacatttgcagaataagcaggagcaggggtaggctagctctatgtaattacaaagctcacctaatttagtttttcataggattttagggaatgcttcacatcaaagctgttggtggcacagaggacaatactgtgtggaaaaacttgggcctcaatgaccgagcgaaaattgagtctactcagaagattcagatttggacccagaagaagttttagaaaaatttgaaccaatttacattacttatttttttatgtgtgcccaagaatggcataagattcaaaaaaaaaaatctgtctaaataatatgttagcactctttcactatatatgatataaaaattctagcttatgtaatagttaaattgatgttttcctctgatgtagtttaaaaaaagtttaagcgtacatgggaaataacttatacttttacatcagattggcttgggtttaaatttaggtttcatttcttattagccttgtgatatggtttggctgtgtccccacccaaatctcatttgaattgtagctcccataatccccatgtgtcatgggagggacccagtaggaggtaattgaatcatgggggcagtttttcccgtgctgttctcatggtagttaataaatctcacgagatctgatggttttataaggggcagttcccctgcacatgctttcttgcctgccatcacgtaagacatgcctttgcttctcctttgccttctgccatgattgtgaggcctcctgtggcgtgtggaactgtgagtccatgaaacctcttttgctttataaattacccagtctcatagcagtatgaaaatgggctaataagagtaaactggtaccagtagagtggggtactgctattaagacacctaaaaatgtggaagacactttggagctgggtaacaggcagaggttggaacactttggagggctcagaaaagacaggaagatgtggtaaagtttagagcttcctagagacttgttgaatggttttgaccaaaaagtccaggctgaggtggtctcagatggagatgaagaacttattaggaactggagcaaaggtgagccttgctatgctttagcaaagagactagtggcattttgcccctgtcctagagatctacggaactttgaatttgagagaaaggattagggtacctggtggaagaaatttctaagcagcaaagcattcaagaggtgactttggagctcttaaaagcattcagttttattcattcacaaagatatggtttggaattggaacttacgtttaaaagggaagcaggctattgcttcagagggtgcaatccccaagcctttgtggcttacatgtggtgttgggcctgcaggtgcacagaagtcaagaattgagttttgggaacctccttctaaatttcagaggatttacggaaatacttggatgtccaggcagaggtgtgctgccggggcaaagccctcatggggaacttctgctagggcagtctggaagggaaatgtggggtcagatcccccacacagagtccctactggggcactgacaagtggagctgtgagaagagggccaccctcctccagacctcagagaggtagagccactgacagcttgtaccgtgtgtctggaaaacccacagacattcaacaccagcctgtgaaagcagctgggagcggcactgtatcctgcaaagtcatagggctggagctgcccaaggccatgggagcccacctcttgtatcagtgtgccctagatatgagacatgcagtcaaaggagatcatttttgaactttaaggtttaatgaccgccctattggattttggacttgcatggggcctgtagcccccttgttttggccaatttctccaatttggaacaggtgtatttacccaatgcctgtaccctcattatacctaggaagtaactaacttgctttgattttatgggctcatgggcagaagagacttggcttgtctcagatgagactttggactgtggacttttgagttaatgctaaaatgagttaagactttggggaactgttgggaaggcaaaatggttatgaaatgtgaggacaagagatttggaaggggccaggggtggaatgaaatggtttggctgtgtcctcatcttgaattgtagctcccataatccccatgtgtcaagggagggccctggagggaggtaattgaatcatgagggcaggattttcccatgctgttctcatgatagtgaataagtctcacgagatctgatggttttataaagggcagtttccctgcacatgctctcttgcctgccaccatgtaagatgtgcctttgcacttcgtttgccttctgtcatgattgtgaggcctccccagctatgtggaactgtgagtccattaaacctctttttctttataaattacccacataattcttcatagcagtatgaaatactcaggtatttcttcatagcagtatgaaaatggagtcatacaccctgggaccctgggcatattacaaggtcttaatgagagaataacatttgtagcatgtggctaataattgctatcctgcaagctttattaaatcatttcttttatttgttaaaacgttataaacatttagttttactttagtttttactagaaagttgtaaatacacatttctttttttaaaaaaatctataattttcttttctagttgattttgaagcttcagtatataaagtagcatgtattttacacatgagctttgctgtcacttaactgagtaggaaaaaaccaacagtacaggaagtttgatggagtccaaaatcttagtagagatctgtgggtttccccttaaatattggtgaaaatataggatctgacaaggccctgtcttgtctcttttaagaaggcatagtttgatacaacatcatgccttccaggatttcataactgaattttcatactagaatttttgataggcatatggctgtccagccaaagactacatctcttagcttcctttgcagcttggcgtggccgtgtgactaagttctgatcaatggtatgtgaggaggaatgagctacgcaactttgggtcatgccctgaaaatgaagatgcagtcctcatcccctgtctattgtctgaaatatggatggatggacatagctgaagacattttattgggtcaaagatggaagctgtgtgttaaaggtggcagaagagcaggacaaaaataacatgggccctgatgattttggagccaacatatcaccttggaccaatgactcagacttcaatgtgagagataagcaaatttttatcttgtttaagccactattattttgggcctctctgttacagcactaaaaaatgtacgttaacctctccattttcatgtttctgtccctttcattcactcctccccctgaacaacacgacttaaagtcactcatgtgtgccaatctcataaaaaggcttcttctgagttcctattctgagaacctgctaaatttccttgaaatctagttgccttgaagttgctagtcctcctccctggtgaatggtgtcttgccctaaagctaagccccaatacccatggaaatgttttctcaaaatctggttcctgttcattctgactgcctggatgttccattatgtttcctacctcctcttaagatcctcagcttccttaagttggacccaatactaattataaccttatattggcttttcctttccttgcctatgtgatcttttttgttcatcacattccaccagcaaagtccagaggcagcattttgaatagacctggtcccttttctcaatctctttcagtttttttttggccccagaaaatataactgatcccttgtctccatctctttggcctttgagctgaaataactagaagaagcttgccaaagcatactaatatatgtaagttgttgagtgactactgtgtaagtgtcccattttagggattacctccaatccttataacaaatctaaaaagaggttgtattattccccttatacagatgaagaaactgaggctcagagtgaataagtgtcttgtccaagatgcctcatctagtaagtaatgaatcttcaattaaaacccaatctataatcttttcactatataggctatcttctaagcccaatgttaagacaagggcacagagattagggctcatgaaaaagaagacattctctttgtgagaatgtcctaccatgggtacacagattccaaggatgtgaggggactatctagcaccatactctagaggccatattaacaccaggatgctaatatgaaagtttcaaagcttcttggatgaaaagatgctctccttctaacttctgctttttgaatttaaaaaaagtcatttttctcaccttttctctcctaggattcttctgtttccctgaccttgattgacatttctccctaagtcctctgaattattatggaattaaatggcttattttaatttccctaggtgtctttattgaattctttcacagtgttttatggaaaatatctgattacgaattcatagaacagaacattatgagattctttgctaagtggctgccacagtagtattcaggtcctgaagcctctgcaatctctgtttctgtatacaggctcagaaacaaggaggcaagctaagttccagcatcttgcagttgactcttttatatcacctcctgaacaattcctaaacagaaaatactgtccccaaccccctggaaagattcatgaaatattagaaagcaaatcattttaacacagaagttaagatcttgggttctggaatcaaactgggtttgaatctcactgcttctgtttaaatgaccttgggtaagtttcttaatctcactttccctccatttcatggtctgtaaagtgggagtaacacctacctcacagagtattcatgaggattacatgaactaatagtgccaagctcataataagtgccaacctaaaagttaactaactatatcttttataattaagaagtaggagagtcttgttaaacctagtacaaaataccatagcatgtgaaagattctatgagtacctgcacctcctaaccattttctgacctatatacgtattatacataaacatgaaatcatatgaaaccatgctatttagcagaattcctctaattcagcttgattgacacaaataatccacaatgtggaggtgtcctgagagatcagatgattccttcagagaagagggtgaattctcattagagatctggtagttccagtctagatgagtcaccaatgaatagatttgctatgggttaatgttccgcccagcttgactaaattttaggcaggtttcttcctgactattggctcctaacctcccttttcttagagcatttactttacaaaacttgcaattataaattaggtctctggccctttgacatgtaaatcttctcccagtctctcactgattttacatcctaaaaatgccctttccaaggacctagaaaccatccttttgaaatatgattatcaaaaaagataatgtccttatcttctcatctctgtggaaggataggaggctgatttgataagcaccgacaaagaaacaagattttccttcaaagtaaggaagtatgaagaagtggccttgtagggagtgacagacatggctcagattcaagcagatcatttagtcattatagagaagttaaatattcctctcttacaggttagctgggctttaaaatcacaagaaaaaagtcaaaggttacaggcttttgtgaaaaagtacacaaaaagatgcctttcacaatgacagtcaactcaactctccaagcaatgcctagtttctagaaacttccagatgaagaccagccatttcagtctctgaagtcccaggggtgtgctgggatcttccacccactcagaaagcctctttctaagaattcagtctttgagcatagctgttagctagaaagaaaattccagttgatgtatgaatctatagaaccagtcattctcatgccctctagggataaactaggcatctccaaaccctgaaggaacagagtggtggtgagtggtgttcaaatattttaaaagtattggagtaccaacaaggacatactggttaggagaatatgagctcccaaaatggatattagacacattattattactttttgagatggaatcttgctctgtcgcccaggttggagtgcagtggcacgatcttggctcaccacaacctccacctcccaggttcaatcgattctcctgcctcagcctccagagtagctgagattaaaggtgcatgccaccacacccagctaatttttgtattttgagtagagacagggtttcatcatgttggccaggctggtcttgaactcctgacctcataatccacctgccttggcctcccaaagtgctgggattacaggtgtaagccaccatgcctggcctagacacattataaaggtaaataattataaccatgtgatgttgacacatgagtaaatatgaataaattcagatacctaaagggaatgcagtagaaattaagtaaaaaacaaaatataatttggcatcaagcatacaataaaagtagcatttcttttttttttttttttttttgagatggagtcttgctctgttgcccaggctggagtccagtggcgtcggctcactgcaaactccgcctcccaggttcacaccattctcctgcctcagcctcccaagcagctgggactacaggcacccaccaccacccccggctaatttttttgtatttttagtagagacggggtttcaccatgttagccaggatggtctggatctcctgaccttgtgatccgcctgccttggcctcccaaagtgctgggattacaggtgtgagccactgcgcccggcctaaaagcagcatttctaatcagtgaggatgacaaggactattaattcattcaataatacaggaacaattaaatagtcatctagtaaaaataaagtttgattcatacctcattccttatacaacagtaaattacatagatcaaatatagaaaaacccaaaccataaaagtactagaagaaattataataagattcttatataatctggaagtgagggaggcctttttaataataatacaacattttgaaaccattcatttaaaaaaggcttgattaaataaactacaaagtaattttaaaaatttgcatggtggccgggtgcggtggctcacgcctttaatcccagcaccttgggaggctgaggtgggcagatcacgaggtcaggagatcgagaccatcctggctaacatggtaaaaccctgtctctactaaaaatacaaaaaaattggccaggcatggtggcgggcacctgtagtcccagctactcgggaggctgaggcaggagaatggcgtgaacccgggaggtggagcttgcagtgagccaagatcatgctactgcactccagtctgggtgacagaggaagactccatctcaaaataaaataaaataaaataaaatttgcatggtaaaaatcagtgtaagttaagttgcaagtaaatgaaaaactgaggaaagataattacaacttgtatccattcatggggctatatggctaataagaaagagctcctttgcccttcacatcaatagaaatagaccaacagcagctcccagaatgggccaaggcattttgaacaggcagttcagagaaaaggaaatacaaatggaacttaaacatatgaaaaaaagctcaattttattcataatacaagaaacagcacaaagatactacttttcacctaccaaatatgtaagttccaaaaatttgataatatgctatattggtcaggacataacaaacttttccttatattgctgctgatggtataaatcattgtaactgctaaggagggcaatttggcaatacttatcaaaagtacaaacatccctgaaccagcaatttaacttttgggaatgtatccatcacacatatgccttcatatgtgatgtataaataaggttattcattgcagcattgtttataataagaaaatatataaaccattgttattgatagggagatagttaaataaattaaggtatattaataggattattattattttttaaaattttgcaggcacataaaacattcacacaactaaataccagaaagtgctctatgttctactgtggaaatatctctattaaattaaattaatgggttaaaaaaacaagataaagaacagaatgtagagtatgctaccattttttatatagcttaaaaatgagagataaagagaggaaaaatatatttttatatttgcttgtacctcggttaaatatccctggaaggatatacctgacactgtgtggttgcctattgggaagagaaatgggtatctgaggtaataggtattatagggagatttgcttcactaaacattgtataaacttttatactttcttacattaaaactctcttggccaggagtggtggctcatgcctgtaatgccagcaccttgggaagccaaggcaggtggatctccttgagttcaaaagttcaagaccagcctggataatacggcaaaaccccatctctaccaaaaatacaaaaaattagctgggtgtggtggcccatgcctgtgatcccagttacttgggaggctgagataggaggatcctttgagctggggaggtggaggttgcagtgagccatgattgtgccactgcactccagccagcatgacagagcgagaccctgtctcaaaaacaaacaaacaaacaaacaaaactctcttatatgacatctcatactttgaaatgttcaatttaatcattttccaaatctggaatatggctcatttttattgagatatgaattgttgttgatctcatgcttgatcttcccaaacagaacagaggctctatatctttctctgagaaactttggtgatatttttagcactgaaagtgggtaagaacacttctaacactggaaattcaaagtctgcagcacttactcttgggacttggaaaaattcttttttaaattaataattgttcatcaatggttccattttctttgcctacaagcatgtttcttccttcaaagtggacatgggtgtgtgcatatactcatctgtacacacatacatacacatgtatatgtgtaaggtattgaaagtaaaatgttttcttttaaagtatgtttgcatttttcctagaattggcctcacagtttccatcagacactcaaagcagtgggtgacataggaaaggttaaatattactaaatagtggacattacaattcctagttattcttttcccctttcctacagctaccatttaaatctaggttggcaacttcccttgggtctaaatcagcagtccccagtctttttggcatcagggaccggtgttatggaagacaatttttccatgggcagggcccagggtggaggatagttttgggatgattcaagcacattacattttttgtgcactttatttctattattattacattgtaacatataatgaaataattatacaactcactacaacgtagaatcagtgggagccctgaacttgttttcctgcaactagatggtcccatctgggggtaatgggagacagtgacagatcatcaggcattagattctcataaggagcacacagtctatgcagttcacaaaaaggttcgcactcctatgagaatctaatgctgctgctgatgtgacaggatgcagatctccggtggtaatgctcgctcacctgctgctcacttcctgctatgcagccaggtttctaacaggccatgggctggttggtactggtctgtggtctgggggttggaaatctttggtctagatgaccttgacagcagtatagctggcctgtctgccttcaggctttccacactccacattatatgcccaaccagccagctgttagtaatcattttaaaaataatttactgcctactttatcaaactagctgtgaagcgtttgactgtacgttgaactatagccaagtgtgctgtatttctgcactcatgagtgagcacttcgttgtcatacttcattgtcctggaatttctctgttcctgtttttattagtggggaaaactctgctgtattaattttgttcacagaataaacaaatttttctttaatatataaaaataaactagaaaacatgttttactggtcacttttcaggaagaaatgcctgtatatattttttaaatttttttttttaggaactttccatagggtgaatgatccatgtttgaatataaagtaatgattttattcagtgcttataaactgtattcaattgcatggagaaaaaagaatacactgacctctaatttaaaagtaaagagctttctggagaggtaacagaataataactaatggagctttacagtttataagtgctttcatataaatgacctcatttgtccccaccaaaatctcatgacaaattgtaatccccagtgttggaggtagggtcgactgggaggtgactggatcatggggggtggtccttcatgaatggtatagcaccatctcctggtgctgttcttacgatagtgagtgagttctctcgtgagatctggttgtttaaaagtatgcagcacctcccccttctctctctcttggtcctggtcctgccatgtaagatgcctatgcttctgctttgccttccgtcatgagtaaaaactccctgaagcctccccagaagcagatgccgctatacttcctataaagcctggagaatcatgagccaattaaacctattttctgaaaaaattacgcagtctcaggtatttctttatagcagtgagagaacagactaatacatcatcactgttattttaaagaataaggaaatgaagactcagaaggatgaagcaatgaccaacccaggtcatacagtaggtaagcgaaaaaccagggcctttaacttaaactttctgacactgtatctcataatctttctcatatggtgagtggctctcccaacattactgttacataaaaatttaggtcatgcgtgtaattttatcaagtatccctcaattcctgggacttaagtaattgatacacagaacaggttaaatagagagccttttctgaaagggtaaggaaaaacaacattgatgtttcagaaccaatgtgtgtttatatcatggaaaaagctagaaatcccagtagaaaagtctttacagaagcactacttatcactgtatacctggctatatataaatcataggtagcatactccccctttccctgaattctaatgaaagcattgttccaaatctattacagctatatagtttttataaaatgacccatggggaaaattctttctagagtttaaaagctggaaaagagtttctttctctacacgccttgataatattgttatcaatataatattatataatattataatgacagttctatagcccacttttgtcttgattatcaagaagctcagagtcaagttgtagtcttagttgtagtcatttttcttaatttgggttttctaaaatgtgattgttaatactgaatgtcaatttgattggactgaaggatgcaaagtattgtttctgggtgtctccgtgagggtgttgccaaaggagagtaacatttgagtcagtggactgggagaggcagatcaccctcaatctgggtgggcacgatctaatcagctgccagcgtggctacaaaaaagcaggcagaataaagtggaatgggcagacttgctgagtcttccggccttcatctgtctcctgtgctgaatgcttcctgccctgaaacaacagactccaggttcttcagctttggactcttggagttacaccagtgatttgctaggggctcttgggccttcggccacagactgaaggctgcactgtcggcttccgtacttctgagattttgggacttggactggcttcctcgcttctcagcttgcagacagcatattgtgggacttcaccttgtgatcatgtgagtcaatattccttaataaactccccatccatcctattagttctgtccctctagagaaccctaatacatggattattttctttgttctcctttttacatttttccttttatactatctagttcataccttttactaccgtttcaatggatttttattttactgtaattatatctttttttataagcctcctcaaatctgttttgaagataggcagagtataaacatacagagtccattctaaggaacatgagcatttagtccattgaaagaactaacaatagtataccaggtgcaaatgatctatttaatctcttgagtagcttccagagaagaaatttctgctgtaagtgcacagggtaatagagtcctgttttctttcttttattcttataataaaagtttgacatcactatcacaaccatttcatgtgtcagtaacagtagatgataggtatttggtattatacaacatttgcttgtgttaaaatgagccctggtatttcacgtatgttttatgattgtgcacatttggtgtgatccaaagagataatagtggaattttctatggaaattcttgtttgatacagaattatatcagaagttgacacaagaatcaatgtgtatattgtctagggtatatatcttacatatataattatatcacatctacagttctgattatcataggaatataatacacatgtcacacggacaaacgtattcattttcctaattgatggctacagcagagaaaaccagtgagtatcatctttgagagataaaaccgtggaaatgtcctttgtggtatgattaatactaaaagggaaagggtaattgggtgagaagttagaaggtgaaccaaaggaagactaagaactttttgtaccgtcaataaaacaaatccagacttagacacggtgagacgtaaaaaaactacatcaacctggagaatgttcctcccttaggattttcaagccactcaaaaatcaatcaaaaaggtttttcttttatagggacggctaaacagaactagcagaaacttagaggtaaaattgagtgacagggcggagctaagcagacatcatgatggggatgatataacaggaaatgttgctgtgatcagctaatttggaatgaactgttaaggtagggtgatatagctagtgtttttgttccctagtgtattgttcagtttcacattgaattgtaatcctcagtgttggaggtggggcctggtgggaggttactggatcatgggagtggatttctcatgaatggtttaccatcatccccttggtgctattctcatgacagtgagtgagttctcacaaaatctagttgcttaaaagtgtttggtacctcccccctctctcgcttgctcctacatttgctatacaaagtgcctgctcccgctttgacaccctctaccatgattgtaagctttctgaggcttccctagaacgcgagcagatgccaggaacatgcttcctgtaaagcctgcagaaccgtgagccaattaaacctcttttctttataaatcactcagtctcaggtatttctttatagtaaggcaagaacagcctaacacagtgggatgtttacattttagtgtttgctcagatttggggcaagccaaaagtcaggagcctgtggggaggagagatgtctgattaaatcttgatcaagccaagtcagtgggcaagaaatgggcaattgtgagcatctggccgggatctgcaacctcatgaaaagtatataccatcaaaaggctaactacttgtttgtcacataaattcttataaaaagcttagtggagccaagaagcaagctaagtataataagagaaactcttcttaccatttgtatcactaatgagcacataattgcagctagtcatgtaagtctcctacaaatcagcgtaaggttaattaagagagttgagacacttaggtgaaagtcacttttgcttatagtaaagaacttatctatcttacagacacatatcacttacattatgtatttgttatattaatatatttaatatatttaaaaaacattgtaaaatgatgatctggcaatatccctagaagaacctcattgaaatacttgagatttattggtcatttgtctttacaaaattgagatttgaaaagctttaaaggaggacattctaccaaagcataactcataaaacagaagataaaagtatgagccatggaattatagagctggaaaagatctagccctactgtttcattttcaaatgaggaaattgagggttattctaaggggttgtttttttaagtcatacagtaagttggtgcagacggaggagtagcaatcagatctctgagctcttttcctctttgacaatgaagttcacgaatgcaattttgtttcataagttatttactttactaaagtaaagtaaggtacagctatgatttattgttaaatgagaagaatgagtgtcagagaactgtatatggcatgatttcatgttcttaaaatacaaacaatatttgtcaatctatctatctatctatattgatttatttatcttctatctgtatgtgattgaatgaaattggagaaatgagtggaagcatatacaccacactaacattgaacatttacaagaagggtaaaaaaaggagtaagaaaaaaggaagcaaaatagaatttggtaaaatggtatgtgaaagtgaagattgcaaaacttttatccataaaattattaatacataaaaattgaatgtgcacatagacgaagactagaaagtcactaggatatacatacaacaagaacataaacaaaagaacatattattttgaccaggggtttattaaaaataaaaataaaaacaagtccaatgactcccttttctgaaaccactgaaacacaactattttgactcaaaactgataaaaagatgtaatcatatattcacaaacagtattcacttaggaaattttaccttattttcagcattgatacctataaagttttgtgcttcacctatgaatgtatatatatgtacatatacgtccatataaatattttatttgcttaccattatatttgtttactaaatttggatatacttctttattaaataatttagacaatgaaaataaaattaatgtatactcactgttaaaagcttagaaaatttagaaaaagagagagcagaaaataaaaaccactgataatcttactcagagatatccactgttagactttttgcatatgtcctttcagattttttttgcatgtatgtgtattcaaaaatgggctaatatcttactttattatctgctgctttcatttagtaacaaattatggctatatttctgtggtaatatatatagatacaatgtcattttaaattaggtgtttaacattttatcatcaggaattagtgtaatttcttttttaaattttctattaatggtcatttgatttgattctattttttaaacaaccataaacaatgctgaaatgaatatctttatatgtgcattttttgctcctgttcaattgcttccttaggatatattcctatatgtgatatttaattataaaatatttaatttcctaactccctggaagtttacacttcagtatcaaaaacactagtggatgacaattcctttgctattagaacagaagaccatagaatcaaccaataacagatacaaagtttttctcatgggtaagtgccctacactggtcacttaattcttcattatattttgggcaaataaatttgtatctaaaaaccatctttatgatgatctatgacttataaaaatctactatttatcttacaaattacttccaattacttttacttcttcttctgttgccggtatgaggtcactaatggtagattttagaaaatgcgctaacaattatatgtaaaccatacaattagtattttttaagtgtctacaaagaagacatttgcaagtggtttctagctttattgtgaatgtgcaaggggtatattctatcaagtaagcatcattcctatcctcaagacacttatatatactggaaatatgaaatcattatccatagtttggaaaaatttttcttttaagaaaataatagatggaaaagaaaagagaagtccaaggaaaaaaaaagtcatctgttaagatctgctatgtaccaggaatatagttaactacttccttattaattacagcctcccaataatattgaagtagatattatttattatagctgttttccatatgaagaagtgaaattcagactgatgaaatgatttgcacaaggtgacactgccaataattgatatagtgagattcaaacctaggtgacatacttttgacccaacaaaataagttttcaacaacttgagtgtctcagtgatagaatatattatctctggaagcagtgagcttatcatcatgggaagtatgttagcagatgttagttgatgttggttgatcatatatcagagacatgaaaaatattctactactaatgggcgatttcacttgctcatctccctaggccccttctggagggttagatattttgttgaattgaaaactgtaccatttttaaaccattgatacgtcataagcaaatattagaccacagaataatactcaactattttacacttaagggaaaccaaatatcacaatgaatattatctctaattttagaatactagagaatctcagcggtatttgaaagatcaaaatttatattatgcatgttatttttgcttttaaacactagttagaatgtatggtgctaaatacattttagcgtctgtggtgctaagaacacaatcgtttgattaaacaagatctcttgataaagattagttagcacatgctagcctaacaattactgaaattcacatttttacatgggtatcctattattaagtgattccttagatttaatctatctgaaaaaagtcagtaaaatgttatataaaataataataaaaataaatcctctcttgatttagataaaatagcatgcttgtgtgctaatgtattctactacctaccttccccagttgcttctattaaaaatagtactgtaaaaagaaataaaaatcaaaaatataatatgcctgttgcaaagcgtttcagagaagcttttatgtgaaatttaacagttcatggaacaaagaatatgactggaggcaaggaaaatttctcctctgaaaataagtgaaacctaggtcgtcattagagtttgtgcattcacttttgggacataggatatgttcagggctatgactcatttacatacatgactatgtggcctgtgttttgggagggctgtggggtgttagctgaagccttccatgctggtagttatgctttgctaagagaaggctggttctctacttacaccccctcagatggctctctttagtgcatgtctgtatgatttgacctaacagaaagaagaaatggactagcttctgttattctatgtcagcagcatattttattgaaaggagtatggacttcaggaaaagaaaaatcagggtttgaagcagctgagaagtcaacaagctacttattcttctgagctcttcttcatctataaaatgggcataataatacttcactgagtgagttgttttgagaattgaatacaaaaaatgttgacagtagtaaactgcacatcatctgatacacagttaagaatggagtacattttagcatccttttttttagttctgtaataaggagattgtaaatacatttaaaaaaaaatgtttccctagagtttggtgggtgatattgccacttaggaggatagctatcagctgcactggtgacaaagtacctcctgatgcagacccagagctacataagcaaacatgaggggcttggaagcaacccagacatcaagcaggagcagtttccagggctgtgaagatgtttgctctcctctacttagaaagaggctcttttaggagaaagggacatatttaggagaaagagctctgcctgttcttgcagacccagggaaagaggagcttggatcaggaagccagagagcatttactctgccttagtgagttcctaaggtcctagaaactctctatgggtgggtctctgctgcggtgagggactctgaactgtgacctgcccctcagatcccaggaagaagagaagcaaaagcttagaaagcaaggctgtaggataagtgttagccactgatttcagagctatgtattttccagcaaattgtctaagaactatgctttatctatccaatatagacaatgtactctataataaaattccttaggaattaattttaatagctttcatttataattaaaatctagatggcatttatatattgacaaatgaatacaatttaaccttaagtataagaagaaaatgccagccttaaaaatacattttaactacttaactatttttatacgaatgcacttgagattaatctaatatagtccatatatcttgcagtcagttcaatgtaacaagattattaaaactggtttagaaataggagggtgtttatgagattatctgtcacccttgtattgtgaagcctgagcgcttgattactctgcatgtttgctcttgtgtaatgacaagcacgtcccgtggagccaattactgcctccactttacttaagtgatcctccatcccatcaagaagatattcaacctgattcttagaaaagtgtgagtatttgaagtagttccagtgaaggtggtaaatttcctaacttgaaagcactttcttatgattgcaatgacaatggttaaagaaataaaacttcagaaaagattccacatgaaagcaacttagaatatgagtaattataccttaactacaatcctcagtgatcaaaagataagcaaggtttcccaagcatctttctgtggagcatgcactctaatgagaaagagaagccatgcatactctgataaaaaggcaagaaaattatatttatgaattaccagctatgtttcaggctataaagttgagaattcccaacctgaaaatctgaaatccgaaatgctcccaaatctaattttttgaacacctacatgacaccacaagtagaaaattttgactgtattttgacaagccacagtcaaaatacagtcaaaattttgttttgtgcacaaaattattaaaaatattgtataaaattacattcatgctttgtatagaaggtgtatataaataacaaatgaatttcatgtttagatttgggtcccaactacaagatgtttcattatatatatgcaaacattccaaatccaaaaataattgaaatctgaaacacttccggtcacaagcatttcagataagggatacctaaactgtagtagtacagtgtataatttaatcttgctacagtcttatagggtggttattaaaaatctgagtttctaggtgaggaagttgacatcagggaggtcagaaattgcaaaactgggacttgagaccaggtccatctaacttcaaaacctgttatctgaaaggattctaaaaatgcaaacctgagagtgcatgatgatgtagaatatattatcacatcacatatccagctttgctgaagaacagggtgttctgcacaatatgaggcattgaatataattgaatcctacaccaatactgatttgtttggcatttgagtctgatttcaagtgggaaaacagaagtgttgtttgtaaaacttatgaattaataagttctgagaatcaaaaggactgacctcaaacaaattcaggaaattatatttactcttatttctgtcttagtcctggacagttgacgttgctagataagtttcaaactactacacaattgctgagaaaattggggtggtaggaaaaagaggaaactgatttctattagtaaaactagttgatgacccatagagactgctcaaactttgagtgggttcatatttataggaataaagatgagagacctccaaatcttttcctgatccaataaatattttgtttataaaatatctgacattagaaatgtgtaggggtggggacaacaaaaaaaatgctgagacaaaataggcaagagaatccaaatgtaatgttgacctttgatccttcatctccattgcttaagattttattctcccaattgtcttaagaggtcttaagcaacaaacataagtgttcaaaaaactacagagctctgttagagctaggcatagcacttgacttagtatcctcccaaagcaaaattttgcagatagacaacacatactacataaaacggtgtttcctcttgctcattttaaatttacctcccattaatttcattgcctgtcccttcccaattgtcaagcaaaagcagtatgatcagatttcatcaaaataacttagaccacttaaatcaatgtgtattagacttttcttctttctgtgccagggtactctggaattttatgctctcttttagtaactgctcttctctggtaccaattgactggtgcatttatcatgacctgtattccaactgacacaccacaacaattcctgggaatacagtgaatttaacattaagattgtaagatcagctgacattctaagattcttacagacagggcttacgtgtatttattttggtatgaccacagcagcaaacacaatgtctgcatcacaataggacaaggtgagagctaaaatttaatatgtatctgcatatgttagacttttatgtatatgccatcgtgcatctctacactcatcctctattagtattctcatttctgtcaatggggaaactgagtaagtcacctaagatcaagcagctggtaaataacagagccaagatttgaattcatgtctgtctgactttttttttttttaccatgtgatttaccaaccacactcagtacccaaaatattacttgtggaatgccattttcacagggttgtttatcacacctctaattaaacctacccttgagagggaaaaaactgcaactcagcaaaactgtaattcacaactagcctaatggccaagtggaatggtacatgccatggtcaatcacttagcacgtaagtagtgtgtgatgaagaggtaaaaattgaggcacacacagagccagcctctgttaataacaatgattctttggggactgagtctccactttcattttaactaccactgtagaaaaatgataaataaagtcagtaggtaggatggcaatatgataggtagaaagagaagaaaaaataatttgtgtatttgtttaccactaaaatgcccttaagaggcagctttgtccaagtggcacttttaacatttatttttacttttaataatcatgtgtattatatttttatggctcaatggcactatatgtttgaagaattttagaacattaatatccaatgttacctaagtctagctgtggacttcatgcatgaaacaccattccagcacagaagcactcctagcttgaatatcctcagtattgaggaacttactatcacacggggcagccactctatctttgaataaagatagaatgagtaaagttgataagaaaagaaattcttaccttcacatcaatcaaagatctgtattcttacaatatccctgaaattattctgtaagcaggcctgaaagaattacgtggcaacatatgttgctaggctggttcgttgggttttggcaaagtcctcagtgtttgtcagcatttctatgtgagagaactggctacatagtctatcttggagctaatatcatacttgggtcactaaacatatgtatgaaattttgagaattgtttcttaatttttcagttttaaaatctaatgcaaacctgtatttcagaaaaaaagtattgcttgacctttttaaaaattatcacttaattaacatggggcccagccgagttagaataacttctcacttgttccaacataagagaaacaagcaaggtactcctaccagggtgtcacttagacctgcatattctttttagtgattgcaatgttacttcttagccacccaggccaatccaccataaaacaatcattctccaactttcctggtcttaagagtcacttggattgcttgtttaaaaggcatatttgttgagctctgcctccagaaatactgatttagtagcatggagccgaggaatcttcatttttcaccagcgctggaagtgattctgatgcaagtgatttgtagaccacattttgagaaaaattccctaatgttagcagttgtaatgatgcaggtagttcattcagttttgcttcagtacaaaactgcaaggataatactattgggttttctagatataggatcatgccatctgcaaacagggatagtttgacttcctctcttcctatttggatgctgtttttcacactgctgtaaagatactacctgagactgggttatttataaagaaaagaggtttaactgactcgcagtttcgcatggctgaggaggcctcaggaaacttacaatcatggtggaaggcaaaggggaagcaaggcacatcttacatggcagcaggagagagacacagtaaagggggaattgccacactctaagaccatcaggtctcgtgagaactcacccactatcatgaaaacagcatgctgggaaccaaccccatgatccaatcacctcccactaggtccctcccttgacatatcaggattacaattcaagatgagatttgggtgggaacacagccaaaccatagcagatgccctttctttctttctcttgcctgactgcactggccagaacttctgatactatgttgaataggaataaggagggcatgcttgtcttgtgctgattttcaaggagaatgcttccagctttgaccattaaaaagaatgagattatatcctttgcagggacatggatggagctggagaccattatccttagcaaactaacacaggaacagaaaaccaaattctgcatgttctcacttataagtgggagctaaatgacgagaacacatggacacacagaggggaacaacacacgctgatatcttttggaggatggagggtgggaggagggagagagtcaggaaaaataatgggtactaggcttaatacctgggtgatgaaataatctggacaacaaacctccatgatacaagtttacctatgcagcaaacatacttgtatccctgaacataaaataaaagttaaaaaagaagaaaattgcaaggatggtaagatttggggctctttcataacttttcaaatatgtcaactgagaatatcaaaatgaatcaccagccttttttgtttggggtgtgttcctgtgtgtttgtcacaaaattcacatacttttcaactgtgcctgccttacactaaaatagtcattatacccagctgtataggcccagctatatacatatatatgtatatatatgtgtgtgtatgtgtttgtgtgtgtctgggggctccacacacatttggtgtcaatactgaagtaatgcaaatatctctgtattggctacaaaactcaaacaagaaaaatgaatagatttggatctgatatggccttccactttggctctgaactttagttgtaaggaagaaaataatacttagtaagagtaatatataaaatagtgattgtaaaaccaactatttgtgaaatagtctgccaagtattatgggatacataaagatgattaacacacagttcttgcaaaattggagcccacaacttagcagaagttgttaatcactttggtcaggtgaatgtttcactgaataagaaatattagtgtattaagtcatcagattctttaatgctttgaagtgcttcatactgagctctacataaaatagaaacttcgtgtgtgtgcatgtgtgtctatatatatacatatttgaagacagggtctcactatcttgccaaggctggtctcaaacacctaggctctagcaatcctttggcctcagcctcccgagtacctgggactacaggcacatgcctagcacatagaaaaacttcactggtgtccaaggtggctgaataggaagagctctggtctgcagttcccagtgagatcgatgcagaagatgggtgatttctgcatttccaactgaggtacctggttcatctcattgagactggttggacagtgggtgcagcccacagagggcgagctgaagcagggcggggtgttgcctcacccaggaagtgcaaggggttgggggatttccccttcctagccaagggaaactgtgacagactgtacctggagaaatggtacactcctgatcaaatactgcacttttcccacagtcttagcaactggcagaccaggagataccttcccttgcctggcttggtgggtcccacacccacggatccttgctcactgctagtgcagcagtctgagatcaacatgcaatgctgcagcttgacggggggaggggcatccgtcactgttgaggcttgagtagctcacagtgtgaacaaagcagccgggaagctccaaatgggtggagcccactgcagcttagcaaggcctactgcctctctagattccacctctgggggaagggcatagcagaacaaaaggcagcagacagtttctgcagatttaaatgtccctgtctgacagctcggaagaaagcagtggttctctcagcacagcgtttgagctccaagaacagacagactgcctcctcaagcaggtccctgacccctgtgtagcctgactgggagacatctcccagtaggggccaacagacacctcaaagaggtgggtgctcctctgggacaaagcttccagaggaaggatcaggcagcaatatttgctgttctgcagcctctactagtgatacccaggcaaacagggtctggagtgggcctccagcaaactccagcagacctgcagctgaggggcttgactgttagaaggaaaactaataaacagaaaggaatagcatctacagcaacgaaaaggacatccacaccaaaaccccatctgtataggtcaccaacatcaaagaccaaaggtagataaaaccaaaaaaatgggagaaaccactgcagaaaagctgaaaattccaaaaaccagaatgcctcttctcctccaaaggattgcagctcctcgccagcaagtgaacaaaactagacagagaatgagtttgatgagttgacagaagtagccttcagaaggttggaataacaaactcctctgagctaaaggatcatattctaacccatctcaaggaagctaaaaaccctgaaaaaaggttagacaaatggctaactagaataaacggtgtaaagaagactttaaatgacctgatggaactgaaaaccaaagcacaagaacctcatgatgcatgcacaagcatcaatagctgatttgatcaagtggaagaaaggataacagtgatggaagatcaaataaatgaaataaagcaagaagacaagattagagaaaaaagagtgaaaagaaatgaacaaagcctccaagaaatatgggactatgtgaaaagaccaaatatacatttgattggtgtaccagaaagtgacagggagaatgaaccaagttagaaaacactcttcaggatattatctaggagaacttcccgaatctagcaaggcaggccaacattcaaattcaggaaatacagagaacaccacaaagatactcctcaagaagagcaaccccaagacacataatcatcagattcaacaaggttgaaatgaaggaaaaaatgttaagggcagccagagagaaaggttgggttacccacaaagggaagcccattagactaacagtggatctcttggcagaaacattacaagcaagaagagagtgggggccgatattcaacattcttaaagaaaagaattttcaacccagaatctcatatccagccaaattatgcttcataaatgaaggagaaataaaatcctttacagacaagcaaatgctgagagattttgtcaccaccaggcctaccttacaagagctcctgaagaaagcactaaacatggaaaggaacaaccggtaccagccactgcaaaaacatgccaaattgtaaagaccatcaacgctatgaggaaactgtggaattaacaggcaaaataaccagctaacataatgatagggtcaaattcaaagataacaatattaaccttaaatgtaaataggctaaatgtccctattaaaagacacagactggaaaattggataaagagccaagacccatcagtgtgctgtattcaggagacacatctcacatgcagagacacacataggctcaaaataaagggatggaggaagatctaccaagcaaatggaaaacaaaaaaaagcacggattgcaatcctagtctctgataaaacagattttaaaccaacaagatcaaaagagacaaagaaggccactatataatggtaaacggatcaattcaacaagaagagctaactatcctaaatatataggcacccaatacaggagtaaccagaatcataaagcaagtccttagagaccgacaaagagacatagactcccatacaataataatgatagactttaacaccccactgccaatattagacagatcaataagagagaaagttaacaaggatatccaggacttgaactcagctctggaccaagcggacataatagacatctacagaactgcataccccaaatcttctcagcaccacatcccacttattctaaaattgaccacatagttagaagtaaaacactcctcagcaaatgtaaaagagcagaaatcataacaaaccgtctctaaaaccacagtgcaatcaaattagaactcaggattaagaaattcactcaaaactgctcaactacgtggaaactgaacaacctgctcctgagtgactactgggtaaataacaaaatgaaggcagaaataaagatgttctttgaaaccaatgagaacaaagacacattgtaccagaatctctgggatacatttaaagcagcgtgtagagggaaacttatagcactaaatgcccacaagagaaagcaggaaagatctaaaattgacacgctaacatcacaattaaaagaactagagaaacaagagcaaacaaattcaaaagctagcagaagacaagaaataattaagatcagagcagaattgaaggagatagagacacaaaaaatccttcacaaaatcaatgaatccaggagctggttttttgaaaagatcaacaaaattgatataccactagcaagactaataaagaagaaaagagagaagaatcaaacagatgcaataaaaaatgataaaggggatatcaccaccaatcccacagaaatacaaactaccatcagagaatactataaacacctctacgcaaatgaagtagaaaatctagaagaaatgggtaaattcctggacacatacaccttcccaagactaaaccaggaagaagttgaatctctgaatagaccaataacaggttctgaaattgaggcaataataaatagcctaccaactaaaaaaagtccaggacaagacaaattcacagccgagttctaccagaggtacaaagaggaactggtaccattccttctgaaacttttccaatcaatagaaaaagagggaatcctccctaactcattttatgaggccagcatcatcttgataccaaagcctggcagagacacaacaacaaaagagaattttatgccaatatccctgatgaacattgatgtgaaaatcctcagtaaaatactagcaaactgaatccagcagcacatcaagaagcttatccaccacgatcagattggcttcatccctgggaggccaggttggttcaacatacacaaatcaataaatgtaatccatcacataaacagaaccaacaacaaaaaggacatgattatctcagtagatgcagaaaaggcctttgacaaaattcaacagcccttcatgctaaaaactctcaataaactaggtattgatggaatgtatctcaaaataataagagctatttatgacaaacccacagccaatatcatactgaacgggcaaaaactggaagcattccctttgaaaaccggcgaaagacagggatgccctctctcaccactcctattcaaaatagtgttggaagttctggccagagcaatcaggcaagagaatgacataaatcaattagaaaaagaggaagtcaaattgtctctgtttgcagatgatatgattgtatatttagaaaacccaatcattttagcccaaaatctccttaagctgataagcaacttcagcaaaatctcaggatacaaaatcaatctgcaaaaatcacaagcattcctatacaccaataatagacaaacagaaagtcaaaacatgagtgaactcccattcacaattactacaaagagaataaaatacctaggaatccaatttacaagggatgtgaaggacctctttaaccagaactacaaaccactgctcaatgaaataaaagaggacacaaacaaatggaagaacattccatgctcatggataagaagaatcaatatcgtgaaaatggccacaccacccaaggtaatttatagattcaatgctatccccatcaagttgccactgactttcttcacagaattggaaaaactactttacaattcatatggaaccaaaaaagagcctgtggagccaagacaatcctaagcaaaaagaacaaaccaggaggcatcatgctatctgacttcaaattattctacaaggctacagtaaacaaaacagcatgattctggtaccaaaacagatatatagaccaatggaacagaacagaggcctcagatataacaacacacatctacaaccatctgatcttcaacaaacctgacaaaaacaagcaatggggaaaggattccctatttaataaatggtgctgggaaaactggctagccatatgtagaaagctgaaactggatcccttcctcacaccatatacaaaaattaactcaagatggcttaatgactttaatgtaagacctaacaccataaaaatcctagaagaaaacctaggcaataccattcaggacataggcatgggcaaagacttcatgactaaaacaccaaaagcaatggcaacaaaagccagaatagacaaatgggatctaattaaactaaagagattccacacagcaaaagaaaaggcaacctacagaatgcgagaaaatttttgcaatctacccatctgacaaagggttaatatccaaaatctacaaagaacttaaacaaatttacaagagaaaaacaaataatcccatcaaaaagtgggcaaaggttatgaacagacacttctcaaaagaagacatctatctagccaacagacacatgaaaaaatgctcatcctcactggtcatcagagaaatgcaaatcaaaaccacagtgagataccatctcaagccagttagaatggcgatcattaaaaagtcaggaaacaacagatgctggagaggacgtggagaaataggaatgcttttacactgtttgtgggagcataaattagttcaaccattgtggaagacagtgtggcgattcctcaaggatctagaactagaaataccatttgacccagccatcccattactgggtatatacctaaaggatcataaatcatgttactatgaagacacatgcacacgtatgtttattgtggcactattcacaatagcaaagacttggaaccaacccaaatgtccaccagtgatagactggattaagaaaatgtggcacatatacaccatggaatactatgcagccattaaaaggatgagctcatgtcctttgcagggacatggatgaagcaggaaaccatcattctcagcaaactgtcacaaggacagaaaaccaaacaccacatgttctcactcataagtgaacaatgagaacacatggacacagggtggggaacatcacatgcaagggcctcttgcggggtggggagctgggggagggatagcattaggagaaatacctaatgtaaatgacgagttgatgggtgcagcaaaccaacatggcacatgtatacctatgtaacaaacctgcacattgtgcacatgtaccctagcacttaaagtataataataaaaaaaagacttacaaccaacagagagtttgaaatatatttaaattaaaagtattattaaaaaattctaaaaaaaaaaaagaaaaacttcactggcatagtaaaatagcacatgggaaaaaatcctctcaatttgctaagtcaatattcttataactgatgttgcttatatgtcattgttgttagatctgagagtggaaggaaataatttgtagttattgttataatgaaaaaaatgcaattatctaaagattcctatcattttctcactactccttaagcacatttattcattataatgtagaggaaggttgccttacttgtggtctcaccattcatctctttaagttcgttgttgattccaacatctatggaactcattattttgtcaatctgtaagaaacaaaaaccatttaaatggattgttacattcacttttaacattgtattttaaaataagtttcaaatgaagggagcaaatatttttgatgttattaccacagtgttccacagttaagagatgcatagcgaaatatttaaaggaaagcaaacatctttcggattgttttattaaaatgtaaagtatgttcccctttcttaaactttcaaaattagtttgccttttctttgtgtttcttgaaataaactttgtacttggatagattggtcatttaggaactgtgtattcttcaaactcagaaggactgtagataaattcatgtgacaaagtctctgctctctggcacccttcttcttctgcctaagaacatgcatcccatctaactggtaaaggagcaggtttcagggtgtggagagcacggccacaggagcaaagttttctgttttttgtttcgacagaatctcactgtgttgcccaggctacagtgctgtggcaccatctcagctcactgcaacctccgccgcccaggtccaaatgagtctcgtgcctcagcctcccaagtagctgggattacaggcatatgccaccacacctggctaatttttgtgtttttagtagagatgtgattttgccatgttggccaggatgtttctgaactcctggcctcaagtgatctacctgcctcggcgtcccaaagtgctaggattacaggcatgagccaccattcccggcctggagcaagttctaaccaaatggtttgaccaaccacaagctgattactgacatccaatcaccagcatctagtcatgaaaacaacttaattataagatctaagttaaatgttaattaatcctgcctctacaaaaggatctcagatgttattcactaaattaataaatataagaaatggctatacttgaaaaactaaccatctactagtatggaatttaaaggaagatatgatggtctaagctatagcaatttatggcttaatgactctcttgatgttagcaacctgaataagatagcaggtttcagaaaggacaatgggcattacttaaatgtcccagtttgttcaccctgaaacagatgcagagatattaagtgattttcccaaacagctcagttcagaatatcactatcagaccatatccatttctagttctccaaatactataatgatctattgtgcttctaaacctaatccaactggtacagtcttttcagagacaatatgtgatgtgttagaatgaaataccaagagagactgtatgaaattaaacactttaagtagaactgaaattggtgatatttgaacctcaaacatttttttctttatttccctgatagctgcaaaagggaaatatcaaatgatgtgtgtttattgtatggtggctggagaagagctaggaaactttatttactatgaagattctaaggagctcttctgaaaatataagatactttaaagaagggagacaaactaacaaagagtttggcaagtagcaaaacaacacagagcaaaatactgagctttttctcgatttgtcagctgcagtgcttggtaggacgagatgtgaatattctcttgtacctcatagctagttattacttctgcttgatatcaatttctatggaaacaatagattaacccacatgtgtggaacagtgtttgtttttatacttgctgtgaaattaccatgcattacccacagaaccatttcattccagttggagccgtatgcttttttttttcttgcttttgaaagagctaaaaagctgaaaatccttcccccaaacctccctcaactgcaaagccttataggatgaacagcaagaagaacaaagcttacttcttcccattccgatgtgaaggatggtgttctttcagaattccctttagaactgtgttcagcagtggaagattcactccagttaactcttgatgttttctcattggaaggataggcaatgagatcagaatcagatttagagacactttttgacaaatgcatgtcgatcaaggctttaggcaatgaccttattctccccagagtacaggctctctccacaaatccccctgcgttcataacccactggtccccattccgagatccactcctggttgatcttgtgccaacaatggtatggttttcgagttggttgctttttttgtgaaaaattgttctactgaccactttgggtttaattttctttaccaaaggttctgagttattttctattggagactgcttgaaaggcaaaggactgtttgccaaactgacttcatcttgtcctttttcacattgttctcttttcccatagagatgaaatggattttcaggggactcacaggctggagaggatccatggagcaggcctgcaaattgcccaggatcatattcttttgggggatcattgtcatcctgtcgggagaggtcatctgcaaaaggaaggaagggatatcagggtttataaaggttctgaaagccacgatataatagcagtgcccttatgaacatgtgggctatccaaacatttcatttactgctacatagcaataccttcactttatgaaatacccctgaccccacagtgccatgtatagaatgaatgtatgagtgtgtgtgcgtgtgtatgcatgtgtgaatcattctttctgatataccttagagttcatttcaaaagtatgaattgtgtattaattgaatgacttcattcacttctcccttgaacccagggtgtatgttttatagccaatgaacaaaattgggttttcttaaagtagaacacacacatctaaactctcacagtaaatgaatcatcgtgaagtagaacactaggcaggtaagtcaaggtcatatataatgacaaccctctgccctcctcccagcaaataaattcaaaaaccaaattttgaaaaaaggtattattaaaagtaattgaagtttaataatcctgatattaccttaaatataaatttaaaataattctatgcagattacataatttagacaaaaaaaatttgttcagacttaacaaaggcaaacaacgcagtatcagaaaaagagagactccaatataagaaactaatgtttagctatgaacacaaaggtagctttttctttcttctctgaaacggcattagctattttctaatttcttcagatctttgaagatgtaatgcagaaaagaaaccaatgatgaatgataatttttattcctttggatttttttctaagataaaacacacattttctctgagatttaaaatacaccatgctttttgcgacttaatttgtctttcaaagacatactgtgtaaaaacctggccaaagaatttagcaaagaaaggaagtgtcctttttttcagtgttcattttaattcatatcaatagctaaatattgccaagatgaaaatttaaattacctgataagcccataactcactgttgcaaagaactaaagtatagtaaatgtggtacataatgacaacaaatccaaagttgatgtgctgattcgtactttcagtaagttaattattaccataaaccccaaacactaacatttttataaattaacaagtaacatttaatgggtaagtgttatttactaggcactgaatgaggaattatatcatctcatttgacacccataacaatcctatgaagtgattattaataataattatgattttgtgatggaacgagatggccaaaatatcgaattctcacatttttaagaaattggcaaccataataaatcttattagacattggctcagaagatgctacaggcacatctgctctttatagtgaagattggccccaggtgtctatactgctctccgcctgggaactggtgaaagcaggtatattcctagctatgtatctctagacttcaccctggttcctgcttgatttttccaaagagaagatgtttgcctgcccagctatcataccagcatcctgagattgaagaaagaagagtgacaggaagagagatccaagacacatgaatctacaaatgcaacaatctgcatccatctactactattatactcactgtcttctcacaaaaacaaaacagaacgataaaacctcatcactttctaaaatagccacactgtcttgataactctctattttattttcctttcacaacagagaccattctaggggtagaatagtgagtggatagtgggataaggcagctttcaattctctccaaagactagagtttatcactgagtatgtgcatttttaagaagtcaaaactaacacttagacaacttaagacacagacatttccccacctagtaagcaattaagctgagattcaaattaaggtctatcagattctgacatccattggccttgcaaatatattgctattaaagataagctttaaaaaaatctagggttggtttatccataggacaagcaagtaggctctttgtaaagagacatgcttctcctgttcatgactgtatctggaatttgggaaaagtggactaaaagcatcagagctttttctttgttttgttttgttttcttcttggagataagctaatactaagaagaaaataagacctggcatcttgttccaatgcattttttttcttaggctacttggatctcacagagtgctttacaacataagcaggttggtatgggtgacaataatggggattaaggtggtaggaaggaggaattctgaaataaggaagttttagaatttcattttgaaagttgctgaagaaggataaaaggtctgaatttgaaaggaaaattgaaaagagcttgcctattgtgggaaaaagattctgtaaatctcagccaaaagagtttccgacgatgttcattatctagaaaaatgagaattttaggggcgtaatattatttaaagttttctgcaaatattattattaggttaccatcccctctgtagtttgactacaatgactataattaccaccccacaatgctttacactgtccaagtcctccaatcacaagcagtcacttctcaaagtaaaagataatttcattgttagcttataaagcttagttttttgaatagcagttcttagcattgtgatggtaacatttctgccaagagtggtgaaaagacaaatattacttgctttttccagtggccaaatcctaaagattattcaagtcaaagaaaaggagaagttgatatgaagcctcctggaaagcctgtgtggtggattgattgcagttatggccccagtctgctcacagctccctgcagacacagccctccccgtatctagtcctctcacgctgactccctcacagcgtggccatgtgccttgtaccgctcaatcagactgcagcaaatgtgatataagcagagacctctgaaaagcatgtgtgcattagacttgttcccttgttgctcttggaaccctgacaccatgtgaacaagccaggctggcctgctggatgatgaggtgacacattacccagctgtttcaaaatgtaggttttattatatttttcaggtatgttgaaaccaacagatcaggagacaattgccattgaaagatagacgctctactcattgatccgagaggcatgccacattataggggccacacagggaactaccagggtccatcaggaggaggctgacaaagtgaggggagattgtgggcaagagcctttactatggtttccatgaaaagaaacacacaaagcaggtataagcaggtttaggaatggctagtttgaatagtttcagcagactctggggcataagaactgtacctagttgtctggtcattagagcaggtgaatgaatagtggcctagagagtgagagccagatgaaggaggtaattgggactatgggctctacgattgttagtttgcataagaaaagcatgctctctggtgagctgtttactatctctaggaattagctagccccaggaggggccgtccctccacagcaagagctcaagagaccaaagcataaaaataaaaatacacaaataaaatagaaaataaaaagacatggttaatacatccgccagtcctgtcaccccaaccaaaagccagccaacttccacctatgtgagtgagggcatctaggacctaccaaattcaggccattctgccaataccaccgatgcatcagcaagcacagctaagaggagctgaggttttcccaggccagaagaagacacccaccaggatcatgagcaatattaatggccattaagtttgggagggtttgatatatgaaaatataaactatatcccaagttttaaagaattaatatattcttcaaaataaattctggcaatgtttatatttccacatctggaaaatgatgatagtaatagaacatacctaaaagtgctgtgaagattgaatgaaatcatagaataataaatgtgttagtccatttgggctgatataacaaaatttcataaaccaggtagcttacaaacaacagatatttatttctcacaggcctagaggctgagtagtccaagatcaagacacctgcagatttggtgtcaggagagggttaattttctggttcatagagggcaccatcttgcctgggtcctcacatggtggagggagcaaaggagctctctggagtctctcttataaggtctctgtcctcatgacttaatcacctaccaaaaggcccacctcctattaccatcactttgggggctgggatttcaacatatgaattttggtagaacacaaatatttggaccatggcaagaagtaaaacagttagaacaatatatgctgcatagaacactaagaatatgtttctactattataacaataatttttaatctatagggtttcatttttataaagaaatacagtaataactgtattagacactcaataaagattattttgacataataatcatgtgggatttactcctttgtttctgtttgtatattttaaaaagtatactttggaaagaattttttgtgttttcttaccctttcttcagacaaaacggaggaaaatatacagattaaactgttgtcataacttgtctcatttaattttacacttctcttttgataagtggatatttcatgccaaggtacagaactaaatatgtgtgaattccaatctgatagttattcaaggcatcattagcatttcaaagaaatgtcagagtaaatgtccaataggaagcagttcaatctctttttatccacctttgctatgatttttatcacctatatatcacctgattaacaataaaatccaaaatttcatgctatggaaaaattatagaaaacaagttacttttttctattatagagtataacttttgtctattgggtcattgcatctgatttagaaaataaaaatttttcctatttttaaggataccggggctgatgttgatattagtagaaactgtgaatttatttcacaaatatgtataaaacgtttcctgtatatcaggtggcaaagtttcagcagtgtcaaaggcaatgtcctgccttcatggtgcctacattccagcagaaaagatgactacaggcaaatcaagaaatgctataatttctgatgatggtatgtgctgtgaaaaaaataaagcaaagtaatgagatagaaacgaaaggaagatgctataaggcaattaggaaatgtctttctcaggagctgacattgagcagacatagaaatgactgtgaaagtgtaaatcattcaatgttttgggggaggattatttcaaggcataggaaagaagatatgaaaagtccctaaggctggtaagaacagtaagaaggccagtgtggctataatagagtggtaggggattagtagaatggctgacgattgaatcagagatgcaggtaggaatagggttggggtgatatgacttatacttttagaagataattggtatttctgaacatgacaacagcatagtgttctttttaaattattcacctcaattctcataaaaacaagacacggggatagtaaaagaataaaatgagcacatgatagcaaaataaaggaaaaacactacaggtgatatctccagtaaagctaagtattaagaagtccccatggccccgaaacacagaggggtgtagccaaatcacatgacagcagtaggatccggaactgaatcagcagtgatgcagctatagtggtgaagagaaagggaaattcaatggcacctacaagccatggaacccagaaattgccatcagatactgatttcccaaaggagagggtcttgtgctaagcaggagtgtgcagtaaaatttgagaacaactagcagaacttgtacacatcttgtaacaagaccacaggaagtagcttactcccttgagaatatcagaaatctccaataaatgcatacttgtagtaggctacagatccactctgaagaaaaacttctgggagaagaatacaaattgcacagggtgaaaacaccaaagatgtgagggagaaaaacatttcatataatggggcagtaggggccaggtgcagtggctcacacctgtaaccccaacagtttgggaggccaaggcgagaggatcacttaagcccaggagtttgagaccagcctgggcaacatagcaagacctcatctgtacaaaaagtgtttaaaagaaatttaagcatgataatgagtgcctgtgagttccagctactcaggagactgagatgggaggattgcttgagcccaggagttcaagtctgcggtgagctttgatcatgccactgcacttagtctgggcaacagagtgagaccttctctagaaaaaaaaaaaaggcagtgggggtggcatcaggcagatgtccagtagagggagactttgaatgtaatagaatagcaaagcacagtgttcagatgtgagagcaccactttggaaggcaggcgcatggaactcaagaacactgaggtagtagcaggaagccttcctgaatcaagcagagaaaaacctgtatttcttaatacttcatcgtaactgcaaaggagaaggcccttgagatgtgaagggctcatggctactgtggctcatccctgctcccatacaggaatctcttcctaatccatgacatcccttctcattaaacgtgggaaacaaaaaaggatttagatagagggcaattttaggaataaaataaataatgacagtaatggattataacccactgaataaaacagaaagacacgagcccataaataaacaaatgatttaaaagtttgactaggaatgggaatcctaaataatttcaaattgcctccccacaaaatacttattaattagaaagaggaaaaagagacacgctacagtgaagaaatctgggaggccctatcttaatcaaatgatcaaagtgaacaatatcagtaatggaacaaatcaaaatcatatccagtgtggtaaagatgcaatgagaaaaatgcagaatcacttttggattttcctgccaaagatgtacaacctaaatctaattatataggaatatcagaaatatcagagaaatccaatttgtgggccattctacaaaataattggcctgtaatcttcagaagtgtcaaggtcatgaaagtcaaagaaagtcaaatgaacccttccaggctgaagaaaactaaggagacattacaactaaatgcaacgtgtgatcctgaactagatcctttgatcataaacaatattattgggtaaaccagcacatcttgaaggaggtctgaggaatagatgctagtgatgtattaactttctgatttggttgcacggtggttctgtggttgtgtaagaatgtacttgcctgtagaacatatacactaaattagtagttatcaaagtgtagtccagggatgcttggggtctccaagattatttcagaagtttcatgaagtcaaaacaattttcagactaacactaagacattatttgcccatttcactttcattatctcatgagtgtacagtagagttgttcagaggctacatgatgtgtcttttcacagtggaaatatgtgatgcctctttctatctcagctgtaggaactggcacgctattacttcttgacagaagaaagtcatatgtctaaacctaaagtaaatggagtgaggatgtaaatggccacctatgctactgcactgcaatgtaccatggcagaagagagagtaaagaactgagaacagtaatctcatcttaaaaataatgtttgctctaagttttgggtagatgccctttattaagttaaatgtcttatcttctaaggttgctgagaattttaattgtgactagatattgagtttataaagaatgtttttctgcatctgttcagttatgtaatttttctcctttactctgttagtgtgaatgacatttgtacattctctaatgttaaacattagatattaatgggataccaacaggataaactcagtgtggtcataatgaactttctttttggcatcctgctagatttggtttgttagtactttgggatctttccatctatgttcatgaaagaaataggcctttggttttaccttttttattctgtctagtttttacatgattactcacctcacagaaatagttggggaaaatttccatttccctagaagagtttatataagattggaacgatatgtttcttgaaagcctttatatttactttacctttaaaatcatctagactcaacatattctttgtggaaagatttcaaattattcattaaatttatttagtatagaactatctggagtctctatacctttttgaagttttttaaagttttaattatctagaatttgtctaatttttctcagtattaaaattcactggtacaaaattattcattcttctttcttaactttgaatggttttttgtatctgtagatttacccccttttctttcctaataggtttatttgtgcctttttatcttgatcattttgactggaaagtgcatccatttttttagtgtcaccaatgattccatttctggctttgtgaattaatattacatatttgttttctatttcattcatttctgtcctttactattttctttctatgccttttctggatttattctattatttcttataaaatttcttaagctggcatttacctcattagtcttcagcgtttcttcttttctaatatatgcatttaaaatttctaagttccactttatgctgcattcatcacatttgatatttagcatttatatttttgtttaactttaaaggtttttaagttagtattatggcatctcctttaactcatttctcatgacttatttagaaacgtgtatttaaattcataaatatatggggatatatatgggaatcttaatttaacttaattgaattatttttagaaaatatagtgtgtatgaatatgagtctttgacatgttgaaacttgcttatagtcaagatcactttttgtgactgtttcatgagaattacatgtattctccaattgttgaatacaaagctctttgcattatgtcagattaaatttattaatggaactcttaaactcttccattgagtgaggtgtgttgaaacctaattttagcagacttatgttttttcctatgaaatatatgtatattatatctggccaacatggtgaaaccctgtctatactaaaaatacaaaaatcaactggctgtggtggtgcgtgcctataatcctagctactcgagaggttgaagcaggagaatcgcttgaaccagggagttggaggttgcagtgtgccgagttcgtgtcactgcactccagcctgggtgacggagtgaaactccatctcaaaaaaaaaaaagaaaaaaaaaagaaaaaagtctaaagttaaataataccttatccacttccttcctaaacaatttaaaaactttagagcattttacattcaattacttcttctataataaatattgttgtcagtgttttaattattttgttagctttacaaatcaggtgttattattttattcagaccatttttaaatttcaattggtttacatgtttgccattttatttactcacaattcgttcctcagaatggcctgagatcattttccttcttaaagttattctttagaatttccttttatacaggtctctggtggtcaatgctctagttttcaactgtgaatatctttctattttactctcatttatttaaaattcataattttaggttgatagttattttctctcacagtttgaagaaattattccacttttttgtggctttcatctttccttgttaattctgctataatgatacctgtctttcttgtgggtgatccatcctttctctccacctggtttgaaaatctctgtatttttcaatttcacaataatgtgtctcactatggatttctgtttatttatcctgcttggaatacagtgtgctttctggacctgtgaatccatatttttatcagtttggaaaaaaatcagccattatccatcaaaaaatgtcctctcctacattttttaaaaaaattatttcatcccggccgggtgcagtggctcatgccgtaatcccagcactttgggaggctgagacgggtggatcacgaggtcaggagatcgagaccatcctggctaacactgtgaaacccggtctctactaaaaatacaaaaaattagcctggcattgtggcgggcgcctgtagtcccagctactccggaggctgaggcaggagaatggcgtgaacccgggaggcggagcttgcagtgagccgagatggtgccactgcactccagccggggcaacacagcgagactccgtctcaaaaaaaaaaaaattatttcatcccgagtctctgattcaaagttaatcttctgattccatacttcatatctcttcataccttccaaattttctgcctctttgcccctctgtgatacattttggggaatttttttcaaatgtatccttcagttcatcaattttctcttcttctgtgcataatctgctatttagcctattcatttaggattttaaaagtaatctcaagtattaaatttttcatatctgaaaatgccatttatttttcaaattttcctactattatagtcaccattttttactcattttaatgataaggcatattatttatttaaatattttgtttatatatagtggttctatttcttgtttcctatttccagtaataatatctatagtcattgagcgctaaatatgtctgtgttatttttgttgatatctacttatagtggtttgcttttcaaggtatttagaaataatttattattaactttattacttgattttaatctatggaagcttgtcaatctcatcagggaaggttttctgcagagagaaaaccttgtgcttccctgagctgtgttgactcagccttccagccttccagctgagccagggaacagtgtcccaaatagcaacactattattcccatctgcactcagaacaacaacagccctcctctcttctatcagatgtttttagagagcaagagtgactggagcaggcaatgtctcaagaacatgtcttattcagaatatatttgttctgctgcagaaagatctctcagagtacctagactgacataatactttgaagcataatatttttatttaaaaatgtacatttgtgacaatttcacttcaaaaaaaccacagtttattaggaatcaaaagtttttaacgtgactctttaaatgatttgtaccctactacataggtagggttaataataaattgccttgctctgcatgtttttgtcttgtaatgtatgatgtaatatataatcaataaattatcctgagaattgtataaacgaagaacaagcttattttaattaattatggcctcaaataaagcaaatccttttaaaataagatccccctaaaaagtatatttataaagaacacaaaagaaactaagggaggtttggtattttgaaagaattccaagtagtctatgatcttcatttaaaaaaaaaagcatgcaaaataatcatagagtgtgttttgtacataaatcctggatcaacttgatttgactaaagatagcaaggagctaaactttaataatatatactgtcaacttgtctcaacaagcttttaaaggagtgctgggttttagaaatattagggagaaatattatccacttgttttttttttttttttttacttataatgtaaacttatgtgatgagctagtacattcatttttttccaaatattgagaaaatattttccagttcactttccaggtcaccttcacattgagatagaagtgtgagtcaaacaagtaacaatgagccacagaggaaactatgtagaactgacattcccttaattccccaatgtaaaaaaatcaattatagtttccaaacatacaagaaattaatttaagcaaactccaattttctggaaaggaatttatttcaaaaattacaaagaccaagattccatactaggtaaggggaaccaccaatagatattgtgtgccttctatgtccaaggtcattctatctcatttaatcctcacaaaagtctctgaagtaggtattatggcatttgcactgatgaagaattagatagctagtgaacagaggagcccgtatgagatataaatctggctaatgcaaagccggcttttttccgatacatcacgacgctttgtgtcggattaccctagaacctcctatggcatcagtacaatgcaccatccactggagtgtcctatccaagtagcactggagcttgaaaaccacccagtgggcctctttccaggtatcagtagtgatctttgggtatttattctgattgcacaattagcccaaagattgctggtatgtttagatgctgaatggtgttagatagagcatgtaataaaattccctcttctaagcaacttaagaccggcagctgcctttctgaaaagccacccaggtaagctctgttgtttcctggtctattagccctacactctgccaaactcagcatttactgcggaagccagagaatgctgacattctgacagctcttggacagcagaccatgctgtttgactctgatttcaaacatttataatcttttctcttgttccctttgctcaatacaggagagaggctatcagccaatttccccaccgtttatagcaaatcccaaggctccctcatttccagctgctaagctgcctgggcagactgtattactaaattattgtatctttttggtagagtgcctgatctgtcttggcatgcgctttgcattgaaagaagctcctgttgcaagcaaaggaagccagcgacattcacccttcccacacgtctttcctctgttaccctcaaccactaacttctttgtttcccatgtataagccaagttcacaggggcagtttctcagctatctctgcctccctagggagttaaggatttcaaagagagttctgtgctaggagtatttcccatagcctagagccagatgaataaatggcgtctagtgaataactacatcagaaccaagaggttttgtttctctcttaccaaaatgtatttctttgtaataccacagtcactgtaaccatgtattttcctcatcagaagagactgtattgggggaagagaggaaatagcctctttaactcaagtcggttgttttcaagagtgttggtcctttggtttaacttattttaataacttcccatttatatactatcccaatggattatgaatgtgaaaaaagaactattctgaagaaataaaacaaaaaaagatctacgatctttaaataaaaaagaaagtgattttgtaatataaaagggacagaaactatttttaattactctaaaatgaataaccactccgattcaattttcaaaagttataccttgaatttgaattcaaagtcacccaaatgtcctcagtaaaagctctgagaatgcagtgcattcaaatgtatcctgtgagttttctattcctgtaagcaatgaacagcctagatttttctcatacgtatctcaagagatacttcatttcaaaagagcaggagagttatcaaaagtgtaatactattaacaagatacaccatagaaaatatacagaaacgttaaagataaattatatctagggagtatgttttaaatcaactttgctgttgctatggtaagagatatccaatgtaaaacaaaaatcctctataaggctttggtgctatagccatggcaacaatgatgttcaactctgcgagtgtttccatctgattcagagagaagaaaaaaatatgctttaaatgtatgtaaaatggcttagaaaatcgatcatttatggttatctttcacatgacccttcaaccaattaaagaagacattgtaaagatagcagccagagagcctaaacaaaaggctcatagatttgcttgggtttttcatgatcacagaagctggaaagatccactttagctgaggtgttggtaaatgacatattcatttagcaactatctcacagaaattttcaggttggggcctcatgtaattttccatgcataggaaaaaactaaatgcaatcaaatgacaatttctacctctttaacacaggaagagaaatattaacctaaagtaagaaaatatggaaagtggtgttctagctctgcaaaagaaaagtctcttaaatgctagtctcttaaatctactccaaataggcttttattccacctacctccaccgaatagcccttaacaatatcagcaaaatctctaccttcctgaaatgaacattcataactctcatcttacttgacctaccagctatacaattgatacagattatcacctcttggatgaaacactttcattaactcccaaggtaccacactcttctggttttcatcctacctcctaggctgttccttctcattctctgctcattccttctgtttccaaatgtggaagcattcaagtgctccagggcttggcatactgggacctctttcctgtttacattttctgtttacattaattcctttgctggccccagggtttaacatattactgaaacaactgcaacacccaagtttctgttttcaacctgacttctcccccacactccagacttgtatatcctactgtcttagttatccttatgcctccttttctctcacaccccacagccaatcacacagcgaatcctggtggctctacctttaaaatataactgcaacctgcctatgcctcacttgtccttttctccctggattattgtagcagcctcctaaccatctcctagctttcatttttgcacctcacaggcaattctcaacatagaagtcagagttatcttagtaaaactaaggcaaatcatgtcactcctctgctcaaaactcttcaatggcaccttgatccactctgagtaaaagccaggatccttacaataacctgtgaggccatacgtgatctcagacctgtggatactctgccccaattctcttaaataacataagctcctactacactccttttcccttaactgacatccagctatattgcctcttgctgttactccaatgcattaggcattcttctgggtcatgacctttgtacttgttttttctgcctgggattttcttcccttaggaagtagcccctcctccaacaccttcttcaaatatctattcctaacgaaaccttacttcataattttttcaataaggcctccatggatcacaccattttaaatggcaaccactaattcttattcccttccctgctttatagtttctccacgacacctataaatataaaaaaatatatattttacttacttatgctatcttaggaggagagacatttttgtccctatcatttcattgctatatccagaaattagaacaaaggctggaacatagtggataatcaataaacattctttgactgatggggtgaaataaatatatagatatttgcatgtgaagaaaaattcaagagtgatatcaacatagctaaatgttaacagtgattaacaataagtgactttaaaataaaataaccttttattctgtttataaaataatatctgttcattctagttattagtaaaagtaaagagagaagaaagacactcataattccaacacctaacaaaagttactattaacatttttatattttttcttttgttttttatggacattattttcccccaatgaaaataagatcactctgtttatgtaattaaaaaaaatttaaatctcacctaaaaaattgagacatgtttattttatttgtctaaaaatttattgtctaaaaaattgagacatgtttatttgtatcatatcaatccttgaaatattcaaataactgatacatttgattttgtttctctctttttataaagtacatttggtcttttatagtgactaggggaatgtgtgtgtgtgtgtgagtttttgttagtcattacttttatgttaccgaaatcatcttcggacctgttttctctgttttcatcagtaaatttttgtttctctctttataagttaatagctaatattactgagtgcttataggtgttaagtacttcagatgcattatctgatttcattcccacacaatgttccctcacataataccccataatactctggggtattatggtattcccatttcgtaggtgaggagttgaatgcttagatgttaagtaaccaatcagggttacagggttactaagtagtggagaagcacatgaacaaggtacccatgctccttactgttaaatcatttgcagttctaaaatgagggaattagcagacttgttatctctgttcccctgactccccactcatgcccacgccccgttttccaatttatattaaaatagtctgggttgtaaagtgctgatactatattactgtatattttataccttctcttttcaatttcttttagatttatagtgttacaacaatattgagaacaattagttgaaaacattttatgtcttacaagctttattttacattctagaatcctttatgctactatttcccttgcccattcttgagaatttatttatcacttgatcaactgaagtatatctttgagcaattacttcaaagagataggttgttttctaaattactgatatggtttggctctgtgtccctacccaaatcttatctcgaattgtaatccccacttgattggatcatgggggtggtttcccccatgctgttctcatgacagtgagtgagttctcatgagatatgacggttttataagtgcttgacagttcctcctacacacacactcactctctcttgcctgccgccatgaaagacatgcttgcttccccttctgttatggtgattaagtttcctgaggcctccctagtcacgtgaaacgtgagtcaactaaacctcttttctttataagttacccagtcttgggtagtatctttatatcagtgtgagaatggactaatacaattacatatctgaaaatgacttactatggtcttgcacaccttggctgggcatacaattcttgaatctcaagttcaaatccattgccctaaaaattctatatacaattccccattgtcttctgtaagtaatctgttttattaccttaatatctatctagattcttatatgactttttccttatccttgaaattataaaaatttaaaattcccttctaaaattatttatttcagaaattttgctaaattcagtaaatctgtaatttattattctaggcattctttagctcataaacaaacaatgagagttttcttttattgatgctttacttcactgctacacttttcgttctaaaattcctatcatatgcatattggatctcatggatctttcccctgtgttttatcttttctcttgtaatttttatttatacatttcttctgtctattaaatgtcttaatattctactttactgacttgggtttctcatgatccagtgtattttttgccttctttacagttttgaatttgatatgaatattattcaaccacatgaagcgtttatgatcttacagttttaacccttcatgactgcttagtctggtttcatgcagcgttagtctactgaatatcattgagatccatttgacgttagcattttggaaaatgctcttttcttaagaaaaattttacgtcaaaggatgccactgttttcattcctcaaaacgagccttctcttttgaggtatcatttaatgtctccagctctttctctatttgctcactgttgcaaagggtggtcttagcttgtctcttttggggacctgggatgagttctgtcagggacttaggaaattctccttttcacctttaggattcaaaagagagaagaaaggaaaagcttaggttaactgccagttctgccatattgcacaactctagggtccttcattcacatagtacaaatgtgcctcctgcaattgtggctggtggtggccatgttcaccgcagttttacttcattggcctagtgtagggctgttcagtagaattttctatgatgagggaaatgttctatatctgtgctggccaatatggtaaccactaaccacacatgattactgtgcacttgacatgtagctggtccaaatcaataatttaattttaaattcatttaattttattaacttaaattttactttaaatagtcacatgtagtagtggctactgtaaaggacagtacaggtctatagcagtggttctcatagtgtggaccccagaacagcagcattagcatctcctgaacacttattagaaatgaaaattcttaggccttgctctagaatatctgggggtgggccccagaaacctatacttttacaaactgtccacttgattctcactagaaatgcatattcttaggcctcacttcagaatacctggggatgggcccagcaatctatatttttacaaactctccacttgattcttaccattaatgcacattcttaggccctgctctagaacatcttggggtgggcccagcaatctctgttttagcagatcctccatgtgattctgatgcacattaagagatgagaaccactgctctactgatcacgagttaggagaggatcagaactaacagcagtcacaaaagggacttttttctctattccagtgtttcttttctatatttgaggtgagctgctaggagttaactggggcagtgtcctcattcttcgcttctcacagttgtcctcattaagaaccaactgtgacaatgttcccctcagtgtaagtgaagagtaagcaagtcatgatccttgctttccagtgggactggcaggatccaatggtacctcctcactgcccccatgtatttctttacttcgtgctttaaccttctaaagtcttctccagttactaccatggagagttcttcacatacggggaattatatatcttcagtccagttcagtcttcaatccacttcactttgccttctatcttgcaagaactcttgaaataatcagcatgtagatgtcacccattattaacttcccatactaatacagatatttttcttccttacttttatatctgttggtcatttccaaggtaatacagaaaggagtgaactagaaaaatgctttcagtcttctgcttttccaagaaatcttccatctttctcttaatgccttaccttatatgaaatattaaaagtttttcatataattctatagtgttttatatgtatcatttcatctaattaccaaaacattccagtgacataggttttattactgtcattttccagacaaggagactgaggcttacatggtttaagtgagctatataagaggaatgggtagagcatctgctttgtaagggtctctgatatgcagaaaatgatggctaacatttattggatctttattacggaccaagcattgtgataagtgttttttatccattatcttatttaaggcttataaaaatttccattttacagataatgagcaacactagaaaggttaaataacttgtctaattacacaactggttagtaaaactgcccatttccatgccctggtttgtctgactctagaggttgtgctcttaccggctatgctgtattggtttcttggcctggaaagtaatcaaatggcatgggcagagtaaagagtataacatttcggagggtgtccttacatctcatcatttatcacacagtgggttatttaatttattttccataccactaccaagtctacagtcacgggtttaagggttaatagaaacccattaatctctggtaattttaatattttgcttattttttcttactctgaatggaatccctaaaaccatatgagtcctaacttttatctccattcattctaaatatttactgcacaactactgcatgccagacactaagcgaggtgctgtgttcttgatgtttgctaggtagctgagcaatagtccctgtcaaaacgtttggtgaattgcctggtttactgttaaactctcctcccagtctgcctttgttatgaatatgattatggattcactgaaaacttcacttgaactttaagtatcataagagtatttggaacaaataggcaccttgattgcaactccaaggagttctgtggcttccttgctgcaaatttaaaagagagaactccatctccaaatcagtgacattcagacatgtgcatcactataaaggacaagggtcaactcaccatccagactagtttgacaggaacaattcagagatgaaagagctgctttcaattgctcaagcaatgaattttccatacaatgcacctttccagagtcatgatcaaaggaatccttgctgaagcctgactcacaacacagggaaataattttatgcctaattttttttctctcctgactctctctctctctctcttgctacagatatgtcagtactaatttagttcctcttataaaatagaattaaaatatcttacatttttggagcctgttattgtttataaaatatatacatttccaaggtgtaattaaatataataggataatctgtgaggcaggtactatttcccccagtttgccaataagaaaataaagattatttggctgtacattcattcattcattcattcatttattcaatcttccaacaaacatgtatcacactgaggcactagagtgacaaaaattaatcaaacaaggtccattatcttgaacagcttatagttataaaacatacaaccagacatattataacatgtgtttttaaagaagttttgtgagcttcagaggaagacaaaataaaatctttccagaaaaagatggagccttggaggacaggtaggacttagatatgcagaaatgagtgaggtgcattccaagcacaggaagcatgcacaagcaaagatatggagctcggaaagtacagacggcacaagaaaactgagttgttttgtatgtatgattgctgaaagaagacatgaagggagaatggtgaaaaataaggttgcaaaggtaggttataatgtttgagggatataagtaatctaaccaaagtaatcagcataagtgggactcaaacccaaattttactctgcagttggagctcttaccttgctagtgctatattccaaacttcttaacacagtatatagctcaatcaacttgaaaaaatagatacaggactatcaagagaactcaactcgtttttgaaagccatctatatcattctttcatttaagaactgggagatgtatattttaaggcaactgatgcacaaactctatagacagcgatctcagtatctgtcatattaaaagtaactgtgtttttctgaacactactagaattcagagcagaaatatgagtccccttgaaaaaggggacaggaagccctaagttgttaagcagttgcttatacctggatagatcttgttcactttattgtaaatggaagtgggaatcttggttgagtgaaaatcagaccggctaagttctcagttccatcaatgtttaaggcatgcaagtggtttggctgttatgcctatgtcaccttggcctcttctatgagggccacaacacagagttcaccccttgtaatttttgtccccagtgggtattcactgcctgactcagaactttgaaaagttggagacaaaggtaatgggcataaaatgacccccaactccaacacatacacatgctggtagtgatataaagaaatgtaataggaaagcataatttccttttttattctaaattaaaaaacaatcactttcctgttttatgctatagctgacacaagtagtagaaaaatttggaagcacaaactgcaacaatatgacagtcaagggcatggactcactgatgataaaaagaaaggagggtttacatttccaaatattctccacttctgttatctttttattagggaacgccatttgagacaataagttctgtctctggaataaaatctaacatggaaagcaaaatgaaatttatactccttattaattcattgtgcataaaatcaggtgtcattggttgtattgtgtaacggcttgctgaaaatcattacaaatacacacagcacaattctagtattactttaaaatcagcttccccttgaaaacaaaatccggatattttttataaaaatacattctctaattcttatctgggaaatggctcctaaatgaacagatgatacctttgcaatttgaagttaagagctgcttatttgtcactaaggcagttagttttgactatgcagttttcgttttatatcaagcaaatacatttttttattttcctgttttaaatattattttcatggttacatttatttagagaaaattatctatggtttacacataaaagacaagcatcaattgagcaaattatggcatttataattaaatgcttcttgtatgcagtctccaacactgctaaaggaagccatcactctaacaaaatattgaatatgtttagcataaaattgcattaaacagaccctcagaattcttattaatttatttgggatgaaataagcagattttttttttttttggtcacacgttttcatgtaaattcaccaattcaaaagacttgcttattattcttatttgagacggagtctcactctgttgctcaggctggagtgcagtagcgcaatctcggctcactgcaagctccgcgtcccgggttcacgccattctcctgcctcagcctccagagtagctgggaccacaggcgcccgccaccacgcccggctaattttttgtattttttagtagagacagggtttcaccttgttagccaggatggtctcgatctcctgacctcgtgatctgcccgcctccaccttccaaagtgctgggattacaggcgtgagccactgcacccggccgacttgctcattatttttaaaagcatattttacatgagtgataccggggtacttgataactgactgagccattgttccatttgaaataaaaatatggagacatttcaggtgagaatttttggcattaaaccaaagaatgatgaatagtacatttttcaaaaaagatagcaacaatattaaaaaatttaacaaacagagtcccttgattaacagagactggagtgaaagtgaggtgagactgtgtgaaactcacaaaaggccccagttaggttgatcagtggggttccaagacataactttgaaattaggcaatccttgactcttccttctctcttacctagtcagtatctcagcccatcggattttatctccttttctaaaattgaaatgctttgctctttcttactcagacttttccttttctcattatgagagctcagctcaaatatcacctcctcagagaggcctattctgatccctaatttaaagtaatcatcctcttagccctcaccccacctactactcactgcctcctacctcctccagtcattcctatctaatgtatcatcttcctattttatttacctgaggttacttatatttgttttcttgcttattttctgtccctcccactagaatgtaagatttatggaggtaaggacattccatgttaactgttgaatccctagtgcccaaactctgtggcaagtatttgaaataacacctatccacagtgtcctaattcaggtccttataatatcctgtctgggtacctgtaagagttccctggatggtttccttaatatcagcctcatcttcctcaacccattttttgcactagagctggattgttctctgtaattcaaatctaatgatgtcactccattacacaaagctcttcattggttcttcactttccaaatgaatattgtcgaaccatacagagtggtgtgcagtatcactttaagtagttcaaaaaagaatattttaatttaatagtttttaaaatttattttaatatgcgttaaaacaaaccatcaattagcacattaacgatttcacagatcttattactgaagatgagaaaaaataaaagttataatccatttacagacatggaaaaattaatgaatgtgtctttaaaagagttttgaatgtgatcagagactaatctaaaggataaagcccaatgccttctcttcagtttcacagagtccctgcctatctctctggcataacattcactacttcttgccttgcgctttatatcttggcaaattcaaattatttgcagctccgccaattcatcacattctttatggcctctctctttttagttcagttatctcctgtgcctagaatgcctttggttggctgctttctccctgtttactgtcacatggttagctcttctcattctgtgactcagctcatgaatcaccaacttcatgaagcctttgttgtttgtttgtttctctttcctcaggtttggttaggtactacttctttgttctcccttaacattctgtaaaaacgttttgtttatacctactgcattgaaaaataactatttgtgcatatctatccttcaagtgaaatattcctaagattagggataatgttttctttacattagtatccctagcttctattataggacctattctgaataggtgctcagttaaaataattagttaagagaaggggccataacatcaataattaaaaagttaaattaaaaagttgttcacccacagtatgagacacatcatatatttattcagtcagtagtcagtcaataaactatatatatatatatatatatatatatatatttactaaatgttaaaaagtatgggcacttaaaactagtttgtcgaagagataaatgaaaaggtcttagcaacatggcatagtaggacctgttggtggggaagaaggatgaaccaagactggagtgaaggaaggattgggtaatagctggaggtaacagttgattttattgattataaatgttacatctcatcagagatggtaccacagtccatacttaccaaatcaaaggtgcatgtgggaatgagaattggtggtgctaatagaatacatgtcagtgaaactttcagatatcagatgttctgttttttgtctttcagttgggagatggaatcagtgattatcaatgttcacctgataacaccgcaaaaggggccagggcaaactgctagtaggaactgtgcagagaccctagtatgaaaaaatttattcaataaacagtgtcttctatggaccaaacactgtggatatagagatgattccagtatgatattattatggtttataatgaccataagtgattgctataaaagaagggaactgttgtcgagcttcagagctaacccagggattacatctttgttagacataatagattaaggccatgtgactagaacactcttttcagaaaactttgttagtgcttgagaaataacattaaaatccaagcaaaagacaattctgggaaaatgatgaagtaggaagcaccagaaatctatctccctgcttagacaataattgctctagcagaatctgtctactataactattttggaactctggagtataatgaagacttgaagcgtccaggagaaggataattgggatatccatcatgttaaacatttatcctgatttgaccaatacacactgtacacaggtatcaaaatattacatgtagccccaaaatatgtacagctattatatatccattaaaaatgttaaaaataaaatttgaagtaaagaattaagtaatttcctttgcttcactaattagcagaaaatttgaacataacatacattttgggagtttggattataatcatttttaaggataaaacctataaatccctttcttctctagaccatttgagagactttttataaaaagcatcatttgaagatatgcttttatttttttcttataaagcttcaataatctcttgaagttgttcatacacttctacaatgcatttgctattccactgattattgtgcagtgctattactgaccctaccaatatctctggatcatgctacatttggagaataatattctcccatatatccaacatgcagtggtgggacaggcataggataacctctacagatagttgcaatcaaaaggagggaaaatggaagttgagcaagttactggtctgtagacattctgaaatccagttgggtgcagattgcatttcttgagtagggctccatcttattggagttgttcactattgttcttagttctactttctgggtttttgtttcctccctctgaatgatcctacttttcatataagaaacattcttatgcctgctttctgttcataaaagctcaggggcccaaaggtctcttaatatattgtactttctctgtcccttctattccaagctagggatgcttccaccagaataattatctaaaaacattgtgggatttgtgtttactaattgacaattcgcacaattagataaatgtcatatccacaaatctttctgacataagtctttgtctaccttgagttccctgtaagactgttgtatgactctctacaatcctgtccaacccacggcccatgggctgcatgctttgaatgtgacccaacacaaatttgcaaacgttcttaaaacattatcagattctttttttttttttgcgattttttttttttttttttttgagacggagtcttgctctgacacccaggctggagtgcagtggcacaatctcggctcactggaacctccacccctccaggtttaagcaattctctgcctgagcctccggagtagctgggattacaggcgcgtgccaccacacccggctaattttttgtattttttgtatttttagtagagacggagtttcaccatcttggccaggctggtcttgaactcctgacctcataatccacctgcctcggcctcccaaagtgctgggattacaggtgtaagccacggcacccggccttttttgtgatttttttaaagctaatcagctattgttagtgtattttatgcatggcctgagacaattctttgtccaatgtgtcccagggaagccaaaagattggacattgctgctctgcaatgcccttagattctcagaacccttattttttagggcggaggagactcaaggcatgcccttaaggtcttaggtcttctgtcatctgaaagtttctatgagtcactatatttgatcttttgagggcttaataaggagttttgtaagcatacccagggattacaccttagactttacttccctgatagcgctctggatttgaactctgacccagagctatttattaattttagtttcatttgacatctggagagactaagaacaaaaaccactttttttttgtacaaataatcttgccccctttgtaatgaacagtctgttcttttacttatctctgttttctcacattttgtcatctaacaagaagaagacaggtggcactttcaataatctgcctggaaatcttagattgtcattagatacttttactattttccatgttattgcaaccaacagaattgccagacattctgccaccatattacaaaagtctcctttcctccagcttccaatcacattttccatactttcctttaagctcccagggacgatctacccagcgcttctgctaacacctgcctttttagtctttccccaacattcttcatgaagcactttcactaacactttttcaatgcccttttagtttctgcctgctacttggttcaaaacctacaccatatgttataggatactataatatgacatgataatagcatcatatttccaggtattaaaatttgttctagtcctctattgttacataaaatagtatcttaaaaatgcagtttcagtaagacagtggatgggactggggtcaatgcaaaggttttctcactcacatgtttggtggttaatgctggctttcaaatgagactttacttgggttgttagccagaacagtacacaggacttctccacatggctattgtgcttccttaaagcatggtggctgggttctaagagtgagatttccaaaggaccaggcaaaatctacattgcctcctatgaccctagtcttgaaggtcactttttaataattgtttttattttaaaatttttgtgggtagatagtaggtgtatgtattaatggagtaaatgaaacattgtgatacagccatataatgcataataatcccagaaggataaatggtgtatccatcatatcaagtatttatccattctttgttttataaacaatttaattctacctttttagttattttaaaatgtacgataaattaatgttgactatcgtcaccctgttgtgctatcaaatactagattctattcattgcatctaactactttttgtacctattaaccaccccctgtccccactatccttcccagcctctgataaccttcattttactctctatcttcatgagttcaattgttttgatgtttagctctacaaataagtgagaacatgcaaagtttgtctttctatgcctgtcttatttcacttaacataacatcctccagttccatctgtgttgttgcaaatgacaggatctcattcctttttatggcttaatagtactctattgtgcatatgcaccacattttgtttattcatttgtttgttgatggacacttaggttgtttccaaatcttggctattgtgaatagtgctgcaacgaacatgggagtgcatttatctcttcagtatacttcttttggggtatatacctggccacttagtgtcacttgtgccatagtcactggctataccatattcaaacataaatataaatctcacctcttgatggaaaaatgtcattatcattttgtaaggaaaatgtatagatggaaagatgttattgtggtcatccaaaatacaatctgtcacagtctgtgatagctaacctgctaaattcatcttcagtctcaattttccattaaaagaaaagaaatgattttgagtgacactagctcccagtgtcagcaatttaaaaattaaaatgaacttgatgatgcttccctgagaatgccagaagtagtaaattaagaagtaaacttttcaagagaaaaaactgtcctggatctaaaagagtaggaatacagacaacaatactccctatgccagaataatttagcatgcttactctgttagattttactgagtccttacttagcagacaaaggatgaggtttattactttttgatgaatgagagttgagttagagaagctctgggtgaatatttcatctcactagacggtttgggacattaaattttgggcattaaattatgtccccatctcctcccgaaattcaaatgctgaagctctaactcctagtagcttagtgactgtatttggatataggccctttaaagtgatgtatttggatataggccctttaaagtgatgattaaagtaaaatgatgctgttatgatgggccccaattcagtattactgatgtccttataaaaataggaaatttggacatgctgagagacacttgagatgtgtttacacagagtggagggccaccatgtgaggaggaagcaagagggtgagcatctctctcacctataaggagagagacttcaaaagaagccaaccctgctgcaaccttgattttggacttccagcctccagaactgtgagaaaatacatttctactgtttaagccacccagtctgtgatattttgttatggcagccctagtaaaagtatacaccatttttaaagtaaggataataaaaccttcttctgacgatggaatcagacatttaaaaaacatcacactgtgcctgccattttataggtagcagatgaagaaatcaccctttctgtaataagattgtgctacatatcagtcagtagagaaaggtgaaggctcaacaaatatggaggccctttaatagtcttgtaatattttacttctctggatgttacatgatctctgtatagttccttaatattttattagataaacactgtgacccctttttgaagtcacctaacttacgtctacattcccctttcttgccgaatatcactaggtcccttctcccctacctgtcatgagggcttacttcctaacctgatgatcacagagcagttcttgaaaggagtcttgagataccttcaagtacaaaagagaacttgttattttgatgtattaaaaaactgagacgtgatagtctccaggtgccatctgataagcactccccctcatccattcctatctgccatgtagttcttagtaaatgacaaagtcttattttaaaatgtgactgtgtttatttcccactgagtacccaatgaaaggaagatcacccctatttacccttaccatgaattaaaagcaaaaacaaaatcactggattcctccacaggccatgtaagaatcatgttatcaaagctactttggtgccacatcgaaaaatggcagctgagaatccaaggaaatattgattttaccagcagaaaagggtctgtgaaaattaaaaagaatattgtttattggagagaaatataaaataataaaataggaggctctaaagctatgtgtacacatgaaatgttgaagatagaaccaaagatgcacttgtgggttagtaaagagttcttccctttacttctgaggctcgcccagttctacagaagtccttgagtcctcggtactgttcagtagtttgggaagcaaaactgaaccctatgcagtcaagatctggttcaagatagtatgtgcttttgaactggtatgagtcactaactggtgctgagtcttaagggaactcagagaaaaaggtaagttcttgatcactgtaaggttgaatacacatttatggggtggaacagaccagaccattgtgaagtattgccccatagactattcctgaataggtctcatctggtagcctgaacaatagatatttgtctttcctattcaggagataatttgaacatgctttgtgatcattctcagcagattcacttgatttgtgagcaaactgatgaaagtgataatccacagacctaattctacattttaagagataaaagataaaactcttcaagcgaggatattagaaatcaagctgtctgccaaagattaatattcccttccacagaatggagccgctgtgttgctgggaagcagctgcccatcaggaattacatttctctagctcccttcatttaagtgggaccatgtgacagagagctggccaagagaatgcaggcagaagtgatgcacaccacatacaggcctggcccaggggaaactttcatgcagtcttccactgtctttcccatctgctggctagatatcaacactgaggctgacttcggaagccatgtgttgaatcctgcaaggtctctgtatgaacccctgtgtccaggtcccatcatttggactttacataagcaaggaaaatatttgctattatgataaaccactacaattttggggatgtgtctgttcccacagctgatatttatcttaactaatatggacagagacataggaaaaaagaagttccccaaatatattttgtttccatatgcttttgtgtaccctcttctgcacttcctccccctctttgattcttacacatccttcaagaccaaggtcaggcatcacctcctccaagaagactttgaaacctccccaagctgagttaaatatggatactgcatgaaggattgtaatcttctgtgtatgtgatcatgtcccaatatctaacaacctaactggtacatatttgtaaaattaatatgtaaattaataaaataaatggagaaaggtaaatacttcaagcaaaaaataaaaagtacaagtcatcctgaaaatatgaaaggaaaagtctctactggctgtggacaatgtaattgcattaaatatttaaaaatatctaggtatgactagcctttctgctgcttcatatgatcttgtattaacctaaattattgcacccaaaatgtagcatatggcacttggtacaaatctgactctttcactagattgcgaatcccctgaagacaaagactgtggttttctttgtgtttccattttcaggtcccagaatggtgcctgaaatggtgtaggccctcaccacatgcccattcactgactcgttgactcactgactggctccaggctggccttgaattcctgggctcagactatcctcctgcctttgtccttttgttctgagtcttcctcagcattttctgccaacccttcttttcaggctgacatgggttaggaggtaatctgaaagctttcaccaataagaaaaattaattgaattacatcagctctattataaggaaaagggctattgagatataatctacatactgtaaaattcatctgtttaaagtatacaattcaatgatttttagtgtacttagagaattgtacagccactcccataatctaattgtagaagatttccatcatccaaaaaagaaaccttgcagcagtcactcctcattcacactcttcccacccccagccctaggcaaccactaatccagtttctctctctatagatttgcctattctagacacttcatataaatggaagcatgcaatctgtggggtggggtggggggaggttgtagaagctttatcttttgacaaatgctgattagccttgtaaagtgcagttgaatattatcaaacatgttctcaaaatgaacaaatataggaataagatgggggtttctataactgtctaaattactgagaaataataattaggggttgggcatggtggctcatgcctgtaatcctagcactttgggaggccaaggtgggtggatcacttgaacccaggagttcaggaccagcctaggcaacatggtgaaaccccatctctaaaaaaattagctgggcatgtggtgcatgcctatagtcccagctacctgggaagatgaggtcggaggatcacctgagcctgggaggttgagggttcagtgagttgtgatcgcacaactgcactccagcctaggtgacatgagtgagaccctgtctcaaaaaaataaaaataaaataaataataattaaaggaaccagcagctcaaaatatattataaacaattctcataattgatattttatccaaatatcaaaaattcatacatttttcagatgaagggtctccagagaaacagaaccaatagagtctgtgtgtgtgtgtgtatgtgtgtgtgtgtacgtgcatgtgtgtgtgtgagagagagagagaaagagaaagagagattgttataaaattttataacaaacactaacatcgaggaatgctagtgagtagacatgcagctatatggtttggcagggcctgccagtgctcaccataaatgtcttctccttgtcttgctggatacataatctgactctcttcctcaactgtcctttataggtaggtgaccatattagttagttctggacaatggaatataagcacaatttatgtaagcacaagttatgtgttttacttctgggctgccatggtacattttatgttaacctgatggggccacagagtgctctggtttttggccaaacattattctaggtggatctgtgagggtgtttctggatgggactaacatttgaactggtagactgagtacagtagattgccctctctaatatgggtagggcaatcagttgaagactaactagaacaaaaaggccgagtgaaaaggaattcccattacctgactgcctttgggctaagatgttgttttcttttctgctttcagacttggatggcaacatcagctctcctgggtctccagcttgctgactgcagatcttaggatatgtcagcctccgtaatagcatgagccaattccttataataaatctctctctctctctctctctctctgtctgtctctctctctctctcacacacacacacatgcacgtacacacacacacgtgcgcacatacacacacacacacacactctctctctctctcgctattggttctgtttctctggagacccttgactaacacatgagcctaaaccataaccccttccacagagaatccttgctctcttctctcatctacttactgaatggatggagaggatgctatgaacctagggaaaggtggggccacaaaatggtaggcatctggggtccctgaataaagcataagaagagagctgcctagtctaccttcattgtactgcaacatgaatgagaaataaacacttattgtgctgatccactcagagtatgcggtttatgtattatggcagctagtggtatttactgtagcatttattacatgctagatttttatgaaattgaagggtaattcactcaagtcaaaatgtaactaaaaattaactgtttcagtggaatgaatacctctttgcttgtgaattttcaaaattaaaagagaaaagtctgagtcatgaactgatagtagaggggtgctttaccatgaccagtgttctggctcacatgaagccatggagtctagcccaagtagctgaattcagtggcaatgttcagatctgactcatccagtctggctcttcttaagagacaaagaacaaatactgtctgttggcgggtacttccaaaataattagcaagcaccagcatacttttattatttttttctggctatacaaacgcccataactagtatatcaaacttcatgactgtgaaaaaataaaagaacttgtgaaaagtaagaaacattttgccaggaagcaatttcattaatagagaagtagaattgtatactaggaggaacatgggctttgaaagtaggctgtcataggtttaattcattcatcactattaattaattcatcaattaaacaagtgtgtactgagaacctactaaattgaaccataaagatgctgatactcaactttatttgaactacaaaaataatggttttgtatgattcagtctaatacataacagccactgttgtatgtgctgggccttcagtaagaataaaacaaagttcctgttctcatggagattaccttttagtggtgagagatcaaaagaaaacaagtcaaatgtatagtatgtgcagtaataatacaggcaattaagaaaaatatagaaggtaaggaagatgggtgtgttgtgaggggaggaatttgctattttgtggtagtcaggaaagcatctttgataaagccatgtttgagtagagaactgtaggaagtgcagaaataagccatttggctacctgggagaagagcattctaggcagaggaaatagcaggtgcgaagtccctgatgcatgactatgcttggtatgttcaagaatagcaatgccagtgtggctggagcaaagtgggcaaaagagagagtagtaagggatgagatcagcaaggcataggactacctcatgtaaaccttgccttacttttatagggcttctggttttcactgatttaagagttgaaaaaccttggagggtttgggggagagatgtgacatgtgttttcaaaagactactctggctactcttgtgcgaatagactgtagggaagagaaggtcgaagcaggccaattaaaaggctattattcccctaatccaggcaggaaaagaccatggcttggtctaaaacattaggtatgcagctagtgagaagtggttagcttttgttctatgaacgtagaactaacaagatttactgatgtatcggatgtgccatatcaaaaaaaagaggtgctaaaaatgttctgagcaagtgaaaaggatggagttttcattaactgacatggggaaacctgaacaaggaagaggttttatggctgtgagaatttagagtttcgttttagacatttaaagggtgaaatgcctactagacattcaaatggagaggtcaaatagtcaagtaggcagctgaatacaacagctgcagagagactcaggttaggaatataaactttggagtcatcagcatgaataagacaataaactattgaggttaattgagaaaaaaagaaaagaaatagcggagacaagaactaagcctggagcattctgacgtttaggggtcaaagaaaagagaataaaaggaagcagctggggatgtcagaagagatgtttagaatgcaagtcttcattcttatgagacctctccaggtttcagtttccataagtgaaaaatacagaaaataattcctaggtcagaggatttccaaaggctgaaaagaagtaacatgggaaagcatacataagatctagaatgtgcttaataaatgttattcctgactcttggtgaaattctgggtagatgccagatttctcatgcttccttctattttttggctcctcaatcaggtcctcaaatatgaaccctatagtccaacagtgttggctatggaagtaagagcctcattattcttcagttattagttatacatttttcagtgatagagctcactgttatcagatattcatctttactgtttgttctcttcctgtgttttgtgaggagtcaggtttaaaggagagtggtcactaatgtgaagctgggaaaatggagggaggatgagttctttatcacctggcaggagtgtatccttacttcaacatttaactgctcaccaaataatttaatttcagaggatttgtttcagtgctatggaagaactatctgtatataaatagctgggttaagtagatctttcactgcagctgttaaaacctattgttgtagctagacaccttgtagtgattcaagatcatctgtctttgaagaaagtctatgctttcttttatgcacatgtagtttcttttagttctgaaaataaaataagctttacttaggaagactaaagaaaatgtttactgaataaaccaggggtagctgaaataataccctgccacaatctcctgcttttatttcatttatctgctttcaacatttaccactgaatacttattgaaagaataaaggaaaaactaaatgaatggatgaattaatatctgaatggcttttttttgcttttccttaacaagactcctcctaaataatcctaaataagttctgggttaccctgaggattatcttttacaacaagaatcatgaagtaggaatactttttcataaagaagagataaatcccagagtaacaccgaaacttacctagtaaagtagtaaacaatctgtagggaatctcaggggatcatctgatcctagtatcaggctcaagcagattctttttcaagttcttatccctcctcctcttccccaccccaacccagttggatttaaattgtgtatattagagcctctttgtaaggaagaattgggcagcagtgcagagagaaggaagagttgggtgctttaccctactgctagcacttgggtgctcaaagtagagaaacaagaaaaacaggctactggtaagatggacaataaaatgagctgcattgggtgaactgtgacctagattataacagtgctttacaaataatattccaaattataagtccctaaaattatccaaatctagattttaacaatcccgaaagccattcattttagaaagattttattttcctgtatccttccctccatttctactcctgccaccttagtccaaaccagtgttttttttcttgccaggacaatgacaaaagcttttcaaccagtctcttcattgcttctgttgctcttctgtaatccattctccatgtagcacttggaataatccgactaaaatgtaaatcaaatcaaatcatttctctacttacaatctttcaatggctccctatagtacttggaacaacgtccaagctcctccctgtggtctttaaggttttttgtgatccggcccctccctgcccctctaacatcatattgagtcattctctccttcactattctccagctacattgacatccttttacatgtatggtgcttgtgtatgtttgtacatatctatatagtgtatatacatataactattttttattaggatataattggcatacaataaactaaacacacttaaagtgtataacttaaagttttcagatttagatatatgcatgaaaatataaccacaatcaacaaaattggcatatctatcatccaaaaatttccttttacccttttgtaatttctcactcatgtccctcattatcttctcatccaccaggcaacaaacaatatgctttctgtcactataggtaagtttagcttttctagaattttatctaaatgaaattatacagtatatacttttttgtctagctgcctttactcagcatagttattttgatatttatccatgttgtttatattaatagttcattcctttttattgccaaatagtgttccattgtatggatatagcataatttatttatccattcacctactgatgaacatttggtttgctgccaggttttgtctattagaaataaagctactatggacatttgtataaaactcattctatcgccatttgttttcatttctcttcaaaaaatatctaggtataaatgaccgagtctagagaaggtgaagcaaaatgactgaatagaactttccagcaattgttgcccctgcagaataccaaattgaataaccatccacataagaaaacaccttcataagaaccaaaaaccaggtgagtgatcatagtacctggttttaacatcataccaatgaaagaagcactgaaagagtatgaaagatgttggcgccacccctccctcatcccctggcagtgactgtgtggcatggagagagaatctgtgtgcttgggggaggaagagagcagtaattgtgggactttgcactgaaattcagtgctgtgctgtcataacagggactaacacagggcagaactcagctggcacccaaagagtgagcatttagaccagccttagccagaggggaatcacctagcagtattgtcagaattctgacaagcccaaaaacaagctaaagcgctctggagttctaaataaacttgaaagatggtctaggccacaagaattgcaatttgtgggcaagttctgatgctgttctaggctcagagtcagtgaatttggggtgcatacaacctagtgagatgccaaccacaggggcaagggaatgtttgtgccacccctcagccaactccaggcagcacagcttgcagctccaggattcacaccttccttctgcttgagaagaagagaggggagaggaggacttcgtttttcaacttggataccagctaagccacagtaggacagggcaccagggagagtctgacagccctcattccaggtcctggttcctggacaaaatttctaaatatatcctgagccagaagataacctgcttccttgaagggaaggacccagtcctggcagaattcatcacctgccagctaaatagcccttgggccttgaatgaacatgagcaatacccaggcagtacttgtcataggccttgggtaagacccagggccacactggctttatgtgtgactgagtgcattcccagcagctgtggccttgaggagagaatcctgtttgaggaaaggagagggaagagtaaaggggactttgccttgtagtttgggtatcagcttagccacagtggagtagaacatcaagcagtttccaagggtccccagttccaggccttggttcttagatggcatttctggatccatcctgggccagagtgaagactactgttccgaagggagagatccaggcctggcagcattcaccacaagctgactgaagagtccttgggcctggagcaaacatcagcagtaaccaggcaatcctcactgtgagcctagaacagtggtggccacagcgagagacttcttctgcatagaggaaagagtgggaagaatgttgtcttgtggtttgggtgccagctcagccacagtagaatagagtaccaagtagattcttacgtttcctaactctagacctgggctcctaaatggcatttcttgtcccactctgggccaggggggagctcaccaccctgaagggaagggcataaacctggctacatttgctgcctgctgactgaagagcctttgagtcttgagtgagcatcggtggtagccaggcagtggacacctcaggacattgacaagacccagtgttatgctggcttcaggtctgacacagtacagtcccagtgatggtgaccataggggtgcttgtgtcaccccctctgacagctccagggagcccagcatgcagagagagactccatttgtttggaggaaagcgagagaagagaacaaatctctgcctagtaatctaaggaattcccctggatctcacctaagaccaggaaggtggtatttctacaagtctgtaagagtcccagtgttactgagcatggagtgccccctaatgcagatattgcaacagtgactaaagatttagatcataacacttgaatacttggaaagccttcccaagaaggatgggtacaaataagctcagactgcaaagactacaataaatacctaactcttcaatgcacaaaaataaatgaacacccacaagcattaagaccattcaggaaaacatgacctcacaagacaaactaaataaggcaccagtgaccaatcctgagtaagagatatgtgacctttcagagaattcaaaatacctgtttttaggaagcttaacaaaatttaagataacacagagaaggaattcagaatcttatcagataaatttttaacaaagatattgaaataatttttaaaaatcaagcagaaattctggagctgaaaaattcaattgatgtacaaagaatgcagcagcatcttgcaatagcagagttgatcaaacagaagaaagaattactgagcttgaagacaggctatttgaaaacacagagtcatagaagacaaaagaaaaaagaataagaaagaatgaagaatgcccataagatgtagaaaatagcttcaaaatagcaaatctaaaagttcttaatctttaagaggaggtaaagagagagatcagggttgaaagtttattcaaagggatagtaaaagaaaattttccaaatctaaataaagaaatcaacttacaagaacaagaaggttctataacaccaagcaaatttaacccaaagaagactactttaagtcttttaataatcaaactcccaaaggtcaagtataaagaaagaaacttaagagtagcaagagaaaagaaacacatagcatacaaaagaacttcaatatgtctggcagcagaattctcagtggaagccttccaggccaggagagagcggcatgatatatttaaaaggatgactgaaaatgcttttatcctagaataacataggtgaaaatatccttcaaacatgaaggagaaataaagatcttcccaggcaaacaaaaggtgaaagatttaaccaacatcatatctgtcctacaagaaatgctaaggagagttcttcaatctgaaagaaaataatgttaatgagcaataagaaaacatctgaacatacaaaactcactggtcataataaataaacagacaaacacgtaatattagaacactgtaactgtggtgtttaaagcacccatatcttgagtaggaagactaaaagatgaaccaatcaaaaataataatggggtgataaagttaaagtgtatagagttattagttttctctttgcttgtttgttaatttgtttttgcagtcagggttaagttgtcatcagtttaatgtaatgggttataagatgttatttgcaagcctcctgataacctcaaatcataaaaaaccctacaacaggtataaaaataacaagaaattaagatatacctcctgagaaaaccaccttcactaaatagacaaagggaggaagaaaggaagagaagaccacaaaacaaccagaaaacaaataacaaaatggtggtagtaagtccttacttatcaataccactgaatgtaaatggactgaactttccaatcaaaagacatagagtggctgaatggatgaaaaagcaagacccattgatccgctacaagaaaaacatttcacctataaaaacatttcacctataaaaactcatcgagactgaaaatgaaaagatataaaagatatttcatgcaaatgaaagccaaaaaaagggcaggagtagctgtgctcatatgagacaaaataagtttcaagataaaaactacaaaaagtgataaaagggttattatataacaataaaggtgtcaattcagtaagagaatataacaattgtaaatatatatgctcccaacactggaggatcagatatgtaaagcaaatattatcagagctaaagagagagacagatcccaatacaataacagctggaggcatcgatgcctcactttcaacattggacagatcatccagacagaaaaatcaacaaagaaatatcatagttaatctatactatagaacaaatggacatcatagatatgtacaaaacatttcatccaatggctgcagaatacacattcttctcctcagcacgtggatcattctcaagtatagatgatatgttaggtcacaaaagaagtcttaaagaattaaaaaatattgaaatcatatcaagtctcttctctgaccacaatggaatgaaactagaaatcaataacaagaagaatgttagaaactatacaaacacatggaaattaaacaatatgcttctgaatgaccagtgaattaataaagacattaaaataaaattttcaaaaattattgaaacaaatgaaaatggaaacacaacatatcaaaatctatgggttatagtaaaagcagtactagagaaaagtttctagcaataagttcctacatcaaaaaagtagaaaaactttatataaactacttaattatgcattttaaagaactagaaaagctgaaaagctagaacaaaacaaacacaaaattactagaagaaagcaataataaagattagagcagaaatataacagaaacagaaaagaataatacaaaacgtcaatgaaatgaaaagttggttttttgaaaagataaacaaaaatgaaaacttttagccagactaagaaaaaaactaaaaaggcctaaatacaatcagaggtgaaaaaggagatactacaactgatactccagaaattcaaatgatcgttagagaattctatgagcaactctatgccaataaattgaaaaatctagaagaaatggataaatgattatacacagacaacctaccaagattgaaggctgaagaaatccaaaacctgaatagactagtaacaagtaattagatcaaagccatactaaaaagtctcccagaaaaaaaaaaaaaaaaggcgtggacctgatggcttcactgctaaattctaccaaatatttgcagaagaactaataccaatcctactcaaacaattctgaaaaataaggggactacctctaaactcattctatgaagccagtattatgctgatatcataaacaaagacacatcacaaaaagaaaactacaggccattatccctgatgaacattgatgccattgatacaaaaatcctcaacaaaataagagcagtccaaattcagcaacacattaaaaaggtcattaatcatgaccaggttggatttatccctggaatgcaaggatggtttaacatacacaaatcaattaatgtgatatatcatatcaacagaataaagggaaaaaaacataaaatcacttcaatagatgctgaaaaagcatttgataaaattcaatattccttcataataaaaactctcaaaaaactggggatagaagaaacatactttaacataataaaagctatatatgacagactcacagctagtataatacttaatggggtaaaactgaaaactcttcagttttgaagatctggaacaagacaaggatgtcctctttcaccactgttattcaatataatactggaagtcctagtagagtaatcagacaacagaaagaaataaaaggcattcaaatgggaaaggaagaagtcaatttatccttgtttacagatgataaaatcttatatgtggaaaaacccaaactaattcagtaaagtggcaagatacaaaaccaacatacaataatcaatagcatttctatatgccaacagcaaacaatatgaaaaagaaatcaaatcccatttccaatagttatgaataaaataaaatacttaggaatagacttaaagaagtgaaagatatctaaaataaaaactgtaaaacactgatgcaagaacttgattgaagaggacacacaaaaaaatggaaatatattccatgttcagggattggaagaatcaatattgttacaataaaatgctcatactaaccaaagctatgtgcagattcaatgcaatccctatcaaatatcaatgacattctttgcagaaatagaaaaaaaatttcctaaaattatatggaaccacaaaagaactaggctagccaaagccatacagagcaaaacaaacaaaactggaggaatcacattaccagacttcaaattatactacagaaatattgtaacaaaaacagcatggttctagcataaaaacaggcacatagaccaatggaacagaacagagaacccagaaataaattcacacatgtacagtgaacttatttttgacaaaagtgccaagaaaacacattggggaaaggacaatctcttcaataaatggttctgggaaaactggatatccttatgcagaagaacaaaactagaacctatctctcaccttataaaaaatcacactacctgacttcaaactatactacaaggctacagtaaccaaaacagcatggtactggtaccaaaacagatatatagaccaatggaacagaacagaagcctcaaaaataacaccacacatctacagccatcttatctttgacaaacctgacaaaaacaagaaatggggaaggattccctgtttaacaaatggtgctgggaaaactggctaggcatatgtagaaagctgaaactggatcccttctttacaccttatacaaaaattaattcaagatggattaaagacttaaatgatagacctaaaaccataaaaaccctagaagaaaacctaggcaatatgattcaggacataggcatgggcaaggacttcatgactaaaataccaaaagcaatggtaacaaagccaaagtagacaaatgggatctaattaaactaaagagcttctgcacggcaaaagaaactaccatcagattggctgggcatggtggctcacgcctgtaatcccagcactttgggagggcaagatgggcagatcacgaggtcaagagaccgagactattctggctaacacagtgaaccccatctctactaaaaataaaaataaaaataaaaataaaaataaaaataaaaataaattagccaggtgtggtggtgggtgcctgtagtcccagctactcaggaggctggggcaggaatgaacctgggaggcggagctttcagtgagccaaaatcacgccactgcactccagcctgggcgacagagcaagactccatctcaaaaaaaaaaaaacgaaacaaaacaactaccatcagagtgagcaggcaacctacagaatgggagaaaattttcacaatctacccatctgacaaagggctaatatccagaatctacaaagaactccaacaaatttacaagaaaaaaaagaaactaccccatcaaaaagtgggcaaaatatgtgaacagacacttctcaaaagaaaacatctatccagccaacagacacaaggaaaaatgctcatcatcactgggtatcagagaaatgcaaatcaaaaccacaatgagataccatctcacaccagttagaatggcaatcattaaaaagtcaggaaacaacagatgctggagaggatgtggagaaataggaatgcttttacactgttggtgggagtgtaaattagttcaaccattgtggaagacagcgtggcgattcctcaaggatctagaactagaaataccatttgacccagcaatcccattactggatatatacccaaaggattacaaatcatgctactataaagacacatgcacacatatgtttactgcagtagtattcacaatagtaaagacttggaaccaaccccaatgtccatcaatgatagactggattaagaaaatatggcacatatacaccatggaatactatgcagccataaaaaagggtgagttcatgtcctttgcagggacatggatgaagctggaaactatcattctgagcaaactatcacaaggacagaaaaccaaacaccacatgttctcactcataggtgggaattgaacaacgagaacacctggacacagggtggggaacatcacacactggggcctgtcggggggtgggggctggggaagggatagcattaggagaaatacctaatataaattacaagttgatgggtgcagcaaaccagcatggcacacgtatacctatgtagcaaacctgctcgttgtgcacatgtaccctagaacttaaagcataataaaaaataaaataaaataaatcaaatcaaaatggattaaagacttaaatctaagatttcaagctatgaaactactaaaagaaaatggggaaactctccaggacattggactgggtaaaagtttcttgagtaatatcccatgtgcacaggcaagcaaagtgaaaatggacaaatgggatcacatcaagttaaaaagcttctgcaaagcaatggaaacaattaccaaagtgaagaggcatcctacagaatggaatacaatatttgcaaactattcatctgacaaggaattaataaccaaaatatataaggagctcaaacgactctataggatagaaacctaatactctgatttaaaaatgggcaaaatatctgaatagacatttatcaaaagaagacatacaaacagcaagcgagtatgtgaaaagatactcaacaacactgatcatcagagaaatgcagatcaaaactacaatgagatagcatctcaccccagtttaaatgatgtttatccaaaaatacgagtaataatgaatgccagcaaggatgtggagaaaagggaaccctcgtaaactgtttgctggaatgcaaatttgtacaggactatggagaaaaatatgtaggttactaaaaaactacaaatagaaccaccatatgttccagcaatcccagtgctagttatatacccaaatgaaatgaaataggtatataagacagatatctgcactcctacatttattgcagcactgtttacaatggccaaaatttggaagcaaccttttgtccatcaacagataaatggataaagaaaatgtggtatatacacataatgtagtactattcagccataaaaaagaatgtgatcctgtcatttgcaacaacatggatggaactggaggacatcatgttaagtgaaataagccaggtacagaaagattaacttcacatgttctcacttatttgtgggagctaaaatttagaacaattgaatccacggagacagagaatagaatgatggttaccagaggctgggaagagtagtgggggcaggaggagaaatggggatggttagcggatacaaaaatacagttataaacaataattaacatttagtaattgataacataacagggtgactacagtcaacaataaattattgcacttcttttttttttgagacaaagtttcgctcctgctgccgaggctggagtgcaatggcgcgatcttggctcaccacaatccccgccttccaggttcaagcaattctcctgcttcggtctcccaagtagctgggactacaggcatgtgccaccacgcccggctaattttgtatttttagtagagacggggtttctccttgttggtcaggctggtctcaatctcctgatttcaggtgatctgcccacctcagcttcccaaagaattattgcacattttaaaataactaaaagaatataattggaaggtttgtaacacaaagaaataataaatgcttgaggggatagatagcccatttaccctgataattacacattgtatgcctggatcaaagtatctcatctaccccataaatacatacatgcactacgtacccataaaaaaattggctgagtcatgtggtaggtagatgtttaacatttaaaaatacagccaaaccattttccaaagtgattataccattttatattcctaccagcaatgtatgagagttccagttactccacatgttcactaacacttggtatgatcagctgttaattttaaattttgtaacaggtaaatattagcccaatggctaatgataggaagtattttttttcacatgctgatttgtcatctgaatatctgcatatcttctatggataggtgtccattaaatcttttgctcatttaaaaaaattgtcatttgtttccttattactggatttgacagttcttcacattttccatattaactcctttataagatatgataattggaaacatattctcccagtcagtggtttgtcatcactgtctttgcaatgtttttcagaaagctgaagttcttaattttgattaagttcaatatatcaaatttttcttttatggattatactttcagtgtcattcttttaaagttttattttaagtccaggggtacatgttcaggtttgttatataggtatacttgcgtcatgggggtttgttgtacagattacttcacacccaggtgttaagcctggtacacattagttatttttcctgatcctcttcctcctcccaccctccaccctccaaaaggccccagtgtgtactgttcccctctatgagtcgtgtattctcataatttagctcccacttataagtgagtacatgtggtattcagttttctgttcctgtgttagtttgctaaggtgtcatttttaagaaatctttgcctaacccaaagtcacaaagtgtttctcttatgttttctgctagcaattttagagttttcggctttatatttatctttgcaaaatatttaatttttaatatggtataaggtatagatgagtgcttttatccttttttttgaaaaccatatccaatttttccagaaaatttgtggaaaagactttcctttattcattgagtcaaacctttgttaaaaatcaattaaccatataaatgtggatctgtttctggactctgtattttgtttcattgatctatttatttttacattgataccacatggtcttaaatatcatgactttatactatatcttgaagtcagttggtgtgtcttacagctttaattttcttcaaagttgtttttaaattattctgcatttccatatgaatgtgaggatcagtttgctaatttctacaaaagcctgctgggattttgattgggttggcatcttttctggtcttttaaaattaaaagcttatcatcactttaagacttttgtattttgttcattggttcatttatcttcttttctctttacagggatctttcgatggctggctcctttgtatcattcgtatttcagctcaaaagtaacatcctcagagatatctttccttgattacccaatttaaatttatatccctcatctctttatatcaaagcattgttttgttgacttaacagcattaattatcatcagaaattaatcttgcctatttgtttattttgttgcttattatctgtctagccaactagaatgtgagaaaagagtagagaccttgcttgtcttattcagtttgtatccctgaagccaaaaagtgcctttgataagcggatactaaatatttgtcgaatgattgactatttgacaaatgtgcatttaagtaaagattcaactagtatgaaaatatataatattaactagaatatgttaacttatttatgaaatgatagttctctgggaagactgtgggaacttgactgtgacttaaagctgtagttctcttgaagattatgaattgcgttgggctagattatggcatttcagaaacatagatttttggtttttaaactaaacatctcaatttagctcattagctttgttagcagaatttaaataggtctcacattagagttattcctgattactttaggaatgtgaatatctagaacaaataaaatctttccccaaacattacacagataaaaggcagaaagtttcaggtccatgagaaattataggtatttcctaaataatatttaattaaaaataaatactagtcataattttgacagacagaggcagcaattaaaacatacttcatttttgtccttgattgcttaaagtagcaaacaatgaaatcaatttcttgagccctatccatgttgcaaaggtataaataagattttatccttaatgagatcatacaacacagatacaaaacctaaggctgtttcaaaatgttttgtagtagcgtaaacatagaattttatttgctgagctatttctctcactgagaaccttcattcattgaacccaccaaacttgtgttgagcaccagctacatgttaggaactgtgctaggcaatggagataagaaatgaataaaacagagtctcaatccttcaagaagtcacagattttacaatttcaattgcttgaaggaaaagtcacaactgaagagactggaaattgtggaaatggtcagctttttttccctgattttgttctactgtggtccttacgtggccttcattcaatacctaggcttcatggtgggcttagctttccccttccaagtgactcacaggcaactccagatctagtgttctattattagccttctcaaacctgattattctaagaagcacttcccactggcaacatggtaatcatgtttaaatataactcttcatgatcaatctaaatctccagatttttaaccaagtttccctgtggcttagataccttttttttttgctttgtttttaattaatccacgtttttataatcctatgtgacattaacatgtaaggggtgtgtgtgtctgtacgtgtggccttctgcactaaggcattagacagaaacaatttgaatgaagaccactggctcttctagtcaaacttcctctttctgtatactctgcctgtatctgtcatctgtctatacctgtcagatgtctgtacatgtcaggaataaagctaacgggatgtataacaactaataattcatggtttgaataactatagtagctttcatttattgaatgtttcctacgtaccaatgatatgggctggctgtgtccccacccaaatctcacgttgaattgtaataatccccacgtgtcaagggcagggccatgtgtagataattgaatcatgggggtggtttcccccatactgttctcatagtagtgaacaagtctcatgagatctgatggttttataaatgggagttccccaacacatgtcctcttgtctgccaccatgtaagatgtatcttgcttcccctttgccttctgccatgattgtgaggcctccctagccatttggaactgtgagtccattaaacctctttcatttataaattacccagtcttgggtatgtctttattagcagtgtgagaacagactaatacaaccaggaaccaggaaatatgcatgtccttactttatttttgtatcaatcctatgaggtagggacttttattttcttcattttatcaataaagctcaggtagggtaatttggcctagattacatcagtaagtgaagagaacaaggtttcagcttaatcctgtcaatctggccatagcctatatacttaggctatacaaatattaaagtatactattaagttacaaaatattaatattaaaaactaagaatggtttctatatcctctacaacccaattttccaatctttcagtaaccagggcaatgagactgaaattgttcattttctgtttttatagacatttctgttttttaaaacaagttgttagcatcaaatttcggtctctgtgaatctggaaacacaaggctatagctgacctgtcagttattatattatttgtttttgcaattttggccacaggccatttatcctatttcatgtttgttgctttttttttttttgagatagatagggtctcactctgtcacccagactggaatgtcatggcacgatcatagctcactgcagctttgaactcctgggctctagtaatcctcccacttcagcccttcaagtagctgggattacaggtgtgcgctaccatgcctggctaagttttctattttttgtagagacgaggtctcgctatgttgtccaggctggtcttgaactcctggcctgaagcaattcttctgccttagcctccaaagcactggaattataggtgttagccactgcacccagccttgtagcttctgaagagcaggaaggagagcttgtgagttaatatgaaacattaagatgtcaatatcatgaaataaaggcatacttttcatagcaaacctttccataaattactcttacgctttttctttctttattcctcttgaactgtaataaaaatgaaaactataacaaatataatcacttttaaatgtttcttagtcctaagcttctatcctgttgctttccagtaatgtgtttgtggttgctgttgtaactataacaccttaactttcaatgatctaattttcacagtaaacagttaccctattttccaaagatcacactctgacaatagaagttaggacatatctatatgcatacccatatttgggaaatagattaatcaactaacacagttttccaaataagtaattttttaaaaatccctttttttccattttgttaagccttttgtattttctttttgatattaggtattgacatgaccctgcctgcacagttccagtgataaacacttgctttaatgatttattgcctttcctggaaaggaacaatgaatgatctgaacttattgctgttcctatgcttggtgggcaaatcacattgagtttgccttcatggtcaatacagatggctgtaatcaaatcaattttgggacaagccacattgaatgctaaaagcctgatttgaatagcacagcctaaagatgatggaacctatgccactgccagctgattactatgctttagaaaaataaaaatgttttaattaattacggggatgacaaaaatctgtattaaaaggagtaaaattggaaatctaatcaagggtattaaaatccccaacgaattaggcctgaaggaaggatatctaaaagatgtaccaatgagttcatacagacctacagatacatctaatgaatggttgctaaataggacaaatatagctcattatcattttagaaggataattatagataattacaggtaaactatcatcccaatgctacatgtgatgtagatgacatgttatgctgggctttttgttttctctcacaacacttattgaatatccactaagtttagaacatcacagaagttcagatttgtaaataagaaaaaaaaaacaacacagaaaacatagaccaaagcccattataataaactccatggagcatctacatttttgcttgcagtacaattttgtttacatatttacaaatcactttcctatcaacagggaactagagactaataaaagggctcatgcccaactgttctggagaatttaagcaagtaaaatgttgtgttcaaaatgcagtaggggtaagaggtggataaaatgcatataacttcacttttgcttattctttctatggttcagccttgatctggtttggtgcacaaatgtgaaggtttagaggcatactttggctgtgcagtttaggtagtattttgatgcacatgtaaaggctagaaaaaaatttaaaagtgctatttggtgactagatgtattcggtttcagaactaataggctatatagagatataaaagaggatatttattatgggaattggctcacatgattatggaggctgagaagtcccatgaggtgccaccagcaagctggagaaccaggaaagctggtgtgtacttcagcctgagtccgaatctctgagaaccggggagccaatggtgtaagtccgagagtccaaaggcccaagaaccaggagctctgatgtccaagggcaggagaagatggatgtcccagctcaagaagagagcaaattagcccttccttcaccttttcattctatctgggctctcaacagattaagtgatgcccatccacactggtgagggcagattgtctttactcagtgtactgattcaaatgttaatctcttccaaaaggacccacatagacatacacagaaatgtttaccagctctctgggatctcttggccctgtcgagttgacataaaattaaccattacaccagaggaaaaaagaaaaaaactttgacaaactaagttatctttttaatacatgggtagaattaccactcacacagtaaagaaacaaagagctgttgaacagatataatgtattataatgcatttagtggaccattttagaatatagaaatggagtaaagggaaaaatctgtgatcaaaagaattttaccactcattcattcattcaaaatacatttatgtattaaatgtacataatagatttactcattcactggttcattcaaaaacattcagtatatgctatgaaccaggcactgagtgagccaatagacttggtttcccaaagtcagaaaaagatgaactcttaggaaaaaatacacaaaaatgaaaaacataaccataaaatcatcaggaaatagcaaaatttataaacataattacagctattaaataatacttgtataaaaaagtacacagtgttatataaaaaaaggcataaagcaacggtaaggcattggagagattggggtcaaatgaggttagtctttgaaaaggtcaaccaggagactgcatttaaaagcgggaaaaggatataatttgttcaagtgaagtgggaatggtgtatcaggaaggccaagcaattctaggtgggagaagtgtgtacagtagaaggttttcttagcagaaacacagaaaacaggtgtgggaaatatcaccagttcttaacttggcctgtctctctattaagaagagggtcacaaagtgttcacagatggagatattctctttccaatgggataacagtactgatttagttcatatgaaaagattttttacatgaaaatcatattttttggaataaatgatgtgcaattatgtacatgacaaaagaattgatttacaggggaattttgccgcagtgttatccaaacactaaattttttccatatatttaaaacatgatgctatttactaaaacatgctttatgcactctcctcccaggaacacatgcattacacaaaagaatgtatccatttgccttaaaacaaaacaacagtagcattaccatttcattttatttagctactaatgtcaagagagctcaatgaaaggaaatgttttttcagagttgaaaaaactctgattccccttgaaaatagtcatccaaggtcaatagagatcatgttattcagatttttagacaagaaacgaatgggggattcagatgacattgtgcttcagtgatatgttaggcacatgaattattatagtggcttgaaagagaaaaattcatctaagaatcttcctaattcccctttattcactgactttctcagtatcatctatcaaatatttcaaacaaaaaggaccacattgttaagtgacataaagaataaaatttggcagcacagatttggcttttcctctcttatgcaagtataaagttatgaatacaaacaaatttagttttcacttgcttttcatcatctaatcaataaaacacattctacataatccaaagcatactgaaagtagagatgacattaaaaagctgactataaaactaaatttcaaaagagcttaaaatctagtgccatgagaagtccagaagattagttattatgttctttaggctaattgagttcaaatgttggcttttatgaaatgtgcacaagggccacctcatgattaagtaatcttagcaaacgcacacaccggtcagaatagtcacatctgaacaaaaggcacataatacttatatgtggcaatacagcaacctctaagacagccatgtgattagaaatgtacacagcagtactgctgacctaaaaaattacatttgttacatggggaaggtgtatatattattggaagtcatggacttgccttacaaatctaaatttataaacacatcatagatgaaatgcaagtttggtcagtaaattggccatctgttccagatacttacttttctgtttcaaggagaaaaacagtctattctaaatattttcttagtcaacctcccatttgaggctctagtgaccaatcaatccatcaatcatttatgtatatctatctacttaaaacaaatatttattgaggttgtactatgccccaacactgttctaaactctggggtttcagtggtgaatcagaaaaggtgcctgtacacatcctagagaggtagacaaatttaaaaaaaatcaaacaataaatatttcagtattgataaattgtataaagaaaaataaggcaaagtagaagaacacagagactattttatcttattttatttttacgtatttcaatagttttgggggaacaggtggtgtttggttacatggataagttcttcagtggtgatttctgagattttggtgcacccattacccaaggagggtacactgtactcaatgtgtagtcttttatccctcacccacctcactcttccccacaagtccccagaattcattatatcattcttatgcatttgcatcttcatagcttagctcccacatataagtgagaacatatgatgtttgattttccattcctgagttacttcatttagaataatggtctccgactccatctaggttgctgagaatgccattatttcattcctttttatggccgagcagtattccatggtattctttatccactcattggctgatgggtatttaggttggttccatatttttgtgattgcgaattgtgctgctataaacatgcatgtgcaagtgtccttttcatataatgacttctttttcactagatagatacccagtagtgggattgctggatcaaatggtcgttctacttttagttctttaaggagtctccatactgttttcggtagtggttgtactagtttacattcccaccagcagtgtagaagtgttcccttttcaccacatccatgccaacatctattattttttgattttttaaaattatgaccattcttgcaggagactgttttaaatagagggacctgggagggtcttcttaacgcggtagttcacatttgagcagaaggttctcgttctctagtctattatattttcttataatttaaaattgtgcactctttgtgcagtgctgattcttggctttcctttcccccttctaccgttttcttttactagcttttgcctctcagagagcgtgagttaggaggtgaaactcatttatttgtgacaatgttgttcctgctgacagctttacaaagagttttgattgaaaagaaggctgaaaataagggataaaatgagatattcttggattctaatgatgcacattttctctgccaccctgaactcatatatcagtaaacaattgagaattgcctagctttctgagtgatctctgtttatcataggctctgggaatatgtctgatggtgatctcttataatacattaaataatatattttagtagtccattgtaatttgttcatctctgaatttggtaggaagtcatcctgatctttagcaatgaatgtgtactttgagattcccttgaattcataaaaaaaggttaatgtatccatattagtctgttttgcattgctatgaaggaatacctgagactgggtaatttataaggaaaagaggcttattggctcatggttttgcagactatacaggaatcatggcaccagcatttgcttccagtgaggcctcaggaagcttacaatcatagcagaaggccaagggcggtggggggcaggtgtatcacatggtgtgagagggagcaagagagagagagatgggggaggtcctaaattctttttaacaatcagttctcacatgaagtcattactgtggggagggtaccaagccattcatgagggatctacccccatgaacccaacacctcccaccaggccccatctccaacattggggaacacatttcaacatgagatttggaggggtcaaacatccaaactatatcagtacctattttacaaattgtatatttctgctgatatcaatttaaataaaattacattatttcataattatctgactcatgtcaggaattatcactaaattgatgacaaaagctttggacagtagaacaatctcaaaatattgtttccctagcataatgatgctgtctagcaataggatagaggattgtgggaatattttagctctgaaaaaagtggttctttacagttacaaggacagagaaaaactcaatatttctagaaaggaatataaagattcttactctcagaatccctggaaatacaaatataacaagaaatcttgtttcatcaaaattcttgtgaagttactgcagctaaaatcaggagtcaaataggggattctctctatacatagcaatggtcaagaaagcttgaataaccacagaaaggagcctagaatcaaagaagcccagggtaggaaggcatctttaaaatcacctggttctatacttcattaaaggcttgaatcatccagcaacttctctgccatacaatattcagactccagtaatggagaacccatttctttctaaagcagtgaactcctttaatggaaacctacataaatggtaaaatgtcctcccttgttgaactgaaatctattttttctttaacttccatttccataacagaaatttaactacactttgggggatgctttttactttcataaagcattttgactatgcacaagaatttgaactccaggggttttctggacctataatttagattttgggaggatatggtgggggcaaggcaggaagaaaagaaggtcttagtgttgtgcttcaatccagaaattcctgaagttcatcaccaacagttattggaggagttgttaataaagtaatttttaaatgttcactgttattgtttcttgtgtactgctccctcagcaacctcacaaggtgcaagtggggtaggggatgactgagaaggaagcattcagccattcctgggtctctagacccgatgccatcaaatactagtaaatctctgttgtaacccctagcaaagactttactaggcaggtttttccatcactgaacaagctgaatatttagaaagtgttttcttgtgtgtctccctacccccacccccataactttcaccactgaatcctttactagataagcaacacataagggtatttggagcccttcatgtaattgaatagggggatagtttctgatgatggttttacatgacagatggtttctagattatccaggtttttatcaactggatgctgtctagcatatcaaagacattttaaaacttttaaataaatatgtgctaagcaggtccaaagaggctaccacttctggtgatctggtcactgtccttttcccaatgcagtataattttatgagcactttgttaaagctgcatctctttgcaaaccagcttggttaaatttcctatttcattttcacatatctagtgttcattttcacatatctagtgatctgttcttatacagttgatttttttaacctcaaggaaggattttatatttatccttagtaaatttcattctaatggtttttatctagtgttatagcctctggagatcatgctgcatcttgattttgtcatcagtcagttaagccattactccactcccaggtttgtagcatccacaactttggaaagtacaatgtaatggtccttgtcgtccctggctctgccttcttctaacttttgcacttaaggtcaattaaaatgcatgaattcaaaatagtttttccttccaggatcaactctgcttattagactgaaggtggggacagaatgaatttagaatcattttattttagcacaggaaaaactgtataattgtgattgttggattcttcaggattgcatgatataatatttcaaatggcctctaatttctttaagtctcttttcagggaggaaaatccaggtttatatgcaaaaatgtagccagtatgcatatctgacaaaaactcgacaagtaggaatgaaagcagtgtagaccaaggaaaatggcttgacactggaatagagaaagggtgaataatctggagtcaaacaaaggtcccaagagagtgggtgaaactctccctgaatcttgagttcaaactatatataaaggtttgcaggaaaagaaacagaaaaaggcagtgaacaggcagtcctggagagcctggacaaagaaaaagattataataagagaaagacacttccttgtcattttatgggaaaatgagaaggaagaggcaaagaagtttgtgtgtgtgcatgagagataggggagggagttgggtagtgagagttgtggtggaaaaacacctgctttgtgctttttgattctttctggagcttagctcaactgaatgtcttttttttttttctttcaagaattgacatgctgatataagagctcaaaaaccagcaatttctaatgaggtttgctacatcaaatgtgatctaggccaaccttttttatttagctgtagtggaaaaaacaattctccaaaggctaattcttgctggaggtcacacagccaatttgtttcagagttgagactagagaatccatgtctcccaatcactggttcagtagtcttttctatggaggactccctcgactaatagttcaaacaacacaacatcaaataagccttgttctctatcaacctgatctatcttctgctgatagctgattaaacaaacgattatagcaacaaatgaatgattgtgactcgtttaactatatctggacctggaggtagctatttgtttttatattaggttttaaaaaatggatttaaatattataattctatagaaattatagagaacaagaatcagagcaatcactacatagctctatgaatttgctgcagagaattaagacataacatatcagatacatttgaagcaccctatgtattactttgtaatctatttctcatacttcttctttaaatgtgttgattatcatcttccatgaattaggttggtaaagaagttgacaaggggctttatatttttaaaatagagaaaatactgcaatataatatttgattacacgaataggggctggtacacaaatgtttgtccttcaatttccatttatgaatggatttgcttctaggctgtcttttccatgtcattatcatttgtctatttctgtattaattccacatcatcttaattactaatagtttcataagatttgatagctgacaaagcaagttctcccatattttcaagctaattttggctccttgtttttcctcattaattttagaatatgcttgttaagatccaaaaaaaactttgttgaaatatgataatggttttatactgtaaattgagagatgaataacatctctatgatattaagtcaagccattttggatatggtctatggtatcatttgtttccatttttatatccttcaaaactgttctgtatttttttccacaaatgtctttcacacattttattagatttgtgcctaggtaatttatagatttattgttattatgtaggaagaatactatatttgtataatatatatagtatatatgtatactatatataacatatatgttacctgtgtactatatataacatatatataacatatacactgtatgtaatagatgtgtatactacaggtatttacaaatactatcagttttcatgtattaatcctacagctaggaacctggctaaactccctaatagtttgtagttacttttaggttttctatggttgcaaccttgtaaatcccatgtaatttcagtttatgttttccttttcaaccattatgccttgtatttctttttcttacctcattgcattggccaggttgccattatattttaaataagagcagttatgttttagatagataatttttgtcaatttaaaaatttatcttccatttattgtttgctaatttggtttatttttcaattttatgagtgtggaattttatcaaatatatcttaagctcctactgagttaatgttatgtttttttccctttaatctgttgtcattaatagttttccacatattgaaacactcttatattttcattaatttttattgccctataaaatctgatattatcagctgaaagtcatgcttgccaaggattttcaaggttaaaaatcactaagtgtgagtcttgtctttaggaatcaagtggtgcatcttaatggatgtgtatgtgcacatatgtatacacattaatttagataaacacacatacatctagtcacacataaatacataaatatacatgcatataaaataaaatataaataatggtgcttatactttgtccattttatttcaggacaatcactgaagttttcattgttgaatactaacaaccttttgtaatagccatatattacaattggtgtagcaatgagaacaaaataaagtgaagctctacagaattttaaataagcctaagcagtactacaaacagcattcattttggctaaacactatgatgtcctcttaagaacattacttaaagattttaaagctcattttctctttagtaatcacgagtttggagtgaagtggcaatgtagggaataaaaagaacttactataaatggtatttgaaaattccttatgtggatccacatagtgttgctaggaaacatggtttcttagcatttggaaagctagaaaaccaagtttcttacctcttttggccacagaaatctgtatcatggatctgatttaagagagtttggagattagttggcttcaaaatattcggataagcataaattatgttttatgaccaaccatcccttaagaaataataacatgttttcaactcatgctcaaaaataggaaaatataccctgtatcatctttcattactgggatatcacataactgaaatattagaatagtggttaaaactatagtgatgattaattttacatgtcagcttaactgggccacagggtgtcctgatatttgatcaaacatgatggatgtttatgtgagggtatttctgaatgagattaatgtttgaattggtagattacttaaagcagcctgtcctccctaatgtttgtgcctcatgtcatcagctgaagtcctgaatagaacaaaaggctgtccctctttctattagcgaggattcttcctacttgactaccttcggattgagacattagctcttttcctgctttcagactcaaactgaaacgttggctgtttctgggtcccaggcttgcttaccttaggacaggaactacatcactggctctcacggttttcaggccttcacactcaggctgggaccaaaccatcagctagctatcctgggtctccagcttgccgagtcaccctatagatcttgggagttgcctgcttccataatcatgtgagccaattccttacaataaatctatctatctgtctgtctacatcctattgtttctatttctttggagaatcctgactaatacaaatataaactctatagccagattggttaggtttgaattacagctttgtcacttactgcctatgtgactctcagcaagttatttaaaatctctgtgcctcattttcctcacctttaaaacagggaaaacaatagcacctgcctaatggaactttgtgagaattaaatgagctattacatataagacacttagtaggacgcctgaccataataaatgttggataaatgttacctattattactgtgtggttgctgttgtcattcttgtattagaaaatgtattttcaggtggaactattacaaatttcaccatttcttacactcttaagacttcttaagcaaatagaatttactcttgccaatattaatctagagatggatagcccagtgagaaatttacattctcctgctaaatgggtttcctataacattgccagaaacccagcaagttgaaaaaaatatacagaaaaagaaagaaacaaatgtagactctgtgggtgagtgggtgcatccatggaattaaagagaaagggggacagtttaaatggaacgctggatgtatgtcttaagtgcatttgtatcaaaagaagggcatatatatgaaggtataaaatgtaatttcttcagcttcataaaaaccttctgggtatgaagagagattgatgaaacaagtatcaatatagaagtaaacaccatcagaattcagaactggaagtgaagaacaattctgtatgcaaattgaaaccaccagagggaacctaggtaggtggaatataattacccaaactggaaagtgcccaggaagctggattaataatctacattttaaagaagtgccaggcatttttgaagtcaaaaatgttcagaaacttttgattatgttttataatcacaaaatattttgaaagtacattcaatgtactagttggaaccataccaaaaataagagctcagtgagaaggaaagaggaatgtggtgctttttattgttatatatatttcatctttttatagtattgaggaggcttatatttaaatagaatgacagaaatgaattattccctcttgacgggtgcaaaatcttagagcattatttttctctcaaagcaaactataggattcaattccccattacaaggaaaaatgaaaaaagtatgatagcgagttttattagagagtgtactcgaagcatttggagaaattttagaaagagattgtcacaatagcatcgaaataaatcttaggaatgatttctacagtttgtaggcagaaagctatctaggttaaacgagtcatttcttcagccattagatctgcccttctgtaatagctgcacagttttgcacaaagggctatatgttagggccagcaaccaggagtcttgattttaaaagaaatgatgtcggaagtgctggctaattaacaaaaggcattggcaacatttacggacttataagcagtgaataacattgttcttttcattttatcatatgaaagtgttcacataactattatctgctatccttgaatggtgaggtgggaacaagaagacctatacagtatctgcataggaagtggtgaaataaatgtttacttgttttaaacagtctctttttagaagatcagtgtgttctttacagttacagtgagaactgtaagtctgcttgtctgacttttcgtgaaatgctcttccaaaatgacgacatagaccaagtatatattcctaaaacctgtgccaagcagctttcctatcttgtattagcattgagttaactagcaacatcataaaatagatggaagaataaagattaacctaatgaatcaatgaataggtaaatatttttaccacagacaagtcaagggtaagggtatttatgaccctctatataagaccatctttctcatccgtgacatggaacaggcatagaatgttggctttgtgttaagagggaaatttatagcattaaatgcccacattagaaagctagaaagatctcaaatcgataccctaacatcacaattaaaagagctagagaagcaagagtaaattaatccaaaaactagcagaagacaagaaataactaagatgagagcagaactgaaggagatggaaacatgaaaaaccctccaaaaaatcaatgaatccaggagatggttttttgaaaaaattaacaaaatagatagactgctaactagactaataaggaagaaaaaagagaagaatcaaatagacacaataaaaaatgataaaggggatatcaccactgaccccacagaaatacaagctactatcagagaatgttataaacaactatatgcaaataaactagaaaatctagaagaaatgaatagattcctggacacatacatcctcccagaaaccaggatgatatcgtatccctgaatagaccaataacagtttgaaattgaggcagtaatagcctatcaactaaaaaataaaagtccaggatcagacagattcacagctgaattctaccagaagtacaaagaggagctggtaccaaaccttctgaaactattccaaacaactgaaaaggagggaatcttccctaactcattttacgaagccagcatcatcctgataccaaaaccgggcagagacacaacaacaacaaaaaacttcaggccaacatccctgatgaagatcaatgcaaaaatcctcaataaaatactggcaaaccgaatccagcagcacatcaaaaagcttagccaccacgatcaaatcagcttccttcctgggttgcaaggttggttcaacatacgcaaatcaataaatgtaatccatcacataaacagaaccaatgacaaaaaccacatgattatctcagtaggtgcagaaaaggcctttgataaaattcaacatcccttcatgttcaaaactctcaataaactaggtattgatggaacacatctcaaaataataagagctatttatgacaaacccacagccaatatcatattgaatgggcaaaagctggaagcattcccttcgaaaactggtacaagacaaggatgccctttctcaccactcctattcaacatagtattggaagttctggctagggcaatcaggcaagagaaagaaacaaagggccttcaaataggaagagaggaagtcaaattgtctctgtttgcagatgacatgactatatacttataaaatcctatcatctcacccaaaaactccttaagctgataagcaacttcagcaaagtctcaggatacaaaatcaacgtgcaaaaatcacaagcattcctatacaccaacaatagacaagcagagagccaaataatgaatgaactcccattcacaattgctacaaagaaaacaaaacacctaggaatacagctaacaagggatgtgaaggacctcttcaaggagaactacacaccactgctcaaggaaataagagaggacacaaacaaaaggaagaacattccatcctcatggataggaaaaatcaatattgtgaaaatggccatactgcccaaactaatttatagattcaatgccattcccatcaaactaacatcgacattcttcacagaattagaaaaaactactttaaatttcatatggaatcaaagaagaccccatatatccaagaaaatcctaagcaaaaagaacaaagctggagtcatcatgctacctgactttgaactatactacaaggctacagtaaccaaaagagcatggtactggtaccaaaacagacacatagaccaatggaacagaacagatacctcagtaataacaccacacatctacaaccatctgatctttgacaagcctgacaaaaaaaagcaatagggaaatgatttcctattcaataaatggtggtgggaaaactggctagccatatgcagaaaactgaaatcggaacccttccttataccttttataaaaattaactcaagatggattaaagacttaaacgtaaaccccaaaaccctaaaaaccctagaagaaaacctaggcaataccattcaggacataggcatgggcaaagatttcatgacaaaaacaccaaaagcaattgcgacaaaagcaaaaactgacaaatacgatctaattaaagagcttctgcacagcaaaagaaactaccattggctgggcgtggtggctcacacctgtaatcccagcactttaggaggctgaggcgggtggatcatgaggtcaagagatcaagaccatcctggccaacatggtgaaaccccctctctactaaaaacacaaaaattagctgggcgtggtggtgcatgcctgtagtcccagctactcaggaggctgaaacagaattgcttgaacctgggaggcagaggttgcagtgagccgagattgtgccactgcactccagcctagtgacagtgtgagacttcatctcaaaaaaaaaaaaaacaaaaaacctatcagagcaaacaggcaacttacaaaacggaaaaaattttttacaatctacctatctaacaaaggtctaatatgcaaaagttaaaggaacttaaacaaatctacaagaaaaaaacaaccccatcaaaaagtgggaaaacgattatgaacagacagtgctcaaaagaagacatttatgcagccaacaaacatatgaagaaaagctcaacatcactgatcattagagaaatgcaaatcaaaaccacaatgagataccatctcacaccaatcagaatggtaattattatttttttctataagttttattaatatttgaatataattcacataacataaaattcatccttttaaagtatgccatttggtgattttttgtatattcagaaagtcatgcaagcacaaccactatctaatttttttttattatactttaagttctagggtacatgtgcacaacgtgcaggtttgttacataggtatacatgtgccatgttggtgtgctgcactcattaactcatcatttacattaggtatatctcctaatgctatccctcccctctccccccaccccatgacaggccccggtgtgtgatgttcctcactctgtgtccaagtgttctcattgttcaactcccacctatgaatgagaacatgtggtgtttggttttctgtccttgcaatactttgctcagaatgatagtttccagcttcaaccatgtccctacaaaggacatgaactcatcattttttatggctgcacagtattccatggtgtatatgtgccacattttctttattcagtctatcattgatggacattggggttggttccaagtctttactattatgaatagtgccacaataaacatacgtgtgcatgtgtctttatagcagcatgatttataatcatttcggtatatacccagtaatgggattgctgggtcaaatggtatttctagttctagatccttgaggaattgccacactgttttccacaatgggtgaactagtttacagtcccaccaacagtgtgaaagtgttcctgtttctccacatcctctccagcacctgttgtttcctgactttttaatgatcgccattttaactggtgtgagatggtatctagttgtggttttgatttgcatttctctgatacccagtgatgataagcattttttcatgtgtctgttgggggcataaatgctttcttttgagaagtgtctgttcatatcctttgaccactttttgatggggttgtttgattttttcttgtaaatttttaagttctttgtagattctggatattagccctttgtcagatgagtaggttgtaaaaatgttctccctttttgtaggtttcctgttcactctgatggtagtttcttttgctgtgcagaagctctttagtttaattagatcccatttgtcaattttggcttttgttgccattgcttttggtgttttagtcatgaagtccttgcccatgcctatggcctgaatggtattgcctaggttttctttaagggtttttatggttttaggtctaacatttaagtctttaatctatcttgaattaatttttgtataaggtgtaaggaaggaatccagtttcagctttctacatgtggctagccagttttcccagcaccatttattaaatagggaatcctttccccatttcttgtttttgtcaggtttgtgaaagatcagatggttgtagatgtgtggtgttatttctgaggactctgctctgttccattggtctgtgtgtgttttggtaccagtaccatgctgttttggttactgtagccttgtagtataatttgaagtcaggtagcgtgatgcctccaggtttgttctttttgcttaggattgtcttggcaatgtgggctcttttttggttccatatgaactttaaagtagttttttccaattctgtgaagaaagtcattggtagcttgatgggaatggcattgaatctataaattatcctgggcagtatggccattttcacgatattgattcttcctatctgtgagcatggaatgttcttccatttgtatcctcttttatttcattgagcagtggtttgtagttctccttgaagaggtccttcatgttccttgtaagttggattcctaggtattttattctctttgaagcaattgtgaatgggagttcactcatgatttggctctctgtttgtctgtgattggtgtataggaatgctgtgatttttgcacattgattttgtatcttgggagtttgctgaagttgcttatcagcttaaggagattttgggctgagacaatggggttttctaaatatacaatcatggcatctgcaaacaggggcaatatgacttcctcttttcctaattgaataccctttatttctttctcctgcctgatttgccctggccagaacttccaacactatgttgaataggagtggtgagagagggcatctctgtcttgtgccagttttcaaagggaatgcttccaatttttgtccattcagtatgatattggctgtgggtttgtcataaatagctcttattattttgagatatgttccatcaatacctagtttattgagagtttttagcatgaagcgttgttgaattttgtcaaaggccttttctgcatctattgagataatcatgtggtttttgtctttggttctgtttatatgacggattaagtttattgatttgcatatgttgaaccagccttgcatcctagggatgaagcccacttgatcgtggtggataagatttttgatgtgctgctggatttggtttgccagtattttattgaggatttttacatcattgttcatcaggaatattggtctaaaattctcttttattgttgtgtctctgccaggctttggtatcaggatgatgctgtcctcataaaatgagttagggaggattccctctttttctattgaatggaatagtttcagaaggaatggtaccagctcctctttgtatctctggtagaattcagctgtggatctgtctagtcctggactttttttggttggtaggctattaattattgcctcaacttcaaagcctgtaattggtctattcagggattcaacttcttcctggtttagtcttgggagggtgtatgtgttcaggaatttattcatttcttctagattttctagtttatttgtgtagaggtgtttatagtgttctttgagggtagtttgtatgtatttctgtgggaccagtggtgatatcccctttatcatttttttattgtgtctatttgattcttctctcttttctccattattagtcttgctagtggtctattaattttgttgatcttttcaaaaaaccagctcctggattcattgattttttgaaggtttttttatgtctctatctccttcagttcttctctgatcttagttatttcttgccttctgctagctttttaatgtgtttgttcttgcttctctagttcttttaattgtgatgttagcgtgtcaattttagatctttcctgctttctccggtgggcatttagtgctataaatttccctctacacattgctttaaatgtgtcccagagattctggtgtgttgtgtctttgttttcattggtttcaaagaacatctttatttctgccttcatttcgttatgtacccagtagtcattcaggagcaggttgttcagtttccatgtagttgagcggttttgagtgagtttcttaatcttgagttctagtttgattgcactgtggtctgagagatggtttgttataagttctctgttcttttacacttgctgaggagtgctttacttccaactatgtggtcaattttggaataagtgtgatgtggtgctaagaagaatgtatattctcttgatttggggtggagagttctgtagatgtctgttaggtccacttggtgcagagctgagttcaattcctggatatccttgttaactttctgtcttgttgatctgtctaatgttgacagtggggggttgtctcccattattattgtgtaggagtctaagtctctttgtaggtctctaagggcttgctttatgaatctgggtactcctgtattgggtgcatatatatttaggatagttagctcttcttgttgaattgatccctttaccattatgaaatggctttctttgtctcttttgatctttgttggtttaaagtctgttttatcagagactaggactgcaacccctgcttttttgtttgtttgttttccatttgcttggtagatcttcctccatccctttattttgagcctatgtgtgtctctgcacgtgagatgggtttcctgaatacagcacactgatggttcttgagtctttatccaatttgccagtctgtgtcttttaattggagcatttagcccatttacatttaaagttaatattgttatgtgtgaatttgaccatgtcactatgatgttagctggttattttgctagttgttagtttgtttgttagttgatgcactttcttcctagcatcgatggtctttacaatttggcacatttttgcagtggctggtaccggttgttcctttccatgtttagtgcttccttcaggagctcctgtaaagcaggcctagtggtgacaaagtctctcagcatttgtttgtctgtaaaggattttatttatccttcacttatgaaggttagtttggctggatatgaaattctgggttgaaagttcttttctttaagaatgttgaatattggcccccactctcttctggcttgtagagcttctgctgagagatccactcttagtctgatcggcttccctttgtgggtaacctgccctttctctctggctgcccttaatattttttccttcatttcaattttggtgaatctgacaattatgtgtcttgaagttgctcttcttgaggaatatctttgtggcattctctgtatctcctgaatttgaatgttggcctgccttgctaggttggggaagttctcctggataatatctcgcagagtgttttccaacttggttctgttctccccgtcactttctggtacaacaatcagatgtagatttggtcttttcacatagtcccatactttttggaggctttgttcatttctttttaatctttttcctctaaacttctcttctcgcttcatttcattcatttgatcttcaatcactgataccctttcttccacttgatcgaatcggctactgaagcttgtgcatgcatcatgtagttctcgtggcatggttttcagctccatccggtcatttaaggtcttctctacactgtttatcctagttagccattcgtctaatcttttttcaaggtttttagcttctttgcaaagggtgtgaacatcttcctttagcacagagaggtttgttattactgatcatctgaagccttcttctctcaactcatcaaagtcattttccgttcagctttgttctgttgctggcaaggagctgtgttcctttggaggagaagaggtgctctgatttttagaattttcaacttttgtgctctggtttctccccatctttgtggttttatctacctttggtctttgatgatagtgatgtgcagatggggttttggtgtggatgtcctttctgtttgttagttttccttctaacagtcatgaccctggaaatgctgcaggtctgttggagtttgctggaggtccactccagaccctgtttgcctgagtatccccagcggaggctgcagaacagcaaatattgcagaacggcacatgttgctgcctgatacttcctctggaagcttcatctcagagggacacccggttgtatgaggtgtcagttggcccctactgggaggtgtctcccagttaggctactcaggggtcagggacccacttgaggaggcagtctgtcctttctccgatttcaaactctgtgctgggagaaccactactctcttcaaagctgtcagacagggaggtttaactctgcagaagtttctgctgccttttgttcagctatgccctgcccccagaggtggagtccacagaggcaggcaggccaccttgagctgcagtgggctccacccagttcaagcttcccagccactttgtttacctactcaagcctcggcaatggcggacgcccctcccccagcctcgctgccgccttgcagttcaatctcagactgctgtgctagcagtgagtgaggctccatgggcatgggaccctccgagccaagtgccggatataatctactggtgtgctgtttgctaagaccgttggaaatgcgcagtattagggtgggagtgtcctgattttccaggtaccatctgtcatggcttcccttggctaggaaagggaattccccaaccccttgcacttcctgggtaaggcgatgccccgccctgctctgtgggctgcacccactgtccgacaaaccccactgagatgaacccagtgcctcagatggaaatgcagaaatcacctgtcttctgcatcactcacactgggagctgtagactggagctcttcctattcggccatcttgggaccatccagaatggtaattattaaaaagtcaagaaagaatagatgctggtgaggctgtggagaaataggaatgcttttacactgttggtgggaatgtaaatgagttcaaccattgtggaagacagtatggtgattcctcaaagatctagaagcagaaataccatctgtcccagcaatcccattactgggcatatacccaaaggaaaataaatcattctactataaagacaaatgcacacgtatgtttattgcagcactatttacaatagctaagtcatggaaccaacccaaatgcccatcaatgttagactggataagaaaatgtggtacatatataccatggaatactatgcagccataaaaaaatgagactatgtccttagcagggacatggatgaagctggaagccatcatcctcagtaaactaacacaggaacagaaaaccaaacactgtatgttctcactcataaggggtagttgtataatgagaacacatggacacaggggggtgaacaacacacaccaatgcctgttgtggggtggggaatgaggggagtgaacttagaagatgggtcaataggtgcagcaaaccaccatgacacacgtatactcatgtaacaaacctgcacactctgtatatgtatcctggaacttaaagtaaaaaaaaaaaaaaaagaaaaagaaaaaaatctcagtacaaaagatatgtctcatacaggaacaaaaacaaaacaaaacaaaaaacaatattggctttgtatctccacctgcctgcatctacttttaccactgaatacctcgctattccatgctatgagaaccctatgattcagttatatcaaatgatttgccatgctctgaagtcacccaactttcacttttcatatttgcctttcttcagtgatatggtttggctgtgtccccatccaaatctcatcttgaattgtagctcccagaagtcctacatgtgggagagacccagtggaagataactgaatcatggaggaagttttccccgtaccgttctcacggtagtgagtaagtctcacaagatatgatggttttataaggggtttccctttttgcttggttcttattctctcttgcctgccaccatgtaacatgtgtctttcacctcctgccatgattgtgaggccccctggtcatgtggaactgtgagtccactaaacccctttttctttataaattacccagtctcgggtatgtctttatcagtagtgtgagaatgaactaatacactcagcttgagttgctcttcctttatattatcctccaaaaagtttctacttatcctgtaaggttcaactgaagggtcagcatactgatatatcctcttttaacttctggacagagttgtgtatctgttctattatgcttcatttgagccctacctatttctatcacagcaagtgtcactgaactgtgaatatccacttccattacaacggagttccttgagtgaaaaatacataatacctatgagtaattaatttctgcatggcattcatgcagccatattcattttatgtgcatcattttactatcaagagttaaaattaatggtcagtgattttcatttcttgcaattttacttccttagccagcataggttcctggcatcatttcttctcaaccccaacagaggctcaattccagtactgactggaatgcttttcatgcatgaagaatattgaaaagagctctttcttactttcatgtcttatttaaacatgttacttgctttattttttaacctttaatgactatcacttgccttatttgtcacatttggactaaataatcatttcattttgtcagccagtgttaattcttatggcttgttattgaaactaagcaaattcaatgtatagcatgagtaagatgggacagagaaaaagggaactctgaagaaagtgagctattgactgtgtccctacaaaagtagagatcaatatgtaggtaagaggtaggaaggaaggctgagaagaacagactagaaaggcagtgaagtgagactcaagcgatttaaattctcatcttgcttcactttcaacttcttgtataatattttttttcctctttgggcctcatttatctcatttgttttttgagggcgatgtacttaagtcttttgtatagcaccagtatgattttgcaatatccacacataattgtattagtatttgcttaaataaaaattaaactagtgctcttaactttatgccattcccacaataatcataagcaatgatatctatataataaaccaagttaatgagctatttatttttgtgtgtacattaattacatggacattaattttttaagtccatcctatacacctaaaataacaacagctgacatttatctaaattttgctgggtgccatgtgctgttctaagctatttatttgtatttactcatataatcttcacaacatccattttaatactaattttacaggtgggaaattgtggcacagagaagttaaggctttataaaaagccatgtagcttgtaagtggcagagtcaggactcaaactcaggcagtctgtagtcacacttgggaacaatgaactagaagacatctagggtcctttccagcatcacgaccctctgattttgcttttctctggagcacactcttctcagttcctaagagagtattttatttctacttagcttaataaggtcctttcaaatagagtctatattaggctgtatttgatttttagccttttcactgtcttttatctcctcacaattacataaaattgttcacttagccagttatgaacaatgcagaagtcaaatttcattgcagtcccagaaatcactttatctaaaagtactataaaaaacattcattcttgactatgaagaggctgtacaaagttacctcttttcaagagagtcagtctgcccttgaaacttagtaatttactaaccatcatttttttttctaaaaagaaatatcaggcacagaaatttagagttgaaaggagcttagctgttatgtggtcctaacaccaaacattgaaatatccctgcctagactccctgaatgttggtcattcaccttttggagaagaatcttcagaaagtgaaattactatgtccattattaggtgttccattcattggtaaatacacctcattccctttctgaaatcagatatgccgtatatgtacagtatgtaccacataatgatatttcagtcaatgatggactgtatacacgatggtggtcccataagactataatgaagcatatagggtcttcaaaaaattcatagaaaatgcatattatgaaaaagtatgcatgaatttccaattttttacacaaaataaactcatactgaacaggatctagttgagtctctaagaaagatgagacatcagtttgaaaagagcccctatcacagcaacatgaatcctgctaaaattgaggcaagaacaaacattgaatttacactgaagcttgggtgtgagaatggtgaaatcattgatgctttatgaagagtttatggggctaatgccccaaagaaattggcagtttacaaatggatagctcattttaaaaaggagtgagaagatattgaagatggcacctgcagtggcagaccacccacatcagtttgcaaggaagaaaattcattttttccatgctctaactgaagagggtcaacgattaacagcagaaacaacagcgaatgccatagacatctaaatttgttcaggttacacaattctgactgaaaaattaaagctgaacaaactatacacttgatggttgctaaaattgttatgcccagatcagctgcagacaaacggaaattttcaataagtcggatcaagattctgaagcatttcttcaaagaattgtaataggagatggagcatggttttatcagtacgatcctaaagacaaagcataatcaatgcaatggctactaagaggtggcagtggtccagtcaaagcaaaagtggaccagtgtattagtctgttttcatactactataaagaactgccaaagactgggtaatttataaaggaaagaggtttaactgactcacaattcagcatggctcggaggcctcaggaaatttaaaatcacagcagaaggtgaagagaaagcaaagcaccttcttcacaaggcagcatgaaggagaagtgctgagtgaagtgtgaaaagagtccattattaaaccatcaaatctcatgagaactcattcactatcacgagaacagcatgagggaaattgctcccacgattcaattacctccacctggtctcttccaagacacatggggattatggggattataattcaagatgagactggggtggggacacaaaacctaaccatatcaaccagtcaagagcaaatgtcatggcaacaggtttttgggatactcaaggcattttccttgttgactttctggagggtcaaaaaatgacattatctgcttattatgagagtgttttgagaaaggtagccaaagcattagcagaaaaatgcccagaagcttcaccagagagtactcctccaccacaacaatgcttcagctcactcctctcaccaaacaagggcaattttgtgagagtttcaatcagaaatcattaggcatccgccttaccattctaatttcactccttcttctctctgtttttgaatcttaaaaattctttaaggacacctgtttttcttcagttaataatgtaaaagagactacattaacattgttaaattcccagtacaggacttgagggatgaactaaatgtctgatattgttacgtaaaaagtgccttgaacttaatggagcttatgttgagaaagtttatatatttcttacttttatattttaattttttttttacaaactttttgaagtccccttgtttaaagaaacctgatatatggcacttgatattagcattgcagttcaagtagggaaaatagttgatatgcagtaattgtgctgagagagttttccacataaggtggatgcctaatgacaattttccacatgaaaactatatttttatgtatatttgatgcagatgaaacatatataaaatataaagttcacaaatactatatgaacatcatagagtatatgtatacaaacctagattttatatataatatataatacataatttatatattatattataataaatattatatatatttatatacaattatatataatacaatatataatatattaatgttatattataatatatcaatatatattaatataactaatataattaatatattaatatacaataatatataatatataatatataattatattatatatttattataattatataatatattatctattatataatataatttataattataataattataatttattataattatataaataattataatttattataattataacatataaaatatgtaattatatattataattacatattatatataattatatattataattacatattatatataattacatattatatataattatatattataattacatattatatataattatatattatattgtctataaattatatattatatattatattataattatatatgtaaaatatatatattatatattatatataaaatctaggtttgtatacatatactctatgatgttcatacaatgttgaaattgcttgctgatgtatttctcaggacatatccccattattaagcaacgcatgactctgtgtgttagggaggtatatgtatcccccccatatatatatgccactcattggtcttaccttgttattttcaagcaaaataaaagtcggttttctttttccaaaagttgtatatatttatataatagataatattcattttagtaaaattaatatcttttcatggaagataatttagaaaagtattaaaatgaatacaaatcatccataatcccagggatcagcactgttgctaatatttttatattttcttctcttaatgtgaacatatatgcatgtactagtattctgaatatatctatttttaaactaacgggattatttatatgatcctattttctgtgtgtggtgaggctcctcctgatactctactacatacagatgaataaatttttaataatttttggggaaaatgaagaacatcataaaggtaagggcatctacttccagacaaaatgggataactgaccaaatgtgcactccttcctaaaataaaaagtgaaaatatataaaatgataatttgcaagacactgaaaagcaggaaatgaagggccaaaatctctgagaaacagcaaacaagttgagtcctatatttgccccagtttattgccttgagagagtctctaggctgtagtgcaggagaagggtaaccaggagatgaacttgacagtctgagaagacagaggtaaacagagttgtccagatagtatctaacggggtgagcaaaacgtcgaagatccatagaggaactccctcgaatattcagtgcatgcatgtgaggaaataacccaacactgggggaaaaaacacctaaaagaattagtggcaagactgcccagtgcccacacaggaccaggaacagtgcttgctcccattagtcagattagaattaggtggagtacacagaaggttcttgcctcaacagcaggaaataattggccttagatttagtattgctgtgttctggcctaacatagttaaaaagaccccaaaagatcaaaatgtttccaagtaagtcaatttcatcccaaaaaagccctcaaaaatatttatagaaatataaaaatatatccaacatcaagcaaggtaaaatttatcatgtctggtatttgatcaaaaattacaagcatgaaaacaagtaggaaatatgacccaattaagaaatataataatcaaatttgaaccagaattgacagatgttagaattggcatatgagaacattaaaatattgaaacttacatcaaaactgtgttccatattttaaaagataagtagagatctgaaagatatataaaaagactgaaaaaacttctggagataaaaattcagtctaagatgagaaacatactggctagaataacaagtaaattcagcaatgcaaaagaaaacatactaatgaaaacttgaaaacatggcaactgaaaatatcaaaaataaaactcagaaaaaatagaatccaaagaaaaatgaacagagcctcagtgaactatggagcaacttcaagtggcctaatatatgtgtaattggagtaactgaaaaaaggtttggggtatgaggacagaaaaaaatatttgaagagataatagctgacatttttccaaatttgatggaaactattcttatttttcatttaacattatgttgtcagaattcttctttctttctgtgtatcatgtgaaaacacagttcctgaagactacaaaattccctcccatggatgttttatgatttatttagccatttgtgcctgtacattttgattatgatttttcataattataaatgatgttgtaatgaatctttatacccataaatgttgatctgcatctgatccttgagatatattccttgaaatgagtttacagggtaaggttctacatatatttttagagtcttgatatataattttaagccattttccagaaagatcatatagtacttgtacatttgtacagtatatgtagtatgcattgtatattttaccacattctggtcaacaaatgtctttattaaagaataaaaagatattactgaaaaagacaaacttagctacttttgtaggtaaaaattataagccttaaaaatctgcatttcttatattattaatagctaaaatattgttcatgttcattgcaaatgccacttcatgtccttaggccatttttctattagttttaagtgtttttcttacatcaatttctaccagctgtttatatgttaaggatattaatattttatatttgtgatgaacgtttttcaaagattagacaaaatctacatgtttacatcatatgatgtattaataatttccagagctcccaccctctttaaagtgcattcacatttatcattgttcttatgtcctaaacttgcatctatttctcccttaaactgatattttctattttggttacagagcccaaacctaagaattaagtgtacactaatttcatgtatatcagaatctgttctgcttaattcttcagttcaccttatctaagtaatttctctttcacatcataagagaattaaaagtaattaagatccaatccaagggctatggactagggtaaagcctgtggtacaacttaatggaagaaatattttcttccttaggagttctatcagttatacttgagcccattgttcttgaaagagttaatgtcttatttctaaaatatgtctattatagattcaagtaaatccagctacacttacttaatgcacatatccagtacataagagaaatggaagattcctagcctgagtgccaggaaatgcagtttagatatggccctgccatctttccagaacttgatttccttcccagctacaaaatgagatccaaaccagatgatcctcaggaaccaatccagctctgaaattcgacaactttgtgattgttctataaaacaaatattacatttccctccaaaggatcttctgggattatttgcatctgttttagaaagattggaggtgggaaggggtcaatttttaatggctgcaggtgttttacaaatgtcaaagatacattgcttgcactgatagctaggtttaaaatcttcagaaaataaatgcataattagatgtttccagcatttatatagtgaatctgttcggtctttcatgcttcaaggagctaatagaacctaatgcttcctttgaaatcagtggaagctctaaacccatctaatgtgctagcttataactaacagaaaaattgggtcaatttttatcccactgatgaaaaataaatcaaacaagtgtatcttttaaacagcatgtaaaccatttaatacttagtgtactaggttatgtgcatagttttgggaaacatgaaagtgtgtgaccaaacagacttcaaatacatcatttttatacattcgagggtggttatttaaacaatgcattgatgaatccattggatattgctaggggtgggaaaaaagctttgtaatcacttgcatccaaataatacaagtttataattttatttttataaactttatgattataatcatattcatgtatatgaccgtgcatgtgttactgttaataacaacttgtgttttaagacataaaatggttttataatatgctcatggattcctggattgaacctgacacctctgggtttacttaacgtcctaaaaaaagaaacagtactctaatatggggctagatattactgaaaaagtcaactagtagcagtaaatgtcaaaattcaccttaaaatggcatctctaattataagtcgacagtagcaaagcattggcagtttccatgatattacatgctttacaacctcctgcagctgccagccaaatctccgtttctcttctacatttgcttttccttcatgacatttaatcagtcaacaatatgaacgctggagttctcctaagccaccctacagtttaaaatcctgactacttcatgttcttctgaaagtggggcggggagagcagcaagtctttcagaatgagatctgtacttatcgatcacagcatcagcagggaaattggcctttgtaggggtgaatgtggttcgttcactgagaaaggaaaaactattttgggttaaaatgaaggcaaaacaattcaggcagctgaagaggcttctgaaaactggaaagatggaatttccagggtttgggcaatgaggcagagactaaatttatggaaagcagacaggagaacaacttcaggttagtctaaaaaaggaatctggagagagcttatgtagagaaaaatcacacagactgaatcatacgtggggaatgaatagagggaaaacctgactctgggagctgcgattatagaggaaataaaggcagtaaagattaaatatcagtccctaacactgcctcaaaaaagcctgacaatatattcacagctgggtataacctctgcaggcaccactaagtagtccttccgttctattgagttccttccacagtttgttcctcccttaaacctctcatgagaaatcctttccctcgatatgctgtatagcgtgttaaagtgtagtctgaggaccagcagcattggcatctcctaggagcttattagaagtgcagaattatggctccactcaaatctactgaaactgaacacaatttttccaagatcgtagatgattcatgcgcacattaaagtttgagaagcactgatctacaacatatacgatgtgctgtctaagacttttttactgcatatcaaaacataggcagatagattacaactgtacatcatttattcattctcttaacaaatactcactaaacacaggccctattctcaaggagttggcactttgctaccagttattgaactcccttccgttctctgcattgtgtgaggtgtcagggctagaaggataaatatggcattgtccctgcccttaattagatcatagatatgttaggaaatagttaatgcaaaaaagtgtcatggttttaatgctaaaaacgtgtacctggcactgggattacaggagaacaagtattggagacatataaggaaggtggtgatcaaggtttttagaaatggaaaagtttttatagaggtgagctgagctttcaaaaaaaaaaaagctttttttcttttttccaggtggaccatggggcattgtgggcaggatgaaggaagggttagaaagaagggtgtacaagggagaggaaacaatcttaacaaaggctcaagggcaagaaacaggttggcctattcagagaactttaagtaattccatatggctggatgataggttttgaggagggtggattggggtctggtggtcagagataaggctggagagcttgacaggggccagatttagggggctgtattgtagcctaagcactttgggattgatcctacagagcagcaataagaagtcactgaaggttttccagtaaggcaataacaagatcacgtttgtgttttagaaacatcactctggaggatgtttggggaatggtgattagccaatttggctgaagcacaaagtacacagagaaaagtaaaggcagataaggctggaaatgtaaatttggatccagatcatagaggatactgactgccatgctttgtactttgtaggcagtggggagacactgaaattttctgagcaagagaatgctttagactgggaagagactaaagacagaaggccagttagaaagttattgcaataatttaggcaagaggtaataagaacctgatgactctgagaatagaaattaacagatagattcaagaagcaggtgcacaattataagcacagtttcattactcattttaggataccacaatttcatacataaatcagatctttataaatgtcttcattttcacatcctaatatagcatttacttctgtaccaatcactgggtgagatactcttaacgttctttgggtcaccaaggaaaaaatctccttcctgttgatttagtttgcaggtccctgtctcagttccatgtggaagccgctgcatgcctctaagtcacccaaacccaaaataaaaattttgttacagaattgttctctatttgcctctttggttgtttctcaaccctgaatatgttcctaggaaggcttcttggttattctttattcactttcaagaaaatagccttcccttttcccatctccagccccttttctagtcccacatttttttcacttagaagcactgattccactaggtggtaggtagggagatcaaagtcacatttccagttctcagtttttttttttttttttttttaacaatgtgagtaagttgtagggtaggtacatgttgatcgcatttcatatacctcaactgctgccagattggttttttgtatgatttatggttatggagctttatggctggtgtgaggttattttgaatttatttagaaagctctttcaagtgtttcagtttcacatcatagaatatttataattctgggtcaggcatcatgtttagcttgacttccaagatacagaattccaaacagccatttgctcctctaaatagatagatagatagatagatagacagacagacagacagacagacagacagatagatagatacatagatacatagatacatagatacatagaaagatagaagcacagtatatctgtttcctgtacatcaattttcctggtactggatggcttcattctttctaattcaagacccaccaggcctcgagaatgattagaaacattcatgctttaatattaatacttacaaaatctccctgttcttatctgagctttgcatttttgttaagatgcttagccagaatggaagctgcccacacaatgcttgtataaaaattatacttgctcaataatattcatatctccacccactcttgagtggaacagaacaagcattatgatatgcatgtacacatttgcataaaaatataccatacacaaattcaagtttgcatgcccagttccaaatgcacaccaccatagaaatgcacatttgaaaaagcatgcaatctcaatgtccagacgttttcctccctagagagtgatttttttcctaaaatgaaagaataataatagccttaatttatgtagtacatttttttccattctcctccctttacaagagatgagtcaattattttatgagcaacttaaaaaagcataaattttttcttcctttacgtatggagtaaggcaaggtgtcccaggagactagttcctcatgcaaattcaagggtgaagtgaaatttgtcaatatattcttccttttatgacagtctttccttctcttacagctacctcaattctttgccagccagctgagagatctctattgaagaaatctcttggctaatctcccagtttcccatctcttactacaaaaggtttcaattcacaaaacacaggctgacacaatcctattgagtcctcgcgatggtcttgcaattttgtaaactcatagagcagatgttatatttatttaacaaacatattttccacttctaagagttctttcttttttctatttacgtgttgtatttttatttcttcctagttttcttcttcagttttaattttttaagcttttaaaatttttttcatttttaattttcatgggtacatagtagatgtatatatttatggggtacataagatattttgatacaggcatataatgtgtaataatcacatcacagtaaatgaggtatccctaatctcaagcatttattatttctttgtattatgaacattccaattatattgttttagttacttttaagtatacaataaattactgttgactatagtcaccctgttttgctatcaaatactagatcctattcattctattttttttaacccattagccatccctgctcccacctggttcccagctacccttcccagcctctagtaaccaccattttattatctccatgagttcaattgttttaatttttagctcccataaataaatgagaacatgcaaggttaatctttctgtgcctggcttatttctattaacataatgtcctccagtcccatccatattgttgcaaatgacaggatcttattatttttatggctgaatagtactccattgtgtataagtgccacattttctgtggtacattttcatttccatttgtctgctgatggatgtttaggttgcttccaaactttcgctattgtgaatagtgctgcaataaacatgggagtgtgtagctatctcttcaatatactaatttcctttccttggggaatatacttagcaatgggatttctggatcatatgatagttctagttttaattttttgaagaacctccatactgttctccatagtggctccaccaacttacattcccacgaacagtgtacaagagttccgttttctccacatcctcgctagcattcactattattgcctgtcttttggataaaagccattttaattggggtgagatgatttctcattgtggttttgattagcatatctctgataaccaataacgttgagagcaccttttcttatacctctctgccatttatacgtcttctattgagagatgtctattcacatcttttgcccattttttaattggactactagatgtttttttcctgtagagttgtttgagttccttatatattctggttattaatcccttgtcagataagtagtttgcaaatattttctcctattctgtgggttgtctcttcactttgttatttcctttgctatgcagaagctcttcaattggatgtaatcccatttatccctttttacttggcttgctggtgcttgtggggtatttttcaacaaatctctgcccagttgaatgtcctggagtgttttttcaatattttcttgtagtagtttcatgtttgagacattagatgtatgtctttaatccactttgatttgatttttgtatacaatgaaaaataggggtctagtttcattcttctcgtatggatatctagttttgccaccatcatttattgaagaggctgtgttttcccaaatctacgttcttagcacctttgttgaaaataagttcactttagatgtacggatttatttctgggttctctattctgttccatgtgttggtttttatgccagggaaaatattcttcatacatgaaggagaacttggatatactattcaagggtaaaagattttttccttcagcactttaaatatgtcatgctactctgtcctggcctataagggtctccactgagaagtctgctgccaggcatattgaaactccattgaatgttatttgtttcttttctcttgctgctttcaggatcctttctttacatttggcctttgggagtttggttattaagtgtcttgaggtagacttatttgaattgaatctgcttggtattctatcacttttttgtaattgaatactgatctctttatctaggtttggaaagttctcttttattatacctttgaataaacttcctatttcaatctctcttcatcctcttgaagaccaataaccattagatttcccttttgaggctatttgctaaattttgtaggtgtgcttcattgttttttcttttgtttctctgattgtacattttcaaatagactgtcttcaagctcggttattctttcttctgcttgatcaattctgctgttgagagaatctaatgcattctttggtatgtcaactgaatttttctgctccagaatttttgcttgatttttaaaaattatttgtctttttgttaaatttatctgatagaattctgaataccttctctgtattatcttgaatttcaaagagtttcctcaaaacagctatttggaattctctgtctgaaaggttacatatctgtctctccaggatgctcactggtatcttatttagttcatttggtcaggtaacattttcctggatagtcttgatgcttgtggatacccatccgtgtccaggaatttaagttaggtatttattgtagttttctcagtctagacttgtttgtacccattcttcttgggagggatttccaagtattcaatggaaattgagtaatgtaatttaagactttggttactgcagccatatctgcattagggggcaccccaagcccaggaacactgagacttttagagacttacagaggtccagccttggtggacctgagagagaattgggtgagatctgagagaattccatggattatcaggcatagaattttgttgtcttcttttactttccactaacaaacatagtctttcactctgtgctgagctgcctggagatagggaagcactccctggagggcacaaacactcctgtggccacctccactgaaattgcactgggtcagatctgaagccagcacagcactggatcttgcccaaggcctgtggtgaccactgcctgactactgatgatgttcactcaaggcccaagtgttcttaagtcagaaggcggtgaatccagacaggcttgtgtacttcccttcagggaggtaagctcccacttgtcccaggatgggtccagaaatgctgtccgggaaccacagcctggagtcagaatccttaggaatccgcttggtactattctactgcagctgaactggcatgcaagccacaagacaaagtccttcccattcttttctctcctttcctcaagcagtagtctcccctgtgggtaccactgccccaggcccatgttgtgtactgtgtggctattgccgatattcactcagggcccaaaggctcttcagttagcttgtggtgaatgctgccaggcctgagtctctcctttcagggcagtgggctcccctctggcccagggaaggtccagaaatgtcatctaagagctacggcctggaatctgggactttaagagcctgctttgtgctctactccactgtgaccaagctggtgcccaagctgcacaacaaaatctcctttattcttccctctcctttcttaagcaggagtctctcctcgtggccagctctgctcagaatatgctgggccatgccagaagccagcatgtctctgagtctcacaaggcacgtggcaagtactgcctggttaccactgatgtttattcaaggcccatgggctctttagccagcaggtgatgaatcttgcctggatgatgtccttcccttcaagatagtgggttcccttctggtgcagggtatatctagaaagacagggaagatagtgcctggactgggagcctcaggagttaggcaaactgcctaagaccttatttgactgtggctgagctgttatttccgagttgaaagatgaagtcccctttactctcccatctcgtctcctaaagtgaaaggaaggagtctctctcagaactgtgggcttcactgccttgggctgggtgaggagtggtgcaagcagttccttggctggtgtcccactaggtcatgtacaccccaagtccaatggcttggaaccaagcaaagggctaagatttgcccaggaattacagtccttgtggcatagaccatctttcaagtttatttaggacccaagggcactttagcccacagtggtggggctagccagaacttgggttccacaagctggaacggataattcccctctgactagggatgctctaagtgctccctcataggctcttgctgacttctcccctgtgttgctttccactatgatggggcagcacttagttgcaatgcaaagtccagcaatcactgcattcttcctctcccaaacacacaaattctctctccatgccacactgcattgtcagggaatggggcagggttggtgtaggcaattcacagctgtctttcctaccttctctttcctagatatgatgttaaaaccaggtactgtgattgctcacctaaattttggttgttataaaggtggtttcttgtgtggacagttgttcaatatggtgttcctgaggtgggggagtacaatcgctggagggttctattcatccaccttgttccacttctctccctatttcttcaagcttttagaaagtatctgttaggatgtattaatttcataaattagcttttgaaagttgattttgttagatgcattactcagttttagatttccttatgtatttttgaattctggttttcaggcgcccatcctccctacttctgccttgcccctgaccttggcttttgacagtaatcctagatccagtctccactttcgcacaaaacttttagtcctctaccaaacagaaactgagactctgcgtcagaccatagtagttcctaggtctcaatcctgtatacttcttaggtttctattccatttgagggtcactgaaatgttctatcttgcttttgaacttggccctgtcttttagattttttagtcttaatttctttcccattgttatgtattataaacttatggggtcatattgacaggaagtttgtggcatcctcattttatttatttatttttaattttatttttgtatttcctcagagacctttgttctgaacctcattttacagatagaaatgaactgaaaaaggttcattagcctgctccaagttgcaaacctaatcaatggtacagtctgggctaccatttaagtctttcacttggctctgatgatcaaaatttatttcattttacagagagctgctctcagtgaactgctgatcagctgtgataaagcaaaaaaagtaaataacttagagtcagagaacctgaactcaagttctcactctgccaattactagtttctcttggcctcagtttgcaatattgtataacagcaatacagtcatgtatcacctaacaacagagatatgttctgagaaatgcatcattaggcaattccatcactatgcaaaacaaacatcaaagagtgtacttacacaaacctagatggtatatattttttatttatatatatgtatatatattttcttatggaaaaccaaatgccccagtaccattagtaatatcaatcatttcccctacttgatctgcaatgccaatatccagtaccagatatcaggtttctagatatgctctattttaacattatgacccaaacattgctatgtgacaaatgactatattaccaattaccttacacagtggtcataaaattaatacatgtgagaacttttaaaaaaaatgcaaagcactatgtaaatgtgaaagtttaaacagctaaaagatttgtcttttcaaagatatataaataatatgtgtttacttctgagaaataataaaatacagataagcataaaggaaagaaattgtttgcaatgtaatttagcagtgtattcttctagatttatctcaatatatatatttaaattagcaacttaatcgagcgcacttgtcaaaattttatctatatccatctatacagtaataaatcatgaaactgtctcctcaagaagttttggggaagggttttgacacaaaatcaggtaaagtaacattaggttatttgccaaatatagcattaattgtcttaccttgatttgtcacagtctttgtgttcaggtctcaaggacaaagcttccatttagatgaagcctttcaacaaactatttgtggattactcttctatacttcatggttgcaagctagagaatcctctttagctatttggagcagaagtgaatcattctaggtattaattagctcatggaatcttttggagtgctagagaatcaagctcagatgtttcacaaccagaaacaaggcatccagcgttaaagccaacagatgaaatatccacgcacactacccgactattctagaagaactgcacattgatttcacacatgagtaccagtacctacacctagatttaagagatttcactaaaactgtccctaaagaaccagacatctctatcaccatgcttgccacatgtggctactgccttctctgttcccttctgcatctaaatttgctcagtagaaccaaattcccaatagaaatgtagcttcaaggaaatctagaaataaagttctgttttgttctgttttaatttttcagctctatggtaggaaggtgagatataatggatacagaatgggtaatcagtaagccagtctgcagtatctggtaagtactgtaagtaggtagaggtaggcactgtaatttcccccattttacagataaggaaattgagccttagaaagattatgttatttggtcaataataaaggtatatagaaggaagcaaggatttcaacccaggtattctgatcaacattcaccttttaactactacaatatttaataattacttcattacatgacttctccttagaagaatatgagtgactgaagaacaataattctttctaattcagtaagtatttttcagtatcaaattctgggggctgcattcattcaaaacttcatttagtcattcaagacttttaattaaatacctactatgtgccagtactcttctagagacctaggaatatggtggtgaataaaacgcgcatagttcctgatatcatggaggtcagcatttagtgttagagttatcaggtgaaaaagtatgcattaattaaacgcgactaaaaagatatatgaaaataagagagcatttaaatgggagatttaagctagcaggtgcaggcaaagaaagatttcctagggaagctgtttgagttatagagacctgtaagatgagtaagtatcagctagcctaagggacaggttctgggaagacagtattgtaggcacatggaataaatagagtatgagatgtcctggaggttgaaaggaggtcaggggattgaaagaagtcaagtgtggctaatcatagacagtaagtaaaaactgaccctgcgataagtctaaagaggtagaaacccaaccaatgttcattgaatgaataaaggtgtgcaatctctagtagatggtagctgtgatgccttctaaacttcctgcttccactgagattccatgattccaaaagaggcagtatatctttgtatatttagaaaagaaaaggcgaggccagagtggtaaactctcctaaaattatcaaaacatattgatagtctacattaacactttagaatgaatcacttttgtggatgctatggattctgcaaggagaaaattagaatggacccatttgtctaacacctaaaagtaaaatgggaaagactaacagaataatttagaataattaaaattaagtagattagttttttctcttcttctttatttgacctttgagataatgttttgtctttatgaataaagaaaaatctttagaaatttgcctaaagctccttctcaaaacaataagtgtacagaatgcttacatcaagaatactataatttatttttaatatatttttaatcaaatagaaaaaatcaaactgccctatttctgtcaaaagaaaaatgtgaatatattccatctatattcagtaggcagaatcctcaaaataactaataccaaatacaagttttcaaatctttcaaagatttacattatgtattccaaagtaacagctaaaatcatatattaacttacacatatatcttttaagtctaccaataaaatgtgtgaccattgaaacacatttagtgatgagcaggagccacattcaatgaagaaaattaagtagcagtccagcctctctagactacatgagaatagatccaatatcccatgattcacaattgtttttaaatacatggtttatttctctattatttgaagtttgtttttttacacatatatctgaacttcaaacactgtctgacattcctgaaatagctttaatattacttttctttatctcattgccttctctcccaggtcaatggacaaagcttaaggcttccagcataaggctaatccctttatctgtcctctgaatctcattgtcagctgctttttcagggaccttacttaattattgctctcctctcagcatctacaaccttttcctctcaactaaatctttactctcaccatataaccatgctaaaatctctgtgctggcaaaaacaatcaaagacaaataataaaataacccctcaagtattctctcctcatctgcaattcttgtcttctcttttatttacatccaatatttttgaagagtcattggtacctaccagcaattctttctcacctctcactcacctccactgcaaactggcttttacccttatgctccaatgaaattactcctgaaactgtcacagtgaccttttagttgctacatgcagcgggcacttttcaagttgggttgatccctcaggagcatttgatactattaaccagaaatttcctggagcatatagaactgtaaggaacaataagccatgttcccagaatcaccacatggaagggcacccaattaacactcaaataaactattctttgtgcactaaataaacctgcattgtgttagaccaatgggatttataaaactgttccagcacatagcattacttaccttgacaaacacatgagtcttattaggtcattcttaatctgtctccctgattacccaccattcccctgctgtgaactctatgccctagctacacaaaccactgtgtgtgtatatgcatgtgtgtgtgtttgtccatgctattctattcttaattcctttcttcctattatttgttgacacattcttttagtctcacttacagcctttgagaaagcttccctgtttctgacaagcatatttactccatttcacctcatatatctctctttgtagcactcatgctattgtatcataattgttttctgtctcttaagaatggattcttaggtttttggaatatgtaaattacaggaattctaggcatgctttatcaaaacaaggttgaaatgataaacactgggcccttacataaaattttgtaagaacatcaggttctgacaaagaagaacgaatttgtggttttatattttgtttccctttagttaaaccctagatatcaaagatttataatttcttaaaaataaaatcttgcctacttttgggcaacaaatacatgaaccaaatatcctttgtatctaatttccttagaggtgattttctatgcataacagaattatcttttgcaaattatatttgcatatgatcagtcacattttttgtatttcaaatgtattaatatttcaattagctaaaagcaataagaaaaagatttatctagtctgctgtggaagtgctaatataattttaaaaaacaactaagagcactaattttgttgtcaatttcatatccttataattacctcttaaataggctgcacttctctcatggtaatcactgctgttttcaaatggcttgcaaagaagaaaagcatttaagctaactcctagaacagatgaaactatttattttgacatttgtcggctttggaccatgtcctttccaattctgaaaaagacaacctgggaacttacgtgtttagaacaaataattttaataactttggaggtgatttaaaatggagccaattttaggtgtcagataaaatgatcctaattcatcttatatcaaagatactgggcagtgacattggttggggtgtggtcaaattgttactatgccaatcactcagtaaaggagtctgaatcgtcagtggacaagatctagagatctgagaaataactcctttctttgcagccctctctatgatagacactcaagaatgagagaaaatgtagggtcattcttttaggcatggtcatatcaattcaaaggaagacaaaatagtttaggaagtggattctaatgcaagagatagtttagaggaagaatggaaagtgacgttagtatagtttatgaggtagtggtttcagttgttaaatacagataaagagaacagaagaatataaatattctaaactgtatcagaaagaatcatggaactttaaaagcataaaggactttagagagacatcattttcgttcagtcctttcattttaaagaggaggaaactgacctttaaaaaggttaaatcacttgacccaggttgcacagagagttagtgaaaatagtgtctgtgggttcctatggtggggatagggaagaacatgtaagggaagaaaggaagtgggtctcttttcattctgatccagaaacgcaaatcctttaaaaggtaggcagacctttttaaaaaaacagctggcatcacctgcggagctgagccaaatgctgtggttggtacccagcctgagcctaaaaaaaatgctctttgtaaaatttctctttgtgcacggataaccttcacaaaattagttcatgcttgcttttaaattactttgcacctgtcctaatcatacctgaaggtggcaatgtcctaagagttacatagggtttgtaaaattgggctactggcattatttttaggagcactctgccttacttaatttggagaacattttttttcctactaatttcgatgccacatgctttataactcaactttaattttcctccaaagatatccaatttattatccttgtctttagtgtatatttgcttcaagagacagtctccacaatgctgattgggatatcatatgaattccataaattcattttgaagtccttggttttagcttataggatttctacattttgactcacttttcttatgtattttcttgatagttacccccctgcctaaacaatttaactcttccttttctttttttaacttagccacctccctaaatgcatgtatacattctctctctctttctctctcacacacgcacacacacacacacactctctctctctctcctccccttccccaccaccacacacataaaatcataaaagctgttttcccaaatggagaggtatgaagcatgtgagaggtctggagaagaccaggagtcataaatgtgcacaagccaacttaaaatatgttatgaaggcatcagcgagaatgtcagagtaggagactccaatagccttactctccactgaaaagcaaaaaacaaaacgaaacaaacaaacaaacaattctggcaaaactgtcagaaacaaagttactgaaattctggaaaatgggatgtctgtgaaattctgggatgttattagatcatggggcagatttcccctttggtattgttttcgtgagttatcaaagatctggttgtttaaaatgtgtagcacctcccccttctctctcttcctcctgctctggccctgtaagacgtgcctgcttccccttcacctactgccagtcaaaggtttgcagcaaccaagagaattcttaatcaagagaaagggccactgtaacccagtggaagaggtttatagtattttaatttatttgtgtccatccccaccattgctggcttaatggtggtcctgaagaaagcaccttgttctaccagtgtgggtcctggtaccagagggagcagaacagattttgttctgaaaaaactgtggttgcctgttttgacctatcaggtggtttcctgaaggactaacacaggggacttgcctttattttgcctaactcagaactctcccagggcacaaacatggctgcacagacagcatctatataaatacttaatagcaaatcaaccagccactgctacgcccatgagacaaagaatattagatgggataaacaataaacaaaacaaaaaacttgagaagaaggctgggaagtgagatgcttgggggagtaagggctttgagaagcttccacatattcccaggtatctagaaggtcacacacatgcgcagaacaggccacatgatcaaatgatcttgagaagatcctaaagtctcacctttgggtgaacttcagactctgtgaaagcaggaaatgaagttgaaggcagagttgtaaactgcttagctgagtgttaaaggcctgccccaacatacacacagagcccagttgcaaagactgagagagtttttgttttatccaggcatttaaggaaatctttgtcaaatcactagctgaccattgagttagtagaacagagatttcagtgaccacagaggataaaaaatactgtcagtaaaaaattagaaaagtcactaaacatacaagtacaacccaagacaagtagcaataacaaaaacttggggacaagaagaatcggatttccagttactataatatttaaaatgctcagttttaaacaaaaagatattagacttccaaaaaaaataataaagtgtggcccatttacagggaaaaaaagaaatgaatgtgaactgtccctgaggaatcctagacactagatttactagacaaagagattaaatcaactgtcttaaatatgtttaaagccatagacaaagaaccaaaggaatatatgaaaccaatgtctcaccaaataaagaaggcagaaatgatataaaggaaacaaattctggagctgaaatgtacaagtataatactgaaataaaaaaatctctagaaggtttctacagcacttttgagcaggtagaaaaaaagaatagaaaacatatagataaatcaattgaaattatccattctaaagaacagaaacaaaataaatgaagataaatgaacagaacctcagcaacctttgggatatcattaagcatatctacctatctagctatcggaatcccagaaagagaggagacagaataatggacaaaagaccaaataatggctcacagtatttctacattttggctcacttttcttatatattcttcttgatagttaccccctacctgaacaaatcgagtcttccttaaaaaaagacaaaaaaataaaaaaactagctacttccccaaatgcaaatttaataaaagaaataaatctacttattcaagaagcccaacaaataccaagtaagataaactccaacagatctaaactgacatattataatcaaaccatcaaaaaccaaagcaagaatcttgaaagaagcaagagagaagtaactcatcaggtacaagtgatcatcaataagaataatatcttatttaaactatagaagacttaagacagtgaaatgacttatttaaattgctgaaagagaagaactgtaaattaagacctatattaagcaaagctatcctttaaagatgaaggagaaatttagacattcacaaataaacaaaaggtgaaggagtttttcactaacagactggtactgtaagaaatgttaaagggagttcttcatattgaaacaaaaacacactagacaacaacttgcagctacatgaagaaataaaaatcaccagtaaaggtaactacataggtgaatataacaaacagtattattgtaatttcagtttgtaactcctcttctttttcctatgtcatttagaagacaaatgcataaatcaataattataaatttatgctaatggggacacaatgtgaaaacatggaatttgtgacaataacaacacaaacacatgggagagacctatattaaagcagagttttatatactattgaagctaagtgggtattaattcaaactcgattacttataaatgtaagatactaactgtaattccaaaagtaacctgaaagaacaagtgagaaatgttcagaaaagtaaatgagaagggaaccaaaagggattacaaaaggaaattaaattaataacaaaaatgtaactaatatgaaagacaataatggaggaattaaggaacaaaaaggttataagacatcagaaaacaaatagcaaaatggcataagtaagttctttgttagtagctactttaagtgtaaatgaattatactatccaattaaaaggcagagattagaaaatgatccaaatatatactgtctacatgagactcattttagatccaaagacacaaataggttgaaagttaaaggatagaaaaagatatttcatgcaaagagtaaaaaaagaaaaagctggagtggccacactaatatcatacaaaatgtactaagtcaaaagttgttataaaagaaaaagggaggcattatatattaataaaagggtcaatccctcaggaagatgtgacaattaaaagcatacatgcacctaacaactgagtcccaaaatatataaagcaaatttgacagaaatgaaggcagaataaacagctctacagtaatcataggagatttcaataccctattttcaataatggataaaataactatacagaaggtcaataagaaaataaatgacttcaatgatactgtaagccaactagacctaatagagaaatacagaacattctctggagctagatatggatgatggatatacaacactgtgaatatactaaatgccaatgaattgtataatttaaaatgtttaaaatggcacattttatgttatgtatattttatcacaataaaaaacgtttacctattgatatggtttggatctgtgtccccacggaaatctctgtcaaactgtaatcctcaatgttggaggtggggcctggtgggatgtcatttgatcatggcgcagatctcccctttggtgctgttctcatgatagtaagtgagttatcccaagatctggttgtttcaaatgtgtagcacctcccccttctttctcttcctcctgctctggccctgtaagatgtgcctgcgtccccttcacctactgccatgattgtaactttcctgaggcctctccagctatgcttcctgtacagcctgtggaaccatgagacaattaaacctcttttctttgtaaattatacaggctcaggtattttttttatagccgtgcaagagtggagtaatacagctatggacactcacaaggaaacaatgcattattagaagggattaaaaactatgatgaaaaaagagcaccaaattatttaacttaataaatccatcacttctacaaacacaagacaactgtagacatcccagttctgaggcaggagggtataagataaaagaagctgctaaaaattagtagtccatatgaaaataaaaacaaaagctaaaaagtggaaaaccatgaaaaagttttctgtgtgagaaagaaatgagattggggtacaaaggtactgctttttaaatgaagaattctaaaatgatttaaagctttaaactgtgtgaatgcctaacttgttttaacatcaactgatgtttaatattaatgcaaacatcaattaattaaacactccaacccctcaaatgtagtgtaggaaaaaccatactcacttcttaggctcagtattttcaaaatgattggatcacatccacgtctttctgaatgcattcagctacggtcacttagttctgcattggttttgtgtctgtcttaatagcaatcactccaaacctaatagtctcagtcacagctctcaagtatttttctcttttcccaaatcattctcattttattttgagaactatctcccttatagtaatctaggtttatgagtcattttcaaaatcacaaagtgctttatcattccactttttgaaaatctctagaatgtaagtattttggaaaaaatcttggtattttccaccttgtgagtctgctgatgggcagccagtaaagtcagtgctgttgaattaaaataggcaacacaacaagacaagggacattggtcatgcaagtcttatttcctgaggcacaagactttgaaatgagtcgtacaggttttacgatgatcaactctcagaggccaaggcccactaaactaactatatactaaaaaatgagccattgtaaaggaatattttcttgtaattttaaattaaactttttgggggtggtcttttataatttttaattttggtggtaatcctggagtttatttgcactatttttagtttttaactttttttttttatttttgagagttatgggaatgttagtgtttcaacctgtgatggtagaaaacacattttaaaataagacagacctgggtttgaattacaaagaacttctaagtcatgtaagcatagataaattagtgtcttttcttaccttcggttttcttctctataaaatgataatgtccagttttccttgttgtcatgaggattagaaataatacagataaaagagcaatcacggtatatgacaaagaacaggtgctcaaattggtggctttatatttatagttaaagcatagaagtattaaagtcctcatgcctcaattagaccagttcttacattttaccagaaaggaagctgagaatcaagaagagtgatctgacatacatcaataagataaagctagataattccagagattagtactgaggtttcctgcttaagcaacaatctcttccttcccttgggctctcttcactatggatgaagtctactatttaaaggaaagtttaaaataatttattgaacataggagaaagcatacctcagaatattcggaaatgtgacttagatgcaccttctgagattgaaacttgaccaaagatgacccacattttctgaagactttgccaatgtctgcttgttagtgacttggaaaaagtagatactgaatatgaaaagtacaatttcttcttgcccttcattaaaacaaaataaaaacatgttctttactccaagactaagtctgacctgctattatatttgataaattaaagttcttctaagattaaaaaaaatccctttagcaaattgttccagctaacatagtacccagcatacaataaacatttaataaatacttgttggatgaacaagtgaatgtgtacgttctcataatgctaatgagaagtaatgattaaaacaaaagtataaataagaatgacagaaacatcaagcattctgatgaggatctgggaggggggagtctgctatgagaacagcttgctcagacagagaaacaccaaacgacttcaaaaaaaaccacactgacttgagttctggcataactacctcactgcaggcaacaaaaattctgctttgcctttaatcaatgtaatgaaactgtgccttaacatgcttccttatttgcatatctcttgtaatccgtgttgcatacaatacaaaaagatttattataaagaaattaatatatcttgagaggccatccccatcaggcaaaagacccatctgaagataaaaatcacaccatttataaaaaccttagaaagatcttacaaatccatgaattatttacttaaaaacttaaacatccagagattgagttctcagctctcattggcaaatttgctcctctaaacatttcctaatgcacatgaaaactatttccctgagaatccagttctctaagtagtcgagttatagagtctattatagatataactaaagattctcaataacttttaaaaactaaattatgacatagtctgatgaagggtacatttcaccttataaactgcttcatattgtaattcaaattgtaattagactcttcacccctaaacagggatgttatccccacaagtttcactgtacacaaaactgaatcacattagcccaagccccggttacccttctcctaattagaatctttgcttctccccagtatgaatctcacaaggataccagaccaatctcattagaggcaccacagtatgatgtggtctttagaataagatatacatgggtgaaatgtggcttcactccattttatctgtgagctcttggatgaatctcttatctcccttatgtctcagtttccttacctgtaaaactgagataataccaatcttataaatttatgaaggagagtaaatgtgtgtgttgtctgtaaaaatcctggcatatgataagcacataataaatggcactggctattactatcatcatcttgtaacatactggtttctcatgtcacttcatacacaaaaaccacaataagatacccaggtcatatcaaattaaattcaatctcttctattgtgtttttaatgctttctatattctgaccagtttcatcttctctcccagaattccagagcataaattataactctggtcaatttagtttccttttaatctttttcacttagcatgtcaattcctgcatgtcaataatgttgctattattttctttcactttgcttgctccattatgccaggaccttcacattccttaagattttagatcatgtcccatccatttcctctatgaaacagactcttaatgacactagctcactgctttcttctctagcttctagggccaggtcccttagaggaactgggaaaggatggaatttctgtgtgatgtactcacatttttctctatgagagcctgctcttctttctatgtaatcctatcactttgagcatttattttacactgttatggaggccactagtgaatactaaagtaattttcttttccattgatgttactaggattatagtccaaagaaaggatgcatctatgtttatgcaaattaacttgatttcagctaagcttcttattggcacactgggttctctcctgcttcatgcaagataaaagaagtatcacaaaaatcttatgaactaactggtaaatataagttaaataatagcacagtgtatatactaacctcaaagaatattaataaatgggtctatacaaccaggaaagagatctttagttatatatcactggggtctgaaatgaaccaatgaccctttttctgttcattagagacaacatggggtagtgtggcaagtctcatatactaattcctgggttctactccacatactctgtagagtaaagcctagaaaacatatgaaaatgttccttgtatggttttggatgcaccagaaatcataaatatagtggtcaaactacatgcttcaaaaccaaagatctgaattcagagtttgtctctgtctttttgtttgtacgtgatgttgtacttacctgaacctcactatttcctcatgttgagtgttaagtgacatgatgtatgtatagtgtctcacatataacagacactcactaaataggaatcatttatctattatttggatgaatacccaaaagaaatgctcattgaacccactgttgtcacaccattaagaaagagaatgaatacaataaatgctaaaatgactttgagtctcgtactactaggccaaacacccataatattaacatggataagattactaagtggatttaggttgcaaaatcaattgcataagtaaaggataggagacctgcagaataataacagttgacaggggagaaaaaaaccacccagaagtttttattgactttaagttcagtaagagataagtatatgactcaaacaatctttgggataggaaatagaaagttgggagggtattagcatatccaacggtgtttgtaccttccacagctcttagtacagtagcttctttacagaaaaaacacaaaggcattataatgatgtgtgatgtcaataaaaggtcaatatgatcactgtattactattaataactaacagtatgatatctaatacttattgagtgcttattttaggcaatataatatgccaaatgttttgcatgtgttatttcctttaattgataaaacatttatctcaaaatctttgtaaataaccatttctttgaatccccaattttaaacccagacagtctgtgacctaagagagcggaattgctaaatcatgatactaactcccatttaataaggtgactgtgcttcaggtttcataattggtaagtggagattgggatagtgctagaattatttccttggctttgatgctaatttctctgtgcaattcactttaacaattacttcagatctgcaatttgaagtatttgcagtcttattcattgttttcctgccacaaatttattccttaaccaaagtttaggttcattctgttattttaatgcctttttagttgtcttttgactaaaaggtgagtaatactaatttgggagaatcatattattcagaattagataagcctcactgccctgcaaaaagaagctcacttctgtttgcttggctttctgatttggtggcctctgcatggagattcagatttcatttctcatttacatttgtcgttttgtcttctaatagtttgcccccttataataccatgtttgctaataactctgctttcatgctgtttgccaatgcagaagggaatatttttctttaatacattacatttcttccctccctacttaagaactatttacccagcttacaccatgtacctgtccatttatttggaatggtatatgttttgggatccttttatctcctttccatatttgaataattatagttattgatctctgtggcaaacctacccttcgtagtgttttatttatatcttttaccttttctcagtgaagagaaaaggatggaaattataataaaattattaaaatttataaaatccagggtctaatcagaggacagaaactacaataattgaacaggaaaagtttaatgtataaagaattagcaactacaacaggggattagaatattgagggattggtcagtaaggagtaaagggtactcttaaaatatacaggaataacagatataaggaacagccactactctagaactgatatagatgcccaacgaagacgcttgcctaccctgaaggctgagatctggaccttgtcagggagggcacagccatggcttgtggaatggcaggcactgaatagaatgctgtgccagcgtaagttgctgaagatctgcccttcagaactttatggaaatctgctctctagaatgccagggaaaactgtttataggcatgtgtctctctggagtctctcctctatgaaattgtccaaagtgggtgctgctgaccaccacgcactggcattgtgcgagcctgatggtgcagttgctgtttacactgaggagcctgctgagagagcatgccagcatcaggaaggaaaattccttcctcctgtgcttcaattgaccaagctgaacgttgtacacgctggcaaaggaaaatatttaaagggctcatctccatttttgcagaacaggcaatggagtataaatttgcagatgagatacaataacttgataactggtacaccaggtaacctgtatttaacaggaatcctggagggccatctggttcaatttcctatcttccagcagattgatgcctaagctatctaagacagatggttgttaatgctattaatatttaaacatgagttccctttaaaacctgctttactctttaaaaaccgaagccagttaagtctatacgtgtttactagagagaattttggaaatactaaaaaattataacagaaaactaaaataagctataattccagaatttagagaaaactaatgctagtattttggtccatattcttctagacttttttttttttggctactcatgtattcatttaaaacttatttagcatctattaggtctaggcacaatagtaattgttaggtgtacagtgacaaacctatcaaatgcctcctcgtcaactgagaatctagtgaaggaatcaaatacatctatttatgtatatataaatatgtataatacatgtatctatttataacactttttaataataaaattgggttcattttacatatgctgatttggattcagctttattcatttaacattatattaaaaatattttccatgttactataagtttttggaaagtgtcatttttttcatgactaaataattaaattttatcatttaaatatggtttgatttcccttttttctattgttaggcaactttttagcattttaaataatacactttgcattatacccatccctgcatgatagttaaccctgtggatataaccatgctcctgagtttaaatctcatctccagcatgggctgagtgatttagagaaaaaacacttaacttctctgacttcagtaagatcatagtacctgcctcatctgggtgttgggtggataaaataagtttaatatacagaaagcacctagaacgctgcctgagaacataagctatttaagtattagtattatactcatcatctgtttatgtgtctgtgtctccctgagatgtaattgccttggtggttttgcctactattatgtccctaacacataacacagtgtcttgtccatggtacaaaatttaatacttatttaataaattaggtgaaaaaaccctcatatataaatcacattactagttgaaagagtataaacatttttgaggatcttgatacttgctaaattacatttcagaaaagtatcaactcatattgtaactacaatacatgataagaatgcccttcttagcctgctcttagacattagatattacaactttttaatgttttctatttttttcataacatattgcattatactgctgctttaatttgtatttattcaattgctaatgaggtggaacatgtttttccaattgaatactattcttcaaattgtctattttctttcccaattttctactaacataaggatgtttttcttactaatttttaggaattccttttattgttaagatagttaccatttttttaatttttatataggttaacatttacttcttaattttcatacactgctttgtggcattcagctgatcttaatttttatgtagtaaaacatattgattattttctttataattagttgcatgattttattactagacattctcccccatgtagaagtcagtaaacacaagacccatacttcattcaatgttatttgaagttaactatttaatccattgaaatttattttaccccctctaaatagtgactattctcaatatcatttgtataattcattcttcccataacatgttgatgcttcccctataaaatatcatggtttttatatttagtagggtttttatattctattaagtttcataaatttctacattctactggtatctacaattttccaagtggtaagtttaattcattacattttcatatttagtagggtctttaaactctactactttccatggatatctagaccctactagtaccacagtttttaactggtaagtttaacacattctagtatcttgccgggaaaagttcctgcctgcccctcactgtgcatgtgtgtgcatgcatacacacacacacacacacacaggcacagaattctactccatcacacatcatccaaacaacaaatattatagaatgccctatatgtagtcaggaattgtgtcagatgacatgaatagaacaacaggtaaaactgacatagtcccatcccttatggagctaaaagaatgtggaggtagaactaaacaaacaagcagggaattctactacagataggctatcctagggcaagtagagtatgctatgagcagccactggtacagccatgggggagaaagaaaagcttgccacagaagatgaaatgaaactaaaatctaaagtgtgtgagatataaagagaaattggccaggcagaaacatcaagacaataatgaaataaagaaattgatctctctaccccattgttcttttcaaaattcttttaaatatatttcatccatttattcattcaagttgctctaatgatccagtatctcatttggtttggaagctcgggatgaaatattgctctgttatccaactttatgcatttcctctataattcaggcacttgatacaaactagtctactacttttatatctggtatctacccttaatgtacatgttagctcccattttcctacctttctctcttgttatatttagtaggatattttattatttaagtagatagtttcatactcattattctccagggttcattgcttactacctatgtggcttgaataaaaccataaataattactttctaaaaagattgaaagaaatatttgtagttaagtgtgccaagagcataaaaaatacagcttataaaaataatacaattattctttctataggagtgctgaggcttatgaaaatagtttcttattgttaaaaaagatataaaaaatgttcctttaaatgaatgatttccatatataatcagcttaacaatatctttaaaaattgtgttcatttacataggtaccactcacctcgtgtaacggggaatgcaaaatatgatgtcattaacccattttgaccaaatatgcctaaagaaaactaatgcttcaagtatcgatcaacatttaacagtatttttaatctttatatatttatttcaggcaggatactagttaatttagtgtaaaccacgtttaattatttctgtttattttatatatcctgatagtaatataaataccaattacactttttacagtcttgtttctctattctttccatggttttggtaaagtgttaatagtatttcattacatgttttcacttgcagggcttgctgtagaatacagctcagtttaaacagtcaattaattttagcagaactgaaattgaatgatgaaatatttctaggctgagaagaaaactacagtaaactcttagcttttctactttgaattggaatttttgctctttttcacttctcagagaatacctaatcccgactaaataattaactgactggcagcaaaatgcattaattgtggagaacagtaagctgggtttgacatccatctttgtcactaacagaatctcatcatggcaagagtcacttaatgtcttcaggtcacactattttattatttgtgaaatgaattaataggattacagactcttcaaagtccttactacctctaaaatgttaaaattctgactctaccttgtacataaaaagaaccagtaattccagtgtgagtgcaggggtttctaaaggccaaatatcgaatactaaataatatactatacataattgcatgatttgttcacaactattcatcccctccctcatcacagcttctctgtggacaaagtatattccctgaccactgattttgggctggtccctgtgatttgctttgacttatgaaatattgtgaaagagacagtgtggtaatcccaagaaaggctttaagaagtgctacatgcttctcatcactttcttaagattatgtcctctttcataagcacagcatgtacaaaatagtggttttcttgagcctgggtctctcaatgaaaagatgtgtggaatagaacaactgacccacgccaagctgaacctagtctgagccacttgcaaacttgtgggcaagaaataaatctttgttgttgtaagccattaagattttgcggtttactggagatcattctgttaagtgaaacacgccaggcacataaaaacaaacacacattctcacttatttgtgggatctaaaaattaaaacaattgaactcatgcatataaagactagaaggatggttaccagaggctgggaagggtagctgggggactgcggggaggtggggatggttaatgggtacaaaaaataatagaaagtatgaagaagacctactatttgacagcacagcagggtgactatagggtgactacagtcaacaacaacttaattgtgcatttaaaaataactaaaagagtgtaattggattgtttgtacacaaagaataaatgcttgaagggatggatacctcattctttatgatgtaattatttcccattgcatgactgtatcaaagcatcacatgtacccccataaataatatatacctactatgtaaccacaaacattaaaaataaaaaaaattaaaatattttgtggtttgtcatcacagaaaaagttgacgaatcaagtactaggtgtactttttagaaaactgataaaaacaaactatttttgaaagtctcatttcaaacgctttattaagtaactccttattatcagggcttttgttccttccttgatgcctggtattgtactgtatcacctaaattaaacataggaaagaagagaaggaaaagtatgttgaatgggaagttaataatgtgtctctaaagctatttctcagaattagtaagtgttcagagtacaaacagatgagaagtttggagtcaaccttctagcagtgttgtcaatatatcatcaatatgatatggttaataaactagctttaatatgattcagtgaatcttgtctgtttctttaaatttgaatatctatatggcattttcaaattgattgaataaatgtattattaaaacctctaaaatcacataatcattgggataactcgtgatttgtttacactttgtaatagcacactgggggtgggggaaatgatgaacatttgaccacatttaatttcaaaggaaaaatttgaatatattttctgttcgcatttccttaacattcacataagtaattaagatgactaaatacttatatcagtacatgaaagcatctatggaaattccaaatgccaggaagaaagtgaagcaaaacatatatgccatgtaggaagataattatacattttaaaagtacattatcaatccaaaataattatgaagaaaatcctaataatcgacttcattgtagacaatatcctaacacatcataaggacattgcacagcttagtgaaatgagatagcatattgctaaaatctattggtgtcttaaaaagtggaggggattttatgacaactataaccttagcaattttatctatacctataaaataacttgatataataaaaccttatactcaccgccaacattagacgagttaaaatttcctgtcagtctgctgagagacttcattatacattatctttacatatattatctcatatccaatcttcataagaaagatcctacgagaggggttctgtcattgtccttactttatagataaggcaactgaggtttagaaacataaaatacattgcccaaactaagtggctaaaggtcagaaaatatgacttaagaatttaaattcttcatgttaaagtgtgcctaataaatggaagagatgaaaaagtccttcaggtcataagcttaatttgaagatattaaatgtctgtcatatccaaagttacatagatggaagcagaaattaaacaagaacttgaattttttattacggtatcttaacacattttactatatatttataaaaatatctgctataaagttcttgaaattttatttccaagcatgtattttacctgcaaagtttcagggtgatttttatagtcccatatcttaataaacgcagtcaagttatctgctaatttttacattttctcctctgaagacagctcaacaacctctaaaagatacattttatcccagtagggggtctaggagcatggaaataattaagttttaaaatgtctttgttattttattcatatttgatgacttaattaagggaattatgagataaatacccaaagcaagttgatcttaagagtaaataattattatttccactagggtcgaattgcacatctcagtgatgtttaaaaattattgtaacatggaggatggttatagatatcctattaaattgtcaaacatattgcaaagattaggcaaatttttttcattacctcattatggttaatgcagataaaagactccttcctctacttagcctataaaaaaatgcttagaaactaaatgtttagaagacttcacaaattccacttttagtaaaaaagacaagtgatagaataggaaggtaaaacttaaaggagaaactagaaactaggcagtaaaggaagggagaaattatagaagaaattatttcccttaataacaaatatttcaataaaatgtatttagtaaaatctttaacagacttgttcattattttaccattgacttaagtaaaaaagcagatgaaatgctatgattaacaaatgacatgatgccaaaggaaataaataatacagcgtataagtgatacaggctaccaagaaatttaataaggtgaaatttagaagtaataaagacaacattttgcattgagatgaaaaatagtcagcattccagcagaggcagatttaccacacaggtcatgaagcttaagcttcaggacccttgatttacaccaacacctttcagagcctgtacctaatgtatatatgataatcctattattaaaggggacctctaaaattatataagcttccgacctccaaaaacctgactatgcctttaagttttaattccaataggataatacaaactatttaactctgaatccaacaaacctttatgcaacaaacctttcagatcaaacaaggacaaataaaatcaccataacccataccagagcatatcttagagacagaagccaacttacatgtaaacgggagatatattcatttgagaccaccaaagttggctccagagcccttaccttagtgagatggaggggacttgtatatataagaggaaaactaggcatgtttccaaatagatacaattagcctccctctcaccaaggggagggctctgaagccagctttggaggtcttaaatgaatatctctcccacttacatgtaaattgacttctgtctccaagaatgcccccaaaaggagagagtccaatcagtaccacccttaaagtttgtaagatcctgggcaaatattttattttttgcaggactcctgtctatataaacagtttgattaaagatgtactgcaaattcatggactcatgcaaagtacagtgatttattaatgaagagttagaataatgagtagacaagcagtatatatatatttgtttattgtacatgtttattgtacaatcagtgcacatgaagattctttgtagtgtctgattactgcctatttctgttcagatccagaaaccataccttcatgttccctattgtcatatgtcccatgcctaactacttccgcatctcccatctgagaaaaatgtagcaatgctattattgttactgccatagctctttggaaactgtgtgtatttaagcaacacagaccattttgtacctgtagttctctaatatcatttacttaatgctgtacataattactcatgacactgcatcatctatcatgcaccctgtggattctgacttcggtgactctcttgaaggttgttatggcattgatggtcatgaacgcaagtcattcccagagtatttcagataatgtgaatgatggtttgttttctggtcatgtttttactgatggtagttttatatcataaacttatcttccaaccatgtgtttcctcaactatttagatcaaaaccactgcattactgattgcattgctgactgcttttgattattgctatactcccaccttccacaaactgccaccaatgaggaagatagacaagggtcctaggggcagtgagagaagagactttctatttctgtaaatgaatgtccattgttcattcagcatggcttagaattggtccccccaccccaaagaacacaatatcactgcatcaattgtagaatactgattgaaaggatccactggccatgctgagcaacaatctagaagagtcttaccggaaaacagaatgatcattcccagaggactgcttgacatgtggcatggagcctgcagagggattggggtaagcatcttgggtgccagtggctgggagtacattgggttgaggatacctcctgcagctcctgccgcccacaagggctgcccacatgggcagacacacaccagtgagcattaacacagaggcccaaagctcaagcccaaaggtcagtgacaaatagttggtagcccagagctctgaaactcatcctatgtcagacattgagtcacccaagtacatatatcagcacaatctgatagaccaatttcatgtgatcccacaaaagaaatactgtggtagccagcaggagggatccactagccaggctgctctcctgaaatcaaggctggccatgggtcctgggacaactcagaagggtgtgagccccagagttcttacaggtcaggtggatgattccgggtatagagagtggagagttgtagagtgcctcaaaggtaagaaataggaacccgggcccatatggatggatcagggcccttaaggcacagggcctgaggcaaaaactacacttccctgggcctaagggtggttctgggtccaattctaaatgagaaagtattcagaacaggtctgatccctggggatcagagtgctgaatgctggggagtcagaagcaacttagcgggcaagaccagaagtggcggtctctatcaggtacctcttctgatggagaagggggcactctaaatattaatagtacaagagttccttggaggtttgattacaaaggagaagaaagaagttgcttaaaatagggtcgtactgaaacaaaattgtataaaaaaataagaaaagaaagagaataataaaaatcaacaaatgaaaaaataaacaattttttacatcctttacatgtcaacagaagtagcccttggactaagaaaatcagcgtcactggacctggatctatttgccctaagagctcatcttttctcttcttctgttctctgtattacagggggcagccccctctggactgtgtttctctagactcccaaatcagccgggctctgggtgggcttgaacagccatttagaagcacttgtgcaagactggaaggtgttaggaagggagaagtcaggggtatttctctccctttctttctgccttgggaagtatctccattgatgactgtcccttttttatggttccattatttccttggttttcttggttcccgggctctgataaccaccatttccttttgtctctcagcctcaggacactaatggcttcttgcttttgctagcctgtaggtcacctcgctgcccccagtatggctcctctattatttcatcatctgtgtaactaactctctgctttatatccctgtgttgtaaacctctataattaaaacagtgtggtattggcccatgaatagacagaaggatgatgaaacaaatagaaagtccagaaatagacccaggtatatatagaaattgggtatatgacaaagttggcatctcaaatcgctgggaggaaagatgatctttagaataagtgatattggttcagcttgatagacatttggaaaaagtaaaaaaaattgaattctatcttatacattatctcaagattaattttacataaatgtaaaaaataaaaccatataagatctagaggaaaacacagtgaaatcccttatatcctaagagtgagggagcctttctaactatgactcaaaatacggaagcaataatggaaaagattgagaaattcaactacttaaaaaaaagaaatggccaaaaaaaatcatcataaacaaaatcagaggacaaatcacaaaccagatgaaaatattgcaacttatatcacaggagaaggtctaatccagtgtttctaaagctcagcactactgacatttggggatggataattctttgttatgggggctgttttctgcactgcagggcattcggcagtacttttggcctctacctactaaatgccaatagcacccctttcccaggtgtgacaaccaaaaatacttccagacattgccaaaaaacgtggggagaggagtgaggagggaggcaaaatcatccccagctggggaccactagtctgttctaatatataaaaagatcttaaaatagtgaaggaaaaattcaaaatccgaatagaaaattgggcaaaagacgtgggcatttcataaaaagaagagaaatggcccctgagcacctaaaagattgcttaatctcactcatactaagaaaaatgcaaatgaatgctattctgagagatttcttacctagcagattggcacacatccaaacatttgaaagaagtctgtgagctacacattactgatggaagtgcaaaatggcaaaagctctttgaaagagaattaatcggtattttaaaaaattatattcagattttcttttgacctaggaaccccacttctatgaatattccccaagagagagagttccaggagaacaaaccaacatatgtacaaggttacttactgctgtaaaaggctgcaagtaattcagatttccatcaatagcaataatggaataaacaatgacatactacccaatgaaataccataatgcagaccttaaaggaagtgaagactgtctttatgtattgataagaagtaatggtcagaatgtattaagtggaaaattcaaggttcagagcagagtatgtgtgtgtgcttgtgtgtgtgtgtgtgtgtgttgtaaaaagaaaattcttaaaaatgataacatagcggatgaatgggaggaataaagtagggaatagatggaaagaagaattttctgagtacacctttttatataattttgacatctgaactatgtaaatgccttatataattttacaaatgaaaatagaaaagttaaatcctaaaattaaaaggaaaccagaataaataagcctaactctattttaaattagtaatacgactcggagagaaaattatttcaagtgacttttggcaaagcattctgattatatttttatgactacaattttaggatatactgtaagcacaaaaagtgattcaaataaattttaaatttcactcaatagttttgttgtattggggacacatgaatgtaaagatgggaacaacagatactcgagactactagaggaggagggtggaagggggcaaaggttgaataactacccactggatactatgttcacgacctaggtgacaggatcaatcatatcccaatcctgagcattatgcaatatagccatgtaacaaacctgcacatgtaccccatgaatctaatataaaagttaaaatttagaaaaaaataaaataattaaaaagtatttaaaaatagttttgttctcattagaacctactttatatgctaggataaaacaaacatgaatgtcttagaaactaagattttcattataaaagaaaagagacaatataagatcaaagttagaaacttataatattaaaatttaatcaaaatccttcatatgcagtaagtattatatatgcattatagatgtataaaatatatgcgtattttttcttgcactatctgttgtcatttattgtaaaacactgaacatataaaaattcacaattttacagtggttgagaaaagaaaacggaaaagaaaaaagaataagatgaagagagtgatagagagacacacgactatcaaagctcactaataaaccaacttttcactctaaaatttgacaattaaaaaaataattcagaatatcgcacctttttgggaaaagctgtcgccaatacccattttattttggaaagctctttataagagattaacagccaataaacgtagaaggaataatattattagagaatcagaattttgcaatcccaatgaaaccactgttcccatcaaggatcatcaaagaatgataaacccttacgtgaaagttcactggggaatacctgatgtcattcccaacagttcatttaccccacagtttacttgctaattgcaaagggcaaacagaccttgcaatgaagtgatctagtagtaaccaccctaaaagtgataaaatttagcatgaccaatagagcgaagcctgatattttatgcttcctaatgtgatgcaatataaggtactcagaatcacctatgaagtaccatactcttgccaaatgcttaagctagatgtgcccaagactttggacctaatatccaggttataaaaagtacaggtataaaaggacaagttaaacaatcagacaaatatagaatgtgatatattttacaagacaattgtcatcatctcaacaaaaagtcagtatcacaaaaataaatgttggtggactgttctagacttaaagaaacttgagtgatgtaacaatcaaattaaataagtgaactctggatcctggtttgaaaaagcagctgcaaggtcattttggggaaaattggataaattagatagacagatgctagatgaaataggctgattagatatcacttgattaagaaattataattttctcagtgtgcaaggtattacggttaagagaatgctcttttctatatgtatactgaaatatttaggagtaacattatctccagaatttattttcaaatttttcagcaagcaagatagaaagatagataaatagacagatagataaatggatagaaagatagatagatagatagatagatagatagatagatagatagatggacggacggacagacggacggacggacagacggacggatagacagacagacagagacagatagatagatagatagatagatagatagatagatagatagataaaatatggcaaatgttaactcttgaatgtaggttgttgggtgatgggcatacgttaattacactgttctttcaacttgactgtttgaaaattttagttaaaaaatgtggtgaagaacattgtacaaatataggatgagatacgatagaacataaagaagacccttataagtgtgtaggagattagtggggcatgattgttattcttagattacttaaggaggcacaaaaaattagtcttcagcagctaacggcatagatatgatagggttgcactagatccaccttctagggccaaaaaggcactggtggagctgtctcagctgtcagtgctaacaacaaagttgattagacaaagatctatggatctagagtgcttggccatgacttaaaaaatagagagcatttaggggaaatattggcagggatagcctgcctcagctattattgttatggcttatggaacatgatgatgggtacagcaccaagaaatcctgtcatcatggacctacaaacagtaaggatttaggctgagttttagcaaagggaataaagaaagcagctagaaacccaagaaggccagtggatccagatgagttactagaatctctttaaaagacaggcaacagacacacagacatgcaatgaattcaataaaaattatatagtcacagcacattttcccagtctcaggaggtttttgccctctggatggaaggtaattgtttgttaataagtacctggcttcactacacatacactagtttcagggtgaaatattactttaattaactagttgaaatttcacaggtctagaatttaattacctgttggaactgtagctaagatatcatggtctcataaaattttactgccttttaaaaatgaccataatttatcagaatcttgggggaaattgtgcattgtgcatgaaaacaacaaacattggaatatagttagtcctaagattgaagaagagacttacaagtacttcgatgcactctactgaagttcagatgagaggacagattctgtttcagtgacaaagacaaactgggtttcatattcactgttgtcttcaccttctgctatagagtttctgggttttttgtttgtttttgtttctgttttgtttttttttcttgctaggctccctcaaatcatgggacagtttctggttttggaccccaaggaaaatctgaaggtagatgaagttgtcctttgtcaaactacccctgctttttttgtgtgtgtgttagctcactttgtatggcatttagagcctgtatgtcctaatctatttcttcattatgcaaagcattgaatagtttcccagattctaattgtccttgtctaggtagcatgtgtaccagggtattatattttactgtatgttgtctctacacatgccgcaccagattaggctcccaggaagccctaaactcttggtgatagtttgatggaggaaggagagtaggatgaagcctttcctagtccctgagctttagtgatctctgtaaacgcacaatttaagagataagacatgtgagaagaagggtaggattaaagatctgatgaattagttgctaatctatttcttaggcaagtaaatttatccctcttggtatgtgtcaacttgtctaggtcacagtacccagtatacacatgtgcacacacacacacacacatatacatactgagagagagagagagaatttactggttttgtatctctgaaaaagcctaatacaatgtactccctcatctgtgagaaccttccaaattcttcagttttacaatttcatatctaaagaacaggtctttgttgctaaattactgcctgaaaatagttaagctctaattattaaggaaaaaaacattcctgtgaaaaatattttctttccacttataatgcaaaggtaaacttcaccagtatataataagaataaattattaataaatggcacctgtactaataataatgctttactatttgttaaaatattccatagtactgaagacatttaactacgttagtaaatgacccaaactaacactattattatttctttaaaattggtgacacagagggatgactaggcaaagcatagaggattttcagggcagtgaaatattctatatgataccacaatgatggatacatgtctacttacatatttgtgtaaacccatagaatgtacaacaccaagagtgaactctactgtaactatggagtttgggtaataatggtgtgttaatgtaggttcatcatttgcaacacatgtaccactctagtgggggatgttcatgatgggggaggctgtgcacttgtggggagtagggaaatatgggaaatctctgtaccttccactcaattttgctgtgaacctaaaaagaaaaaatatgtcttaaaaaaaaaactaatgacccaagtgtgaataaaacatggattacatagaacttaagggtttaaaatcaacttgcaccatactgaaaccacttagggttcttatcatgctgtgtttcttatgattcgtttgtaattagtcagaatatactgcagctgtttgtgatttcagggaagaataagatgtttataaagagaaaatgttccattatctctgctttttaaaattcctttctttgtaaatgatattttatgatatgttttccatcctcatttcaaatcctaaacaagactgttaaataggggtttgtcatacatagaaaaattgctacatattagcttctttccccacttcctcccctagttttatacatccatacacacactcacgcacattatttttatatgcgacaatttctggctctgcataaaatgttactgcaaaagtacactgtgtcaagttttttcagctgcttacattcctactctggtaccagtgccagggtttcagggcactacaatttcctttatatctcagtggttattttgaaattatcatgtctcatctgcactccctcataatgtatgccttccatgtcatattaagctgcactcttttccctgccttaattccctaatttctggaatgatattggaattggttatgattaaaacagcaagggtctatattaaaagcaagtatcttcctcatagatagatcatgaaagtttgaggtaccatgaaatatgatgtgaaaatcaccttcttcaaatatccaagaagatcactagtaaatttcaagtgtaggttcatttttacatatatcttacttacccctggagttccatagcagaggtggtagtgaacttgaccactagtgagaaataagaggaactatggggtaattgttcccaaggaaagggcaggaataggccattatgtgcatgtaactgtaaagagtcagtagatgcatcaagaggtatcgtatgacaattggaagatacagaaataaattcccagggtttcaagataattgggagaggaaaaaaggaaagacagtgtggtggacatcttttgtttttgcttgactagaatcctccttcattagtaacagcatctgagaaactatcccttccctattagacgggtaagagtctcagttgcaatggcccatcctcccctgaccaagaatgtagatttggtccaatacaggcaagtcagacacttcatgggatatgaatctttaactgaacaacacaaaggctgaaattttttccagctgatttatctcaatgatggtgttttaaagagactttttcattagtttcttctccctagatatccctagttgctccagttactgctctttttgaatacttgtttcattttttgttttttttttaaatcctgcttacattagttgcatgcaatcttacaagcttaactgacaaatcattaccaacaaattagatttctttagtgacttggcgaaagtgagaaagaaaactacctttgagaaagggtggactggattaaagaatgaaaactttcagccaaatagtagagaactttgcctaagaatgacttagaactttggtccacttcaaggaaaggaaactaagccagaatgtaaatcaatgcattgcttctttcattgagaaagtcatgtaacaaaaaaaacaccagctgaactaacctggatgcttagtgatgtatttggatttacaccatgctgccagttccttacaatttcagtctcagtaaccctgatctagcttaggttgttttaatccaaagaatgtgctgattgagactttttattggaataactagaatttgacacatgatttccagaagtatagaggttcccagaaaatacataaatgaatggaaagaatagtacagcaggcccttgaataatgttgtttcattcaaatgtcatttcattataatgttggtgaggaaaaaaaaatctattcccagttagagccactgtctgtgtggagtttgcaggttttccccgtgtctggatggattttctctgggtattctggtttcctcccacatcccagagatgcacatgttaggtgaactggtgtgtctacagggtcccaggctgagtgagtgtaggtgttaatatgagtgtaccccgtgaagggacagcatcctgtccagggtgcattcccatcttgtaccctgagctgcaaagataggctccgaaataatagagtaaataattgtctggcttgtttttattaatcttaaatgtatgtatagttcacatttatttcaatgtttaatatgggaagtgttttggtctttattcagaagtttggtgatgttttagtaaccagaaatatgccatagaagctacaattttctagctgaacaaattacagcaatataagctttcttatggttatcttaaaagatcttatggttatctaaaagatcttaaatcacacatcttctttgtgtttctggtatgccaagttttgttgtttatgggtttcaatgtgaatttgtttacttatttattttatttttttacctaagatccaggaactatagatcaatgtaaattaaataaaaaattgacttggattcttgtccttgattaaactgcaattcatgtgtttttgaatttttaaaagtaaattttctgttgtaaagtaataatgacggctacctcccaatgggacacattctgttttctagagtcaatgaattcaagtccacttggagtctatgagtttggatcaccttatcttaaaggctacttggtgaacagagttgaagttttaagataatccgttagttgagttaaaaaagcacttgggtatatcagggcttcttaacttcagcactactgacatcctagagctagataattctttgctgtggacagttctgtacattgtaggatgttttcagcagccctggtctgtatccctagatgccagtagcaatcttccttaattgcccaatatgccctgggaggaaggggtaaaatcaccccaagttgagaaccactggtgtatatcattgctataagggcattggtttttaaacctgacaaagctgagctcacctctcaggtctgtccctttcttacgttgatttgggaaagttactattttccttgtctgagaaatgttgatatctcctgggaattcttgaagagattagaaaatgtacttagcttcatgactcacctatagtaaaaactcaacaaagtaatcattgttagtaatagtatcataattcctaaatcctaaatacagattttctgatctaaatgtgcaaataataactaatcaaatttccaactgtgttatttgacaaaggtataatgaactaaaactctaagacatgttaaaaaaaaaaccctaaatacaataatttctaaatgggacaaaggctttatagctaactctttgaacttgaaactattttcagaaaaatgactggagtaatgttgctttccatacataactgttgaggaaatgtactaacacagacgagatcaaactgaaaaagaattatatgtccaatgttctagtcctagaaagaatacacacacttcctctctcttcctctaaatccatagatgttagcagtgaaagatactaagaaaatgaagaactagaacgtggaatattgtcacatggaactaacataagaagtaaaatgtaaatgaaggaattttatacatgtgcatttcaaatgatctcgaccacaaaatcagagaaatgacagacgaatacatgaattatcaaaccattcgctgttcaaaaataaacttctgaactttagtgtttgcttaatggaaagttctttcttttctttactcagttatgacctcagacatgcatcagaactcaatgcatatgataaaacattatcatgccaactctgtggatacgaaaaaaaatgcatgagtggagtgacatttaaaatgctgatttaaattccttagcataaatttcaaccatctgggaattttatttgctttcctcttggatcctgttgcacactcaggtgagcatagctgttatccataaacgaacagttgttttgaaggggcagttgtacagtctctttaataccaagttcactttatctggggtgttcagatagtgctttcattttcaggtttgtggaaaggtgaagagacaaaaagctcaaatgctttgttaggaaatgctgctgaggaaaggaatcctgattattgctttgaacttcaaagtatatcagtaacagggtctcttaaaaggaagtctcttgagagttcagattacagtgaataatcttagaaatgttcctgatgaaattaaattgcatggttcaagtaatgggctactctcccatatgagccttgccatgattaaaactgctttaacactaaatcgcacatggatgccttgtaaatacaagatatttaacaaatatttctcttgatgacagtctcatctcacctcatttcagcaaattaaagtaagttgccacggctttaaagaagtcacacagctagttaattgcaccgtttgtccaggaaactcattctcctgaatcaatcccagtacagctctgggttggattgattaaatcatggatacattgattgttttaatgaaaaaagtttacatgttcatttaatctaagacaacctgcaccttacacacacacacacacaccccacccacacacctatcttttttttttttgagatggagtctcgctctgtcgccaggctgaagtgccgtggtgcgatcttggcccactgcaacttccgcctcccaggttcaagcgattctcctgcctcagcctcccaagtagctgggactacagtcgcgcgtgaccaggcccagctaatttttgtatttttaggagagacggggtttcaccatgttggccaggatggtctctatctcttgacctcgtgatctgcccgcctcagcctcccaaagtggtggattatgggtgtgagcctgagttaactaaaatgttgaaaagttaagggaattggtcattattcttcagcatatcattcttgaacaaaatgcggtttctattatactctggcttttgtggggctagcagtatctgaagaaacactgcagaaaacattgtagacagttttatttcctaggaacatcagtaagatttccacaatataaaaacttaaaaaaatattcagagcaaaaataattaaactaccataaaagtgttctttgccaacgaattgtgactagtacaaagcattcagtcataataaatcttttaagcttttcaaaagcaactccagaagctaagtttcaaaatttgtttagacaaaagcaaatttttaagaaaaagagtgtatattttcttcaagctacattgaaggcatttgcatgtttaagtaccagtgaaccatttgtttatgtttaaaaatgtttaatcacgttagtgtttttttagtttgattttattttccaaagatggctacaacaatatctcccatcccatactttcttctagaatcttgtaaatttcccattaagaaatacaatctgattcctgcccccttaaacctggacaggtttgtgacttgcttgtaacaacaatacaagatttcccaagctaggtcagaaaaggtagtacaactttcaccttatagatggaatactcaggccattcctagcctttccagatggcaaacaattctttaattaaaagagagcctcaagtcaaagatcaaatccagggtgggactataagatcatttgtgaagacttcaaaaagatctaaggctatacctcatagatcatttaagaaccacaaaaggctctctgaggatcttaaaaacatgcctcataggtcctccctgttaaacaatatagggtttctaagtatctaaggaagtgtctttcatcagacttacagggaacacaaaatagagaatggattatcttaaagagatttgtgactgtggcttttgtttaatggactgaaacccaatgagattcatagaaaatccacgaagttcttaagaattgtgttgctgaaaacactgccagtttaaaagagaaggccgggcatggtggctcatgcctgtaatcccagcactttgggaggacgaggtgggcagatcatgaggtcaagagatcgagaccatcctggccaacatggtgaaaccctgcctctactaaaaatacaaaaaattagctgggcgtggtgacatgcacctgtagtctcagctacccaggaggctgaggcaggagaattgcttgaacctgggaggcggaggttgcagtgagccgagatcacgcactgcactccagcctggcaacggagtgagactccatctcaaaaaaaaaaaaaaaaaaaaagaaaaagaaaagaaaaagagacagtacaaaatgaaaggaagcctctgaattctagaactgctataggcaggaagcaaactgagaagatttagttttatgcataggtcacttattataacaataaagaaaagattactcaaagaaagtaagactccagagggcagagccaaaagtcgtggccaactctcagagagtagaaccaaaccctactgacaaaactggcaacacgtacctggctggacttcagaatttctattggccagtgacttctatgtacctatactcttccatccatttgtaatggaagcatctattgtggttaacctatgcgtctggcctttacatgatggatatgtgggaggcaccaagaggaacagtacttgaatgctttgcttaaggaaactgacttaaggagactcaactgcaaaaggacctaacttaattagagaaataaaaggtttgcttctcgaggtctatttacagactaagaattacaaaataaaagatctagtgtatgtggattaataattttaataagcgaaagtggtatgtactttctaaagtatatcacaaatgtgatataaagagataattgagaggcagaataatgtgttggtcaaagtgcaagccctgaatcagaatggatggaatcaaatcatggctccactcacctctagttctatcaatgaaggcaagtcagttatatgctctgtgctttcatcccccatttgtaaatcagacatgacaatagtacttacctagggttgttgtgagaattaaattagtgagaatatgcaaaacatttagaaaagttcttaataattatagagataatttacctacaaaaatctaattgacaatgatgacttttattgctgaaaggaaggaaacttttaactcctctcaaattactgggagttcaaaaatgaatcttgttgagtgaagaaaattgctacagaagactttggaagtgattacacaagtacaacatagtaaagctagaatcttctgccacttgtcaaaataaactaaaaatagatgaagaataataaacactaagttgtgaatcctagtgtctacttacgataatttaatgacaataaatctaggcagatctactgggttatgctaagacattttcctagctgtatctaatttgattgactttttctgtttaattagtgaatattataattatgtgttctgaaagttgtatgaatttcataccatcaaatagcactaatgcaaaatagagcaaaatatcaagacttagagtctcttttgtgaacttgccttcttgcaaagaatatagttaactccctggagtaatccttatttgtctacataatgaatgctgtgggaaaatgaggcacttccactcttgttctcatcggcattgatatgaccttgtctgatttagttgaaccaagggcattttcaataattacaagctcagaggtctaccacagatcctctcatgggaggattacttaatgtaggcaaagtagatacaacccttcatgtctggtccattttaatttattggttgcctaaatattcaatcagagctttcaccagctatatttgtagagctgctcaaatgtttttataaaagtaagcacatagaaattacaaacggtgcttcttttcattcttgcaggctgacacctacaaaatatattttgttaggttataaatagttaaaaaacttttttgagctacaatgcttttaattgcttaattttgtagtttttagaaacatgttctagaaatatttaggaaacaatatcacatcctgtggcatcaagaaaggcaggaactttgtttttctaattaataaagaaggctaaaaagagtcagttgttaaataggcaatgggaaaccataattgtaatccatgggaaccacggatttttgctggaatataaaggatgatttaaaattagcttaagatttcactgattcttaatgtattttgttgatatattgattagaaaaaaattacatttagccacacctaaacttattttggcttgtttatcaaattttcagattaattcttgttgatcagtttcctttcctccttccttccttccttccttccttccttccttccttccttccttcctttctcatgctccacaacaaacatttgttaggcaacagttcatttactaacaccataataggtgctagagattccagtagaaatcataatctctgtcaccatgaagttcatgaatttacaataaaaacaaaaccaattaacaaaggtgggccccgaattcaatgactggcctccttataagaagaggagaggatacagagacccagagaagaaggccatgagaaaacagaggcagagattgaaattatgctgccacaagaggaggaacacctggaagctggaagaggcaagaaaggattctttcctagtgcatttggagggagcatggtcttgctgactccttgatttcagacttctaggctccagacttgtgagagaataaatttctgttgtatcaagccacccagtttgtggtactttttgtggcatccttaagaaacgaatacagacatgttcactttgaagtacctttgggacaactgagtcgaatggtcaaaagaaagatgaattcagggatttggaattccagcttaggctggagataaaactttgaggattatcagtatgcgatttggcaataaagccatataagtggctaagatcatccaacgcactgtgtagaatgagacaagaattccatctagggccatgaagaacagtaccttttaggaagagaccaaggtggaggtgctcacaaagggagactggagaggtagaaggaagaccaggatagtggaggggcacatgcagagggtttcaagggttaagtgcagcagactggtcaagtaaaataaagactttgtccgttgcatttaggaaaaggcagttgtggtgacctaactgagacttcagtgcaagagtggagtaattttcaggaatgactgagagatccaaaagtgagtccaggaagtgtagacagctctttccaggggattgaatgtgaaaggtggaaaaccgactgcaactagaagcaaagaatgaagaagacctttcacattgcttaattgtcactatttggattttcttacagatgattatgctcttaactaatgagacactttgatgtttagacaatgatgataaaacaaaacagtacctcattttaattgttgttgtccacaaaactgctcactaaattatggcaaagcaactagaacatgttttacagatacaaatctaaaaagtcagtaaatgagaatctgttgttggtagaaattttctgcataatttacaaagagggaaattataggcagaataatgttttgaaatgcaaaacatctgactcatagtagagatgaagagcagtgaatgacccatgagagaaacttatcttattgttcacacacagggtagagaaaattcaaaccgataaggcatcaggcaaagcaaaactgctttaacgaaggtgagtcataatgccactcagggagatgaatcaggtgcccacatgtccaatcactttcataattacagctccctacatcttttaaattaaaactgaagtcaggtaacaactaatgtccctttagaacaaacttagccaaatggaaatagacagagtcctaagaagtaaaatgagcatatcaaagagatgcagcttttctggaaaggaaaaaaagaaagaggggcagtggctcacacgtgtaatcccagcactttgggaggccaaggtgggtagatcacttgaggccaggaattcgagaccagtcaacatggcaaaaccctgtctctaccaaaaagacaaaaattagccgttcatagtggcacatgcctgtagtcccagctgctccagaggctgaggcacaagaatcacttgaacttgggagatggagtttgcagtgacctgagatcataccactgcactccagcctgggttgcagagtgggactctgtattaaaaaaaaaaaaaaaaaaaaagagagagagagagagagcttgcacaaaagcaagccatccctttaagtgtaatgtcatgactgctggccccaaaagacttttaaatgcttttattgtgccctctgttccaactgattttgataccttcccatcatggaatcactacagtagtttttgctcaacatgaagtcttagatatattatacctgaggcccctaaggtttcctgctcaagccaggagagtaagcagcctccctgccccctcccacccacttcccttctagctttcacagtcaatcaaaagcctagtaaattctacatcttagacatctaccctctgtcctttcccagagatacagcctgatctaagctgctactgacttacctgtaacaactagtttcactcatcctggttgcctcctttaggcaaagctacagcacagctagcgtgaacatggaaacatacaaatcagatatcattctgttgcctaaaccttagatggtttcccgccaagaccaacacaagcttatatgagcctctgtgagaattttgaaaaaaaggtaattgcccctactatgggataagcagaaaagagccacatttcagacccgatttaccctgtggttaggcttatttatgtggcgatgaaaatgcagcagacgttgcctgtagaataaaatccagactctttaaaatggcttatgaagccctctacaacctggcccctgccaatctctgcagtcacctctcaccattctttgatcttgctcttacagatcagtttcagttccttgaccatatcatgttctcacttatatctttgccaaacctgccactgtttggaatagtcttccctcctttgtgaccacataattcctgctcacttttcaggttttgacaaaaatattacctccctttacaggtcttccccgatgcccttgattaaaaatgctttcttgccatacactcccccagatcacctaaatgtgtccttgcataacagtcattaggattcattgaaattgctggcataggctgagtgcagtgcgcatgcctgtaatgccagcactttgggaggctgaggcaagtaaatcacttgagcccaggagttcaagaccagcctaggcaatgtggtgaaaccccatctctacaaaaaaaaaaaaaaaaaagaaaagaaaagaagtaactgggcatggtgttgcatgcctgtagtctcagctactcaagaggctgaagctggggggttacttgcgcctggaagtgtaggctgcagtgagctgtaatcgtgccactgaattccagcctgggcaacacagtgagaccctgtctcaaaataagagagaaattgctggtataacgtcaacattttctaatgaactctcagctcaaagagagcagagattttgtctgtttgctccccactgtattatctgtatatagtaatgtgtctgatgcttagaagctcaagaaatatttattgactgaataaataattacatgaataaaaaagcctggaatccttgttacagtatagtgggaagaggtctagtccaggctcttccactaacttattggttctgtgactgtaaacaagtttcctaaccacggtgagcctactctttaaatgtaatctttaaaatgttgacaataccgtttgtcctatctaccatcaaaattgtcatgaggctcaatgaagctgaggacaactaatgtgtactgacagcctaccacgtgcaaagctttatgctaggtactgccatctgtattatcttgaaaaatagaagaatctctgaaagactgtcatttacccaaagatcatttttcatagtaagtggcaaactaaagacttaagtaggaatttctgtgattccaaaggctcttttcttctcgtcccttcccttcctttccctgccctgccctgccttcccctcctctccctcccctcccctcctctcctctctttctccttcctcaccatgttccatcaatatctatctgattaatacttcaagtcacaggacaagcatcactcgttttgtgaaaccatctctgattcttctgaccagatttatgtgctcctataactatgttcatattgtacttactataataacattagttttaaatttttttttaccacaaagtttttgtgagaggggagcatgtcttcccactattatattatttccagtatcttgcctggatattaacattttataagtactaaaggaatatttgttaaatgaatgaatgaacttactttctctggcttttttagaaaatttgataatacacctaatttttgttcagtgtttacagttttatatttaatttataaacagcaataattgaggccccaaccacagtagctcatatgcttaaagttgttaagatagtattatgaacatacgacatcagctcttgcccaataatagacgtttggttttagattaatatatttaagattaatcttaaagtgcaactaataggctgagtgtagtggctcacgcctgtaatcgcaccactttgggaggccgaggcgggtggatcatttgaagtcaggagttcgagaccagcctggccaacatggcaaaaccccatctctactaaaaatacaaaaatcagctgggcgtgctggcacgtgcctgtagtcccagctactcaggaggctgaggcacaagaattgcttgaacctgggaggtggaggctgcagtgagctaggattgtgccactgcactccagcctgggcaacagagcgaggctgtgtcaaaagtaataataataataattttaaaagtacaaataattattgcctgaaagggaatatgctaaatatgagatacagggaaatgattcaggttcacttcaaatttaatattccagttttaatttgatataaggcaacctcagggaacaaacatgttgttagtagcaaactacttagcttagagaacttaacatagtatttattgtaatgttcccctgttctagaaaatcataactaataatagaaataaaacccagctgcatatcaatggccaagaacatatcaatggactagaaaatatgctaaggagactaaaacagacctgaacatttccttcaaatttaaataaagtaagtactttttacttattactaagatctgaaagatatattaaaaatactttgaaattacgtaacatgtgatctaaattgttcatctaaaacaacagcttgtcaaaatgctaatcactaggaaccgagaggtttgtttagttaatagtgcttcctttcacatgtgcttatgtgcttttcagaaggaaatctgaaatctattattagctttccatagtcaactcctgattatccgagttaataaaatagaacccagacatctgtgctaatagagagaacacagacatacaatagacctgattcagatccaaaaaagcagataacacaaaaattacatctttgactccggaataaatgttgattctttgtagcatatgtgccttcctaataacactccattagtttttctactatagcacaggggaactatgctacggaaaactcacctacacatgtaagtgagagttcactctagattgtgtgaacgcattgttagatgttagaattctgtcagtggtattcattccgcacactggattctgatcatcactaatatgttgaaaggtctcattctcttcaatgctccaggccctaatacaagattcccaacctcataaatggctcctgtagaaagtaacaacatcagggtgaagaaaaagtcagttatgggaaagaaaaaaaaaagccatgctatgctttgttttgacctcgtgaaagaacagggatcactcaagtttttactgttattttcaaagtcaagccttagatacttgttcactaaaggggaagaaaattataaattattgtacattattagatacatggctttctagagtgaaattaatgattttggaaatgctgggccaattactttataaatgtctaagaaaaatgaatatcttcctcatgtaaataactgcaatcttttcatctgtaaaatcagatcagttatgtaacaaaaacttacattaaaaatgacatatctccctgaggcaacttatgaaataacgaatgaaaggtaggctcatgcttccgaagaaagcaatgtagttcagaaaaaactacagagctcaccttactatatacatagcaataggcacataggtggcagaatcccagcaaagcaaatattctttcagtgattcaataatttgccatttattgagcacctattataaggtcagtcatcatgctggacactgtggatacactttatttgagacatggtccctgcatttaaggagctcacagacatgtaaataattttgtgtaagagatgcaatagtcgaagcatgtgaagaacgctagggggagtatggatgcaagaattggtgggagttaaagaaggcttcacaaaggaggttactggcatagacataatgtttgtaccctcccaaaattcatatgtttaaatactaactcccaaggtgatgggattaggagtggggcacttgggaggtgattaggtcatgaggacagagccctcatgaaggcgattagtgcccttattaaagaagcctggccgggcgcggtggctcacgcctgtaatcccagcactttgggaggccgaggtgggtggatcacaaggtcaggagatggagaccatcctggccaacatggtgaaagcccatctttactaaaatacaaaaaattagccaagtgtggtggtgcgtgcctgtagtcccagctactcgggaggctgaggcagggttgttgcttgaaccccggaggcggagattgcggccactccggcctgggcgacagagtgagactctgtctcaaaaaaaaaagaagaagaagaagaagaagcccaagggagctcctttgccctgtccactgtgtgagaacacagagaaaatgctccgtctatgaaccagaaagtgggctctcaccagaaccaaatctgctggtgcctcggtgtggcctccccagcttctggaactcaggaaagttaatttctgtggtttgtaagttacccagtttacggtattttgttataacagcccgaatgaactaaaagagttgtctttagccacagttcatgtaagaattgtaatttaccaagtagattagatgccaaggcattccaagatgatgaaaaagtacttaaaacaaggagccatgaactctaagaacaacatacttagaagtccatgatatatttggatagaggtgaacaggaagttatatccaaattatcaaggactgtgttgagcatgctaagacatttggatattcttatataaaagttattaagcagggacaaagcataagatgttcttaaacagcggaatggcatgatcagatatcctttttaaaaaaataaaaataaaaaaagaactctgttagctttaagagactgtcaagtcctggaggtgggaagcctaaatgagagacatcaatagtttatttaggtctggatgatccctaatatagtctcccaccctctgtcttatgtcttaagatttcattatcagagctttagctttataatttagtacctattaaagtaaaaattggtattttgggaatgataggatagaaaattgcataagtggttaagttgagcttggggatgtggggcaaaggtgacagttttaaaatccttccctctttattgtgtaatctcaaaaagatcaagggactggtattgatgggagaggcaccttgaggccagagcagatggagagagggacagacactctctttccaaaatcagaggagcatgggatatgtttgttttctgcctctccataatatggcacaacgaacttagtggcttacaagagcatgcatttattatctcacagtttacaagagtcaggagtctgggtggcttaactgggccctctgctcagggtctcatttagatattggccagggctccagctctcatctgagggccagggtccttttctaagctcacagactgttggcccaatttgcttccttgcagctgcagagctcatgtggtttattctccaaagctagcaacaaagagagagaaattcagctgcatcaagttgctaacttctatgcccgaaatttaaggaatcagcttattatcagttcatctctcttttgattaacttaaaaccagtgattggagaccttaattacatctgcacaatccattcacctttgccctaaaacatctgggagttatatcctatcacctttgccattggctagtagcaagttatgggcctcacacacactcaaaagaaggacctcacacaaaggcctggagacagggagcaggatcacagccttcttagaatcctgccaatgacagatttgaagagttgaggtcactagagtctaggagaggcaaggaacaatcagtctatccagtaggtagaagtaactggggagaatgtctggaacaagttctgttacaggctggctcactgtggcatgacacctaaaagtgaagcctgcgtttgaagggcctggccccaggtaaacacatgaggcacccacccaacatagacaagtgcagagagcaagaggggaagatgttctccccaaagaagactgtacagatagaagatctgaatagagaaaaaggacttgtagtttgaaaactgttttcaactagggggaaggaggggattttctccatagcaccaacctgggaataccaaaagactcttttcctccttttgttttaatttttcaattaccgtaagcttttctctcacagctttatttttaactttaatgatcacacatatatcacacaaatataactaatacgcagggagatttttcaagagatataaacatcctggttgagaaagtcaggagagaaaaactactaagtaaactaaaaatgacaagataattagagagaagatatatacagcaataaatttgaatttcaaagaaaatttcaggtaacaaatctgttatattttcacgtgcattaatagaagttaaagcaagagaaaattgagttaataaaaaattgatttaaaaaaaaacagattttcaacacaaaatctctctgaaactactgcgcccttgcctctgctgtaattttggaaggattagcgcttgtaggactctggctgtccccagcagtgacacaccttcccaccccaggatacataaaactggggcacagagcagatggaattttcagctctgctcatcagcaggttgacctgcttgttccaagcaattttgtgaatttaagactctggtgcctggctggactcatagcacccgggtgctctgcaatttgtacagaattctaaaatttcaggctctgcttgttgcctagatctttagtaataacagcaataaaaaagtaataatacccacatgtattaagcatttatgaagctacattaattaagcatatgttgtgtttatgtagtttgcagttaatggcactggcttaatgtaatagggatagtattttttaaagaagaacttgatatatttccatcttcaaattgtgtttcactggaaactgctcctcttccagggctggacagggtacctaatgccctcacggaagaaaaggtgggttagcaagtcaatagacttaaaaatcagagtcctgctttagaccaatcagaatgacgtatgaagatctattgtatagacaaatgagaagcccatcccagaagagaaaggacataccagcttctggagaatttcaaaacggaaaaggctgaatgagatggggaggatagggaaatagttctacatttgtgtctggaactttcctttctgggcactggcctcgagagaatgtagcataataaataggtattgggcaaacataagaaaagagagctctgggttcccaatcccatctagattctgggcagggccacatcccattaaacttgatagttccctgtggtaaggactagcaagattttggggataaatctttctgagtcccactgatattcctaaattacgaatgagacccagaggtacctggagcctccagaagggggcctcagcaggcagctggtctgaaagccaactggactgccctggggccagcttggcaaggggagaggtgaccgctgcagaggctaggaaagacagatggccgacctggcagagactcagagggaccactttgccagtgcgaggcgagctgaggtgaccagccagaaagagctccaggctctggccagaatggtcttgacctaaatatgccacctgcaggccacaggtatactggaagggatgcccactccctattatcccttttcctgtgtgtctctccggccccatgtaccagccattcattcgttaggagtttgaacaaaaagctaattcaaactttctccatcctcctcaaatatctcatctttgccctcttttgttactctccaaagacagccttgctcttggttcacagagaaaataagagccaccggacagtaaaatgcaaatcagatcatctctcttcgtttaaaacacctatcaatgacttctcattgctcttaggataaataccaaaatcctgaaggtagctacaagggtttgattgggcttttactcgctttgcagcttcaactgctgtcatttctctcctttctctctgacctgcagtttcatgttaatttctaccacagggatttttttaaatatgctattccttctttaaagaataatcttccttccccaccttggcctacttaattcttctttgtctttcagagccccactcattgttggcatgagatcagtcacccccttgagatactctcacagcactttctcatggcacaccctgagtaaacatatttatttaatattgcttaggtaagccaatagtattatatcaactaatttcatttggagtagcaagtcccatgcactagctaactaacatcaccccattatctaactatatattttcataattttaagtgctgaaaagcaatcaacttttcttcatcaagcatctcgtaacctgtaccttgccttctacctgatgtgcaatttgtcacaaaggcactgggtgaaagtcatcatgtgacaccacaggaaaacaggaaaaagtacaggagacacatttcatgatttatcaagaagtgacaagaatataatttaccattacatctatatgcagcatttgatataaaaatacttgcctctagggtacctaaaatcctggtctattgaaagtactgaacttaccaaccaataactcagctaatatatttaatgtatatatttttaggaaaacaggtcccaaagatgtaatctcgcatcatcctctctaaccctttactttctccatatcagcttgccccgaatcttagcttggagttgagaggtcatctcagcagcctgttcctggccttcctgtcggctggaggccaaagcctccctcagctgcctgtgtccagtggctgctgtaataatgatgtctcagcttcaggaggtctatttccaggccatgtgagctaattaaaacacaggccttcatttgcctttctggcaatccctgatcagtgtgagaggcctatgccaccctctccattctaattttagttctcctctagtgttttctctcctttgcagaaaagcgtcctatgctgctaagcacttacaggcttttgtttttgttatttctcccacttggaaagaagcacttttccactttactccttttgggttttctcctcccatcagttttctcctgcaggaggtgatggtttgaaactactagcaaaactgaagataattagttacccaaggtagttgacttgcttagcaggtgcccttgagaaagtgctaatgcacaaaattcttcatgtggaaacaactttttggacacagctttctataaagatagagaacacctgttatcactggcgatgctcagcttcttttcccccagcaattcacaacacaactatccagagttcagaactcataaattcactcacaataggctgagatgctatttttcggtcttttaaaacggatactctttacttctgataagcataaaattatcacatggcttcctcccaccctaccctccctcactgaaaaaaaatcattatctcaactatctactctacatatctacttgaatatccaacagattttcaaattaaaatgttcaaaactgagatttccccatctccactaatatcagctccatctttccaaaggtcaaaacaccaaatatctttgaattacaactttggtcccttttattttcttatatcctacctccaattcatccaaatatatatgtagatagattgatagatcaatcgatagacagatgatagatagatagatagatagatagatagatagacagatagatctacctttaacatagatccagaattctaccactcctcaccacctctatttaaaaaaaactgttacccgaggaaagaagaacacactggcaaccattaaggggacccaagagattgaaatatcttagcagatgggttctcaggtcattcaaaggtttcacatgagaatgagacacatagtggccatgtgcagagagagccccttagggaagtggccttgaatgaaacacctctcttagggagactttggcagccagggaatgacatgaggagccttggcacctcaaggaagagtgggacaaagtatagaagaagtgaactcagataaaggtgatctatattacaatgtgttaaacaaatggaaagattaaatattatgaacgcagtgaatgttatgtctttagaagtatcaaacatttcttccaggaaattgttgtactgatttaattgcagtatttaagaatatgttgatggaggagaggctaactcagctgctcagtcccatggtcttaagacaattgctgataattataatcattcctagttccttgtgcatcccattctttgaatccaacaattattccaaccctcttctttaataccttgactccagcaatactttgaccccactggaatctccagtcctaagatcttattgatttttcagtgttaattatctccttgttctctttcacttccctcttcatcttgaagtctatggttaaatattacactcccttgcatttatatttccttgctcttcaatcacttcaatataccaatttagcaaaaccacaacctatgtaaaattcaactctccaaatactctgcacctgcatcctccagctgacataggctggagaaaaacacagaaccacattggatagtctaattctaaatgcatgaacacagactttaaataggcctttaatgctgccaggtgatcacatcatatacctcctttgtccactcactgtttcttctaaacaactatttcacactgttctctctttcctcaaactctacatttccttctctgtctttggtttcaattgaagctgctgctctctactttgtagaaaaactgaaaactatcagaacagatcttccccagattcccaccacatggatctcctgccagtatttgcacccacaaccaaaacatctgttcatgctcctgtccaaaaccagtctctccacttggttaataatagaattcatcatcccctctttctcctccatcgtaacttaaaaattcccctgtgaagaaattccttcaagggtagtctatcattactctaagtcctctcctccctttctcccttaaaaccaccacatgaggctctatcatttccaaccaaattgctcttgtcaaggtcagcagtgacccccccacccccaatattgttaaatccatgaacctattctaacttagtcctcatcctacttaacttatcagctatatttgacagagttgatccctctttccttcttaataactttcttcacctgacttcagaacaagacactcaccaaaagatttccttctatctcacaggttgctccttatcagcttcccttgctggtgctgcctttcattccatccttcctcaagctcagttattggtcttcttcctctacacacgctgcatatcatctgtataatgacgacgttcacatctatacctgcagactggaccttctgctgcctacttgacacatctattcagatattcagtaggcatctcaaaattaactcctggtatttctcactgtttaccaaaccttctcttccccaaatctcttgtgtgtcaaacgataggaaattcattcttacagttgttaaggagaaaggtcttggagtcatccttaattcttctcattttctcatataccatgtccactccaccatgaaattccattggatctgccttaaaaatatgtccaacatctctccatttctctctaactctgctgattcacctgtgatcttagctgctttccctctcttactgcaatgctacaattgccttctaactggctttcctgcatccacccttgttccctctccccatccatgatcgacattatagccagattaatcctcataaaatagaagttagatcatgtgacttttcttctgaaagaactgaataggctctaagaaaaatcactctgggttaaagccaaagtcctgaaatggcttattagggccttacataatctatccctcaccctctcttcttacctacaaatattctacatttcaaggaagagcatccacctttcactcatcagcttaagctagaaactttagagccctccttgaaatatttcccctcatctttgcacatccaattaccatgacctgttaattactctttccttgtatctcttaaaccaatttacattttccctttgctatgaaactatttctccccttctccaatgtcatttcatctcaaatctactacatattaatactagagtgaactttctagttaaatgtgaacctatttatatcattccccagactgtataacaccaaagctttttaattctaacaaccttttttgatgattcacaagttgaagctttaatcacaattcaagctactttttaaatggccctctgttataataaattcattggttcacttaaaagtgttttgcagcatacgatttatttttgaagatgtattagtctttgttctgttaaatgccattttggtcaagattaattttttgtgtatgcaatcatttataaaatgaaatgtagattaatcagtaaatttaaattatacttctaagtcaagaaaaggtcagctatctcggcataagcttggtcagctaccttggcataccttgtacagacttacaacaggcccccctatcttaaagctactacagatttcaaataatagtattaaaaacaaaaataatattaagcaataactgtgataatattaaagaataatattagttgccaaggtttacaaaatgtattaacataaactcatttattactacaaatacctaaagagtagatattatttccactttcagaggagcaaattaaatgtcagaaaagttaaaggttttgatggaaaatatctagcaaatcagtgatggaactgactcttcaactcattctctttatatacccagtggcaatgtctgtaaagcataacaaattaaatatgtgtaagctaataaaatgctacttttgcaagtacaaatgccttccttacaagttttcctttttaatgtaaagcaaagcaaattgtgctttcacattattactaaatatcagtctatcctaaaattgtttatgtaatgtggaggtgatatattatcttagaaaaccactgtaacatggtattggaaaccatttcaactgttaaaaggttagatttcagttctgtttaaaggtcagacctgaaaatatcctgatgattacaatttctccacacattttggatgatgccactgaactcctggcagcagcaaaatgtgtttgttctgatcctctgcttctggtggtcagtttcagagtggagaaaaggcgccagggctttgggactagacctaaatttctattgcttttaattaaaataataaaggggaaaaggtaatattcctatccaactgagacagaaaaatttgttgaaaaccgattcttacctgttgaaaaatattcagaaaatcgatcatccccaaaacaatgtactaactaaaacaaaaccaagaaaggcattctgaaaggcaagtatcaaagcatctgtcattgccccattttaggttttcaaatctggaactagtcattcaaataaatattgtttgaataataattatatgcccagaacccttcccaggtccacataccactattttttgtttttacaaatcacatctcatctctcctgtcctataaaactgcatttagtacatagcagacaatacattttaatgctcactgaatgaatgctaggattgatgtagaatacaaagaattatgttaatatcattgttattgctactactactaatagttactaacatttattgagcactaactatctgccaggcactgtgttagtcactttacatgcatcaccacagtacagggtaagttaatctaattaattcattgttaatctaattctatagtaagaaaactatagcataaagagatcaagtctcatagctaggtaagaggctcagtttcacagttagtaatcaaactttggcagtctgacctcagtgcttacaatgggccagagaccaacctattgcagcttacattctagaaagacgacaagaaataagtaaagaagtaaccaatataattttacataggagataaggctatggataaaagaaaacgggatgatttgatagaagtgactagagtgatatagaaaaatggttaaaaacatgaactctagtaccaggtttgagttcataccagaactttttccagctttgtcattatgggctgttatttagttacttatgttctttgtgtatttccttatctacagataataccgaatttatataacagtcatgaggtttaaatgaattgatatacataaaatgcctaaaacagttcctgacacatagtgtcatttaagtatttattattattgttatttttgcatttttattgttataattcttatcacgttgaggacatctacttgagatagggtggtatgggaaggcctctatgaggaaatgcatttgaaccaaaacctaaatgacacttaggcacatgaaaattttaaggcagagattccaggcagaaggaaacaaagtgcaaaagccccagggctagaatgttcagcaaagaaagccagtatggccaggatgagttcagtcaagttacagagctagtcaggaaccaggctaaattaggcatcactggatatggtaaggagttgggttttattctaagtgcgattagaagacatgggaacattttaagcatggtaatgacatgctttgatttacattttataaatatcactccggcttccatgaaagtttggattataacttccatagaatgtcaatcttatcattcccattagtcattgtttttaaaatcttagctttattcctagggaaaagtaattctctgactatatttccagaatgtttgtgttagtgcttttaaacatagagtccgattaaaggacttaagtaggtatatgaacatacatatatacacatacactcactgtgaacaaagattatatggaatactcacatagaccacacttcattattctaaattcaaatcagaatttgaattcactgaatgaatgctaggctgggtttttgaatcatgtttcttggaaggaaagtaattgtttacttacatgaaagttgaccatatgaattaggtcattcttgttatacccaactaaaacagttgagaggtcaaggggagaaaacatctagggcacataacactgttccaacaatgtaattccctgtgagcttggctgctgaagctgcctgctgtaacctgaaaccagttttatctaatagctactgaaacaacctgctgcaactctgagaatcattttacccatagccatcacttaccaatcaaaactttccagctcaccaacatattattagtgccaatgaacttcctcaaagagcaatatgtaactttccccttttttgtaaaacctctatccgtctgttctctggacataatgaagaccatccagcctatgagtatgccacaaatgcaattcttgatttccaaataaaacatttaaaattaagacttttgtctctatattgtatttgtctttaacccttattgtaaattatatggcaggggaggatattctttgggtcccacttctcttatttctaatatgtcccttggccttgccaggcgttagctccttgtcccccaaataaagaaagctttgcaaatctgactgcatggaacaatgtatgttttactagtgggtggtgttatttttcttaatcttaccctcacacccagcattttctcccccaacacacttcctctgcaagttcaccatggtttaaataggttgaaagccagcctaggccacattgtacaattccttcttaccagacatccttgatataagttctccggcttcaaagcatctcttaataaagttgtctgttgattagttgataccgctgtgtggtgaggggtaaatggcagtggaagaacatttccaggtccctggtatttttactactataatcacattaaatcatcatctttaatatctaacaccaaaaggccatccatgtattcaaaaagaatattacagccacactgacaagaatcttaaagccctacattgccacacatggaggtgaactaaaaacacaatgcaatttgtacgaagactcctcctaattcctctaactcataaatacttcagtcttaaaataaaaatacagctgcataaagtgaactgctttacctgtatggttagttccctcattcttgacttctgtggttcccacagaagaggtgggtggactagcaggaggactggcagtaaagcttgtgcaccctgtagatgtgttgatttcaaaatattcttggttgtgattcattcggtgaaaatccagagaagacacaatggatgttcgctgtttaggctaaaataaatgagcatgacgagagtattaatatgatcatgttcatcttcagcccaatctccccatcaatttaatctaagtgataatttttttcagttaaaaactatctgggttttatacttaaaatataattgtgctttacagagatacattaatttcttgatgaattaaataataaaaaattatttaatgagaaaatattatggcatagttgatgtgataggttaggcttttcatttgctttccccagaagattgtaaaaatatagtgcacaaaatttctcttggtaatcaattttgaaagttgcaattttaagtcacctttcattcaactaacatttattaagcatctggcatttgccagacccagaggatatagaatctaataataaaagggccttacaacatagaagaataattaaggcagttccatttttttattctttaaatagtccaaggaattggtggcattagatattgttcccaagtacaagatgctggaattttatcatcagaattaaataaagttatatggaacattttctaagatctaagaatatgcttggtatttttagtgaactttgattttcttttttaagaattttaattaatccccaaatagcaagaaaagtcaatttaaacataaaagttaaaatcatggagtaatagcagatataatctataccctttgtcagtaatgaattactccccgtagcaattttctggggctttttccccatagttttaattatattcactttcttttcttgcctagcagagcttctaacattgtccttcagaaaaactgcagttttttggctctcaaatgtgtgtgtttttcccaggattcaactctacctttcttactttttattttttagtttatattactgaaatactaaaaatctcttataataattataagagatcaaatgtaaactttttataataaggtaaagtttattgtactttactttctccaaagtacaattaacttttggtttactaatgtttttattacccttaaatatgtgttaatccctgtactccatagattattttcctgcaaaatattcaaattgctgtctcttccagcttatcattttcttccaagtagatatcatttaatctataatctaaaatagacaatcatatggaaaatatctgcacagtatagggtttttaaaaaaatatataaggtgtgtaaattatcacaatatgatttattctttcaccaatatttcaccaaatatttttatgaaagacattgagaggtataaatattgttatgcaagagagtgcaagtcatttattattatgacacatcaactcagtaatagaattcaaattagcacccacagaggactcagttgcttttgaaatacaaaagatcagggtttaatgtcaggcttggtttctcatgaaatgtctgtccttgggactgctgaatctcaatttcacattcaatgtcctttccaccacattctataatagcaattagaaaggcatgagctatagcgctggctccaatggagcccatcattctaggctttgttttattgtgttgtgtttttgtttcactttatgtgtaggcaatggaccacatttctatgtttcttctcataaattttataaaggtcaagccaaatgatatatatgattcccccatttctaattgtttcttaaatacatgtttctgaatcctgaccacccatggttctaactgctttaaaaacacaatgttttatgcaatcatgaaaacaaacaagctattttgtgcaatattaattcattctacaaatatttgctgaacatacactaaactgcagatatcatgcacgtaagcactgtgataggaataaaacaagacactgtccctgttttctgtatgaatataaacgaggtgggaggatggatggcacatgagtcttcgaaaaagagacaagcaatccaatgattatgcttcagtatcacatagcagtaagggtgatgaaaaattagaagcattatacttagtcatgccctaaggcaagggtcagcaaactatggcctgtggctcaaatctggctttcttcctgtttctaaaaatgaagttttattggaacaaaactgcacccattgctccctcatttagttatggtctatgactgccctcgtactataattgcagagttcagtagtcgcaacacaggtcatattttccacaacacttgaaatatttattatgtctggctttttagagaaaatatttggccactcctgttctatggaattgtttcacacctcaattttgtgctcaataaaaccgtaactataggtttccttttatttcctagcctgacttgcctttgggttgggcaatgtgactaattctcatcaaatacaatattagtagaagtgacatttttctatccctctcttactctcctaatgatgtagttgaaagatgaaggaaagtcatgaaactcactaattagttttatgagatgttaaagtgaaccttccttttttatatttttattttaagttcaggggtacatgtgcaggtttgttacataggtaaaggtgtgtcatgggggtttgtttaacagattattttatcgcccaggtattaagcctagtactcattagttatttttcctgatcctctccctcctcccaccctccaccatctgataggccccagtgtgtgttgttcccctctatgtgtccatgtgttctcatcatttagttcccagtgatgagtgagaacatgtggtatttgattttctgctcctgcattagttcactcaggataacagcctccagctccatccatgtccctgcaaaggacatgatctcattcttttttatggctgcatagtattccgtggtgtatatataccacattttctttatccagtctatcattggtgagcattgaggttgattccatgtctttcatattgtgaatagtgctgcaatgaacatacgcatgacgtgtctttgtaatagaatgatttatgttcttttgggtatatacgcagtaatgggattactggatcgaatggtatttctgactttaagtctttgaggaatcactgcattctcttccacaatggttgaactaatgtatactcccacctgtagtgtataagtgtggctttttctccacaaccttcccagcatgtgttattttttgactttttaataatagccattctgaattgatttgaaatggtatctcattgtggttttggtttgaattactctaatgatcaatgatgtagcactttttttcatataattgttagctgcatgtatgtcttcttttgagcagcagtgtctgttcacttttctttcttttttttttttttttttttttttttgagacggagtctctatcacccaggctggagtgcagtggcatgatcccagctcaatgcaacctctgcctcctgggttcaagtgattcttgtgcctcagggcctcgagtagctgggattacaggcaagcattaccatgtctggctaatttctgtctttttagtagagacggggttttgccgtgttggtcaggctggtcttgaactcctggcctcaagtgatctgcccacctcatcctcccaaagtgctgggattacaggcgtgaacgaccatacccagcccccaatgcccactttttaatgggggttgatttttttttcttgtaaatgtaagttaatttcttatagatgctggatattagcctttgtcaggtgaatagtttgcaaaaattttctccccttctgtgggttgtctgtttactctgttgacagtttcttttgctgtacagaggctctttagttttactagatttcatttgtcaattttttcttttattccaactgaaggaacacttatacactgttgatgggagtttaaattagttcaaccatgaagacactatggtgattcatcaaacagaaattttgaggatatttctgttcctaaaaacaaaaatataccatttgacccagcaatctaattactgggtatatacccaaaggaatataaatcattctgtcataaagacacatacacacatatgttcactgcagcactattcacaacggcaaagacatggaatcaatctaaatgcccatcagtgatagactggataaagaaaatgtgggatataatatatagcatggaatactatgcagccataaaaaagaattagatcatgtccttttcaggaacatggttggagaccgaggctattatccttagcaaactaacacaagaacagaaaaccaaatattgcatgttctcacttatatgtgggagctaaattataactaatggacacatagagaagaacaacacatactgggcctattggagagtggagggtaggaggaaggagagcatcaggaaaaataactaatgggtactaggcttaatgcctgggtgacaaaataatctgtacaacaaaccccatgatactattttacctatgtaacctgcacatgtactcctgaactcaaaatagaagttacataaaaaatttaaaaaaagaaatgagaacaaagaagctgctttgaggaaactcaacaaaattcaagataacgcagatgaggtattcagaatcctatcagataaatttaacaaagagattgaaattattgaaaagaatcaagcagaaattctggagctgaaaaatgcaactggtatactgaagaatgcattagaatctgttaaaagcagaattgatcaggcagaagaaagaattagtgagcttcaaaacaggctatttgtaaatatatagtcagagaagacaaaagaaaaaagaataaaaaagaatgaatcatggcttcaagatctagaaaatagcttccaaagggcaaatctaacagttattggccttatagaggagggagagaggtgggtggaataaaaagtttactcaaagtgagaacagagaacttcctagacctaaagaaagatctcaatattcaagtataagaaggccatagaataccaaggagatttaatccaaacaagactacctcaagctatttaataacttaactctcaaaattcaaggataaacaaaggattataaatgcagcaagagaaaagaagcaaataacgtacaatgaagctccaatatgcttggcagcagatttctcagtagaaactttacatgccaggaaagagtggcatgacatatttaaagtgctggaggaaaaaatgtttatcctagaatagtatatccagtgaaaatatccttcaaacatgaaggagaaataaagactttcccagacaaacaaaagttgagaaatttcttcaacattagatctttcctacaataaatgctaaagggagttcttcagtgtgaaagaaaatgacgttaatgagcaacaagaaatcatctgaaggtacataactcatgagtaaaaaaaacacagaatagtataacactgtaattgggatgtgtgaactcatattttgaggtgacaaatgaaaaaatagactgataataacaagtatgaaaacttttcaagacatagacagtacaataagacataaatagaaacaacaaaagttaaaaagtagggggacaaagttaatggctacaatatttattagtttttcctttgcttgtttgtttatgtaatcagtgttaagttgccatcagtttaaaataatggattataaaaaattatttgcaagccttaaggtaaattcaaattaaaaatcctacaatagatacataagaaataaaacaagaaattaaaacataccagcagagaaaatcttcactaaaaggaagagagggaggaaggagagaaggaggagatcacacaaaaaactagaaaacaaataacacaatggcaggataagtgcttatcattaatatcaataatattgaataattagactagaatctccagtcaaaagacagagagtagctgaatgggttaaaaaaaaaagacccaacaatctattgcctgcaagaaatacacttcacctataaagatacacatagactgaaaataaggggatggacaaagatattccatgcaaataaaaatcaaaaaagagcagtcgtagctatactgatatgacaaaatagatttcaagaaaaaactataaaaacagacaaaaaatcattacataatgataaagggtgaaaatcaagaagatgatatcataatttcaaatatatacgcacccagatatataaagcaaatattattaagggtaaagagagacataaaccccaatacaatagtagctgaagacttcaacaacccactttcatcattggacagatcattcagacagaaaatcaacaaagaaatgtcagacttaatctgtactataggtcaaatgggcttaataggtatctacagaacatttcaatgaacagttacagaatatacattcttctccttagtacatgaataattctcaaagatagaccatttgttaggtcacgaaacaagtcttaaaaaaactaaaaaataaattgaaattatatcaagtatcttctttatccactataaaataaaactaggaatcaataacaagaggaattttggaaactatacaaacacgtgaaaattaaacaatatgctactgaatgaccaaatgggtcaatgaagaaattaagaggggaatttaaaaatgtcttgaagcaaatggtaatgaaaagacaacatagcaaaacctatgggctacagcaaaagcagaactaacaggaaaatttatagctataagcacctacatcaaaaaagtagaaaaacttcaaataacctaacaatgcatcctaagaacaagaaaggcaagagaaaaccatacccaaagttagaagaaaagaaataataaagatcagagcagaaatagataaaattgaaacaaagaaaataccataaatgctaaataaaataaaaagttggttttttgaaaagataaaattgacaaacctttagccagattaagaaaagagagataagcctcaagtaaataaaatgagagaagaaaaagacaacgttacaactgatgccacagaaattcaaaggatcattagaggctcctaggagcaagcagtagtctcccagcaaagaaaagcccaggatctgatggcttcactgctgaattctaccaaacatttaaagaataactaatacatgccttactcaaactatgccaagaaatggaggaggaggaaatacttctgaactcattctacaaggctggtattaccctgataccaaaaccggacaaagacacatcaaaaacagaaaactacgggccaatattcctgatgcatgttgatgcaaaaattctcaacaaaatactagcaaaccaaattcaacaccacattaaaaaggccattcattatgatgaaggggaatttatcccagggatgcaaggatggttcaacttatgtaaatcaatcagataatacaacataccagcaaaattaaggacaaaaaactacataactgatttaattgatgctgaaaaagaatttgataaaattcaacatcccttcatgataaaaacccactgggtatagaagaaacagacctcgaatagtaaaagccatgtacaacagacccacagtatcatacaaaatgggagaaaactgaaagcctttcctctaagacctggaacttgacaaggacgcccactttcagcactcttattcaccgtcatactggaagtcctggctagtaatcagacaagagaaagaaataaagggcatccaagttgaaaaggaagaatttgaattagcctttcaaaatcttacatattttgaaaaacctaaagattctaccaaaaaactattagaactgataaattcagtaaagttgcagaatacaaaatcaacatacaaaaaccagtagcatttctatatgccaacagtgaataatcagaaaaaatagaacaaagaagtctcatttacaatagctacaaataaaataaaatatctaggaataaacttaaccaaagaagtaaaagagctctacagtgaaaactataaacacggatgaaagacattgaaaatcatataagaaaatgaaaagatattccactttctggattggtagaataaacactgttaaaatatccatactacctaaagcaatctacagattcaatgcaatcattaacaaaatactaatgatattcttcacagaaatggaaaaaacaatcctaaaatgtatatggaaccaaaaaagacccagaagagaataagccatcatgagcaaaaagaataaaactggaggaatcacattgcctgacttcaagttatactaccaagctatagtaaccaaaacagcatggttctggcatagaagcagacaaatagaccaatggaacagaatggacaacccaggaacaaatctatacactgacagtgaattcatttttgacaaaggtgtcaagaacatacacaaggttacataagggaaaagacagggtggtggtggaaaaacaggatatccataagcagaagaacgaaagtagacccctatctcttgccttatacaaaaatcaaatcaaaatggattaaataattaaatctaagacctcaaactacaaaactactaaaagaaagcatcagggaagctctccaggacattggactaggcaaaaatttcttaaggaacacttcacaagcataggcaaccaaagcaaaagcggacaagtgagattatatcaagctaaaaacttctgcacagcaaaggaaacaaccaataaagtgaagagaccacctaaagaatgggagaaaatatttacaagctatccatctgacaagagattaatagccagaatatgtaaggagatcaaaaaactgaaaaggaaaaaaaatctaagaatctgatttaaaatgggcaaaagatcagaatagacatttctcaaaagaagacatacaaatggcgaaccgatatgagaaaaggtgttcaatattactgatcatatgagaaatgcaaattacaactacaaggaaatatcacctcaccccagttaaaatggcttttatccaaaagacaggcaacgacaaatgctggcaaggatgtagagaaaatgaaacccttgtaaactgctggtgggaatgtaaattactacaaccaatgtagagaaaaatggagattttggaggttccttaaataactagaaatagaactaccatatgatcctgcagtcacactgctaggtatattcccaaaagtatatcgaaaacatagctcattctctctcatgtttattgcaggactattcacaatagccaagatttagaagccacctaagtgtctatcaacatatgaatggataaagaaaatgtggtacataaacacaatggcatactattcggctataaaaaagaatgagatcctgtcatttgcaacaacatggatggaactggaagtcattacgttaagtgaaataagccaggcacagaaagacaaacattgcatgttctcatttatttgtaggaactagaaaaattaaaacaattgaactcacagtggtagagagtggagtgatggttaccagatgctaaaaatggtaatttgggtggtggggggagtgggaatagttaatgggctcaaaaatgtggttggaatgaataagatctagtatttgatagcacaatattatgactagagtcagcaataatttattgtaccttttaaaataactaaaaccgtataactgaattatgggtaatacaaagaaaggaaaaatgcttgagttgatgaacaccccatttaccccaaaatgattattacactgcatgcctgtgtcaaaatatctcatatactctacaaatatatatacctactatgtaccccaaaaaactaaaaattaaaataaaaaagagatatctatgtggagaaatggaataacagcaatgggagaaaagaataaagagatggtcataatattaaaatggagataaaaaagaataggtctagaatattcatttaaacatgtttgatttaatataatttttactactcaaatagaattgcactcagccattcagtataaaaaagaaaaagtgttttcacaaattcactgaaattacatattgaatttgccaagctttgatatgtagaatgaattgcacttgtgttcgttgtggcttctccactttaaaacatatccctccactgtggtccagtcctcatatcaccctactttccagaggacttgcttctatacatatttacttagcaggagtcagcaaactacatcttatgtgccaaagccaggcttctgaatatttttgttcagcctgaaagctaagaatggttttcacattttttatcgttttttagaaaaggaaaaataatattagtaacacatgaaaattgtatgaaactcaaacttcactgtttgaaaacaaagttttatggagacatagccatgtccattcattgatgtattgtctatggctgttttcctgctacagtagcagagtgtagtagttgtaacgtagaccttatgaacgaagacttaactattttactctctgatcttttataaaaaaaaaaaattgtgaccctttctataaagtgaataggaaatttcagctgggcacagtggttcacgcctgtaatcccagcactttgggaggccgaggtgggcggatcacgaggtcaggagatcgagaccatcccggctaacacggtgaaaccccgtctctactaaaaatacaaaaaattagccgggtgtggttgcaggctcctgtagtcccagctactcgggaggctgaggcaggagaatggcgtgaacctgggagggggagcttgcagggagccgagatcgggccactgcactccagcctgggcaacagggcaagactccatctcaaacaaacaaacaaaccaacaaacaaaagttaacaggaaatttctctgaggaggtaaagttgaacagacacaggaacgactgtgattgaatcagggaaccagtgcaacataaaaaggtaggaccccttgtttcaagagcaggtacaaaaacttttttctttttcccatgttctctctctagatctgttatggtgttcttttatttgctacttaacgtattgctcccttggtcatggaaacactcacagggtgagggcagattcttacaggaatgcagtggctctgccctgcaactcagtaagtgcatctgaccttgacccttccccacactcatggtctcactactgcatcagcagtttctgggcaggccaggggcacctgggttggaggagcaggtggaaaagaattttactcagtaaagaaagtagaaatagggtggaaagtgggaaaacagttaagtcaagattccaagccccaacacatgttcaattttcccataaaccgccttacaaaaccctgggccaggagcaccagggttgggggagctgctagagtccccagtgtctactgttcccatctttatgtctgtgtgtacccaatgtttaggtcccacttattagtaagaatgtgtggtatttggttttctgtttctgtgttaattcactcaggataacggtctctagctacattcatgctgctgccaaggacatgatttcattcttctttatggctgcatagtattccacagtgtatatgtaccacattttctttatccaatccactactgatgggcacttaggctgattccatgtcttctctatagtgaatagcaccgcaataaacatatgagtgcaggtgttttttggtagaaatatttattttcctttgggtctatatcaacctgggatattttgtgtgatacatatgacgaaaatatttaattctaaatatttttttctcaaaatgatagcctactgtcccaataccattatttatccactgatttgaaatgtcacctttatcatatactaaatttccaaatagagattgggcttgcatttttggactcgactatattcccattgatctatttgtctattcctgtactaacatcacactctcttacttactgtatggcttctatttctagagctcctagtgcgtggatattggatctctttgacccttcctgttttatatactgggagtattctacagttcattgtcctaaagaaccttcattaatttgctaggaaatacttattgaccattatcagctgtgtggtcaggcgctgttgtagcctctggggatacatcaatgaacaaataagataaggcacataattttaggcattttgttttaacttttggtgtgattatgctatttttaattttaaaaacttttcttttttttcaagtattccatttttaaaatagcctgttattaactttataagttcaatcacctctcaaatctttctgaggatactgattagagtctttttctggcattaagtcagttttcttaaaggttccttactttgttcattaagcctggtttctctctttttggttgttaatttttcctcaaccatctggtgtcttggtcaagcactttttatacctagggcactgtccccacattaggagcttcagggggtccttcaccttccttagatacttattaccatctggtgggcaaacaacaaagctgattgctccacataggagatgctaaggttctggttgccctgtccactccctggctttgataaccatgccctgttgctcaggcttgagattcttcgcagaggtctaatgaggatgtcaaatccactcattgttccagtgacatcttcccctcttccaccagtgttggatggtgggctttttcctcttgttttgtctaaatctagcaatatttgattttatcttttagaatttcgcaaatgcctcaggtagtaactctccctgtttttcatcactgctatgaatttattgttaattttgtatttatttttaccattttgattgcaagtaaggaggaggaaaatgtaaacacttgcgatccactcagctttatcagttagaattctcatatttctctgtcttgatcactttgaagactgtatataagagatttgaggaagtctggacaactcgaagaaagtaagtatcattgccatttcatcacagatgtcatgcaaatggaaaattattatattttcttgatttttcaataaatggaaaacaattttaagtgaagtacaattttttggttgttatgaatatgatgttaatgtgatcaagacttgctctaaagatgtagaactccttatcttcaggtaggcaaatgcaattcttctgctttatagattatggccaaacatagacaaaaaatatatgatcaccacaagggagttaaagaagtcgtgagtgagtattgagtatttaagagacgtggacattcttctaggcacttgaaatttgttgtctcattgaagcctataatgttagtatcaaaagtagctattactctttccattttatagacttgagattcacagataatctcagttaagtgggagagctgaaattaaagttaagtgggagagatgaaattaaaattaagcgggagagatgaaattaaaacacaaatctagtgaatttcaaattgattgcattttccccgaaagacaccacactataggtaaagcaaagagaagcaaacatatttacaagtaaagccaagagcctaataactcttgagtttctcatctttatatcaacgcacaattttcctactcttcagtctattggtagcattgatttttttaaaaatctacattgtttcaaaagctgttgaaataaaacgcaagtgggtggaaaatgggaataaatagtatctaattctgctatgcattaaactcttacagtcactacattttttataagagaaaggcagaaaatttttaaaaatctttatatctcctgactttagctcttcatttcatttttatatagaggtatctgactatgaaataatatgcatactcatcttctatttaaaaagacaaattataaaacagactgtagggactctgtactgcttctcagacactgcaatcccacataggagcaaggtcagatttactgatacaggcaactgtccaaagcagctcttctcctgctagctgttgatgttctcttcctctctgccagctccataacaagggccctcacccggtgcaccaccctcgcccacacacacaccctgaccgaggccctgagagttccaggttcctgcacctgcctttcctgcccagggctttttgagaacagacagttgctctcaagcccagggctttctgagagcagacagttgctcttgagcccttctctgaggtcctctgaacacccctactccaccatcaatcagagcagttatactttttttttttgcttttacctattaggtttctgttaggttgaaacatatgaaactgctgatattcaaccgtattacctgcaaaaatagcaatttcatataactcagcctacataaacttttcttttaacagagttctctggctaaataatttgaaaaccatttctctaggccttaagtgagcctgacattttgctggccccagtaaaattgaactctttcccttcttagacatcactagtaagagtataaagacacatgcacatgtatgtttattgcagcactattcacaatagcaaagacttggaaccaacccaaatgtccatcaataatagactggataaagaaaatgtggcacagatacaccatggaatactatgcagccataaaaaggatgagttcatgtcctttgcagggacatggatgaagctggaaaccatcattctcagcaaactaacacaggaacagaaaaccaaacaccacatgttctcactcataaatgggagttgaacaattagaacacgtggacacagggagggaaacatcacacactggggcctgtccagggggtgaggggttaggggaaggatagcattaggagaaatacctaacgtaaatgatgtgttgatgggtgcaacaaaccaccatagcacatgtatacctatgtaacaaacctgcgcgttctgcacatgtattccagagagtataaatgggtatatgcccttttcagggcaacttgtcaaaatagattttttaaaagtgttaagtctatccctagtatttaacatacataagcatgagtgtggagtttgttagatggaaaatttgtaatatatgtttcttcgtatgagttagtttcttcatacaatgtattcaaatcttcattggaaagactgtatacacacatgagaggataataaaagttctagtttttattctagttttatttaataaaggtcaaaagtagttttggactcaatgtagatattaaagacctgaaaagcattttgacctccaaaccatggagtttgtcctcatagaagctttcccagcatgaaaatagtcacaactattttgcaaaaaatactttttgacttaggtattgcaaatacttatatattaatattttatagatgttcatgtcaacttcaaatgcatccagaatttaaaataagtaaaaccagctttattttccacacttaagttctttttttaaagcaacaatttcaagtgatttgtttcatcttaggaacagcaggaaataattatgcaatggattatagaagatatattctgaacagctaaaataggaagcacatatcactgtgtgggtgaaagaaagacatttttacaaataaaggtgcacactgctttttaaatagcttaattttttaattaaattttttattttcaataattgtagattcatatgccattgtgagaaatcatagagtgcactcatgtttctttttcctagattccctcagtgggcacatctcacaaaattatagtgcaacatcgtaaaaaggacaagaaacagagcaattccatcaccacgaggatccctcccattgcccttttttttgagagggagtctcgctctgccgcccaggctggagtgtagtggtgagatctcggctcacggcaagctccgcctcccaggttcacgccattttcctgcctcagcctcctaagtagctgggactacaggcgcccgccaccacgcccggctaattttttgtatttttagtagagacggggtttcactgtgttagccaggatggtctcaatctcctgacctcgtgatccacccaccttggcctcctaaagtgctggaattacaggcgtgaaccaccgcgccaggccccattgcccttttatagctacactcacttctctcctgcccccacctccaccttaactcctggtaactaccgatctgttatccagttctacaattttgtcacattaataatgctatattaataggatcacacagtatgtaaccttttaggactggcttttctcactcagcatacttttctgcagattcatccaagctgttgtgtgtatcaatagcttgctccattttattgctggatagtattcaatgacatggatgtttaaccattcacccaatgaaggacatctgggttgtttccagtttttagctgttatgaataatgctgctataaatatttgtgtacagatttttcagtgaacatgttttcatttatctgggataaattcccagaagtacaaatgctggttggtatggcagttcaatgtttaatgttttaagaaactgccaaactgttttccaaaattgctgtacaattttacatttccaccagcaatctatgagcttctctgtatccttgccagcatttagtgttgtcacaattttttattttagcccttctgataggtgtgtagtgatatctcattgtggttttactttgcgtctcccttgtggataatgatgttgaatatcttttcttgtgcttatttgctgccatctacatatcctctgcagtaaaacgtctcttcatgtcttctgcccattttctaattggattatttttatactattgagttttgagagtgctttataagttctagatattattctttgttagatatgtgatttataaatattttctccagtatgtaccttgtcttctcatcttcttaatagggtttttcacagagcaaaagtttttaactttaatgaagtacatttttttttaaccagaggtgctagtcacaccttattctttgatagagcataaacagaggtggggagggagacagtgcaaagggagaagggcaggctcttgagagcgaggttactggcatgcagtcaggccccctctgatttggggactatcacttcttaaacacgtgctctgtggccgttgccatgccaagctcatttatatttgggaggaaggagaggatcaggacaatttatttttttatggattatgtctttggtatcaagtataagaactctttgtctaactctagatcccagaaatttttttcctatttttttctaaaagttttatagttctatattttaagtcaattatccattttgaattaatttttacataagccatatgacttaggtcaagtttcaacttgtggcctgtgtatgtccaactgctccagcaccaggctatcttccctccactgaactgcttttgtacctttgtcaaatagcagtcaggtttatgtgtatgggtatatttctgggttctctcttctgtcctattgatctaagtgtctatcccttcactgataatactacattgtcttaagtactgtagctataaaataaatcttgaaactgggtagactgattcctcccacttttttcttctctttcgatttttttttagttatcctagttactttacgtatctatgcaaatattagaataatcttatatttacaaaaaagtgttgctgtgactttgataggaattatgttaaatctaaatatcaatttggaacaatttacatctttgctacactgagtcttctaatccataaacaggtatgtctttccacttctttgaacattttttttcatcagtgttttgtagttttcagtatacaagacctgtacatgttaaagaggagttcaccgaggctcataatcaaactatcaaaaattaaagacgaagaaaaaattctgaaagcagcaagaagtaagaaacatatcacatacaaagaagtccaatgtaactatcagtggatttatcaggaaaaaccctgcaggctaggaaaggggtaggatgatatcttcaaactgctaaatgaaaacaaattgccaaccaagaatacttaaatcagttaagctgtccttcagaaatgagagagaaatagtaactttcccaaacaaaagctaagggagttcattatcactgggcctgtttcacagaaattactaaagggagttctttaagctgtatcaaaaggccactaattaataacataaaacatgcaaaagcacaacactcaatggtataagcattacagaatcacattcagaatactctggacaaaaatgttggtatgcaaagcaattttatctctagtacaatggttaatagacatctattaaaacaactataaataaaataatcaggggatacaaattacaaaatgatgtaaattttgacatccaaaacataaaatgagggatttggataaaagtgttagatttatatctaattattattttttctttttgtatttgtgattataaatgaccttgtatttttaatttctgtgtatatatgttcataactagttcacagaaatacaatttttttatgtgtatcttgcatcccgtgaccttgttgagctcacttattagtcacaggagtgctgtttttgttttgttttgttttgttttttagcttgcttcggatttctacgaagacaatcatgtcatctgcaaataggaagtttcagttttcctttccaaatctgtatgccttttatttttttgtttttcttcttggcacaggttagagcttccagcactatgttgagtgacagtggtgagcacagtggacatccttgctttgttcctaatcttagaaagaaagtcttcatgtttttaccattaagtataatgttagctgtagattttttatagatgctcttcatcaagttgagaaaattcccctcaatttctattcttttaagaggtcttaaaaaacaaaacaacatgaatgggtgttgaattttgttgaatgctttctgtgtatcaattaatatcattatgtggattttcttctttattgatttcaaatattgaatgagttatgcatccctaaaataaacctcactttgtaattgtatataattttaaaaatacatttctgaatactatttgctaatattttgttaggaattttttgtctatattcatgaggaatattgctctggggtgtgggtgtatgtggaattgggaatactaggtcataaaatgaattagaaaacattcccccattttcttttttcaagacaagattgtttagagttagtgttaattcttctttaaatgttgttataattctccaacaaaacaatgtgagcttggagatttattttttgaaagcttttttgattatgaattccatttcattaatagttgtagggctattcacattatgtattacatattgggtaaattgtggtagtttgttttaataattgatccattttagctaagttgtcaaatttatgtatgtagaatagtttgtaatattcctttattatccttttgatgtcttcagggtctgtagtgacatccctattttattcctgatataggtaatttgtgtctttcttttttctctcagtttcactttaagaacagtaggaaataacaatataatgatttacagaagatatgttcctagcagccaaaatattaataaaagcttatattgctgtatacgtgaaagaaaatttttacaaataagagtgggcattgcttttggtttttaacttctcaaaggtcattctgctttctaattcttgtttttagagatagggtctcactctatcccccaggctagagtccagtggtaaaatcatatcttactgcagcctcaatctcctgggctcaagcgatcctcccaccttagccccctgagtagttagcaatacaggcacacaccaccgtgtccaactaattttttaaaactctttgtagatatatggtctggctatgttgccaggttggtctcaaattcctggcctcaagtgatgttcctgtcttgacctcccaaaatgctgggatttcaggcatgagccagcacacccagcctgctttctaattcttaagtcatctctttactattatagtaatagtgcccatgaaatacattctgtttcaggtatcctacctttttttcatctaaatcctacaaaaactccacagatgggcagacagggaaactgagtgtcaaagatactcagtaactattggacagctttagaatccagctctctcaacacttaaaagccatgaatacactttccattacatcattctgtctttttgctataattacccaaaatgtcttcctatacaataaaaataacagaacttttttagcttaatgatagtttaaaagaatattttccccagagtatctgtaaaagcatttaccacgagggttatcacaaagtaataaatatgttagtaggtagaataaagttaaggtttaaaccagaaagatgtgacaatataagtacttctgtgaataaatttaagatggtgtgaagttttaagaataagcacatagcacttcccctggagtaaaatataatcagggtcataaaaatttgtgtcataatatgatagcaataagttttaaagtgaagataagtattacaattaattttagctaacaagttcaactccttttctgctatttttctaaaacagttataaaaatgcccattaataaaagtttgtctttttttcctgactcattcctggcaaaggaatattcaaaaggttgatatgaaggggtataagtatataaagcaagtgttaaaaaatacataaactcagtaataagcttctaaataatcaagaattgttatgatttgtatgtaaatttcatttggatttccctcaaggaaacaaaatcattaagttctgaaatagtctctaattctaaaactcctttcttcatcttcatatcaatgaaaaaattggtatcctcaattaaaaagtacctttatgtttctaactaattcctatgggttaaacttattaacacatatttgggagacaaaataggatttgcagcaaagtagaattggattcagatcctaatgtcggtatttacagtttagtatttgcattcacaaaatgaggattatataagcctccccacagaattattgtctggattaattgagataatgtaaatgaaagactagaataaggcctaaattagtaaaggattgataagtattcatcttcttctcccactgtaatattttagtataagtaggatctaactgaaagaagacattgatgagttaaatcataaggcagccctcctaataaatggcagaatcaccaaattacatgaacagtccagcagaatctccctgacacaatttacagaggtgaaggttgaaggaaaagaggaaatcaataggttcggaagaaaatacagcacacagacttattttatcagtgtttaagagagctgccctggaaattgcagtaagagctctaagtagaaaccttccgggggcgtctctgatgggaaataagtggcagagaccctggtagaacctctctaaatagcccaccatctctgatttggaggagtgagggctcatggcaatgagggaccacaaagaagggggaaaaagaagagaagatacactccaattaatcacaataagcctttttagaaagcatggcattaggaggttaaagagcccctgtggtgacttgtttacaggagcagaaagttaagaggctgttaggagcttgaagaggaaacatcagacttcagcttctgagaaagaagttagtcattagacatattttgctttagaaacaaacccaagtgatatagtttgaatatatgtccccatcaaatctcacactgaactgtaatcctcagtgttggaggtggggcttggtgggaggtgactgggtcaatggggcaaatccttcatgtcttggtgctgtcctcgtggcaatgttttcacaagatctggttgtttaagtgtgtggcacctccccaccaaccccactctctctcttgctcctgcttttgccatgtgatgtgcctgcttgcacttcacaacttctgccatgagtaaatgctcccttaggcctccccagaagccaagtagacggtggagccatgcttgcacagcctgcagaaccgtgagccaattaaatctgttttctttataaattacccagcaaagcaggcatttctttagagcaatgcaagaatgtcctaacacaccaagcaaaacataaagatggatgttaatgtgccctggtgcaatggcatcaccaaacacagataagacagcacaaaataattcttcttgatgggactgctcattcatgactctgtcatcttctccacttaccagatttaagagaaataaccagcactatccaatattaactaaaagatagatgccattctttccctcaagcacctcatattttagtgagaaagctatgaaagaggaaggtgaaaagtcctatgaagaaatagaacttcctatgaagacatataaccagggatctaacctaatttggagtgtaaagagaagcttctttaaggaagtaatctttcagctgccacctgaaggagatgtagaaattagctaagtgaaagcagtgtgagcgggttaaaatgaagtgtccaagtcagaaggaacatgaaatgccgtaatcctgatgtttacagcaggaaaagatacagacagcacatgtaaggaactaaaaggtggttgatgtgttcgggatacaaaaaggaagaagaagagagagaatgggcacatctttccagaagtttgtgaaatcgaataaaatttgcatagctatgggagatactattctatgatggcattgacttgagtacattaaaatgctgatggaaatgaggtggtaaaaagagatatattaaagagataagaacaaaaaggaattgagagtaaaaatttcctacaaaggaggtaagggtggaatttagagaatgtgtgaaaagtttgatgtttagagaggcagaggaatgccttcagtttaataggatggagaaagaaatgaagaggttcagaaaggttttaaacattttttggcaaagtattgaggtaattccttgttgatgacttccagtttctctggaaagtgaggattaaattatctgagtagactaggaggaaaatcaggtatctgtgaagagtaaaattcaaaagtcattaggaaagttggcatgcaagctaactggagaaatttaggtctgctgagtagtgttaagggcccagaagagattgagaactatgaatttataacattaaaataagattatgaaaaaattcaacatcactgatcattagagaaatgcaaatcaaaaccacaatgagatatcacctcacaccagtcagaatgactaatattacaaactcaaaaaataacagatgttggcgaggttgtggagaaaaaggaacactcatacactgttggtgggagtgtaaattagttccattattgtggaagagagtgtggcaattcctcaaagacctaaaaacagaaatacctttcaacccagcaatcgcattactgggtatgtacccaaaagaatataaatctttctatcataaagacacatgcacttgcacgttcactgcagcactattcaccataacaaagacatgggatcaacataaatgcctgtcattggtagactggatttaaaaagtgtggtacatatacaccatggaatattatgcaacagaaaaaaaaaggaatgagatcatgtcctttgcaggaacatggatggagctggaggtcattatccttagcaaactaatgcaggaacagaaaaccaaacaccacatgttctcacttataagtgggagctaaatggtgagaacatgtgaacacatagaagagaataacacacactgggacctattggagggtggagggtgggaggagggagaggatcaggaaaaatagctaatgggtactaggcttaacctgggtgatgaaataatctgtataacccccccaccccgacacaagtttacctatataacaaacctgcacatgtacctctgaacttgagggttaaattttttaaaaagattatgaattgattaacttctcgacttaggcttttttctattttacctgaaaataaatgaaacaatttattagtctctcactatttactcttgcacatatacatatatatccatatataaatgagttaatgcttttgcatttatttcagtgtaatataataagtagggaaatacgatgtgtgattattatatagttattatggattatgtactttatcaatataaaaatcctatttattcctatgctttttatctcagtggagtccaaggattaggccatgaaggattgaaagattcagagcaatgttccaggcagaagcgtatgttttgaaagagcatgctgcttttgaggaagtaaaataaatctaggtttggaatatagactagaagagatcaagaagtaagaattaactccagaaataaacagaaacctggtcatacagtttgatggctttaagttgaccaagcaatggtggtcaaacctgtgcttagctaggcttaaaagctatgaagtaaatagacaggtttgaaaaaaatagactatcactttgagaaacaatctggattttatgtgtactattttatttaattttttcctcctgtacaggtagcagaaacacacacacacacacacacacacatacacacacacacccataaggaaaattttaacttgtctatctatctatctgtcatctatctgtctgtctgtctgtctgtctagttaaagcaaactaaatatggcctgagaaggactccatacttccatatttgaatccttgtggatgaaccataacctagcttaacaggcagacaagatgaaaacctaacttaggagtatgtgcctgtaacaatagctgagtcttggccaatcacagcagccatacctcaaccactcatagactgctaagtgttcaaacagggttcaattaaggcaaaagccaacctgtaaccagccgtttctgaacctcacttctaagttcttttctgtacctcactttcctttttatgtctataaattagttctgaccacgaggcacccctggagtctctgaatctgctgtgattctgggggctgcccggttcacaagtcattcattgctcaattaaattcctttcaatttaattcggctaaagtttttcttttaacaatatataaacacacacccacagttgtacatattacaaatttgcaaataatctgtgtatatttatattcagtttattttgtagttaacagttaacatttttatagttaccatataattaagttattcatatgattaaattagctttcaaataatttttaatatttttaatattctatcttccattcaaacaaaaatttttattctaattcttttctgttataaatagtagtacaatgaattattttacagaattgtttcctctttctgggcatttcattggtacagacaagaaagtactagacgaaaagtagtatgtttttcaagattcttgattcacattaccaagaaaatgtatagaaacatttccaccattgttctacaagactatcagtctgtgcctgcatcaccatgaatttaccatgcatttgctaagcacaggatatatttttgtttttaaaaagttttaactacttcttaggttatgttataactttattgtgcatttccttgatattcagcgccattaatcatttttccttttatttattattattctttttctttcttaaattgggtatttatattgtttgtccattttcctctgtggatgtgttagtcttctttgtggccttctaagagctctttgcatattaaaattttaacagtttcactgtttatatttatctctatagcattagttacttgttttctattttaataaagtttttttgatgcaaggcaacttaatttctatgaagtcaaggctatttatcttttcctttggtattactttcacaacttttgtgttaagtaaatgtttgtatctgtaagattatgttcgaaatattgacagtgtgtgtctctatcttttcatacattttgttagttaatagagaaatgactgctgagctaatcatttgtaactgttgtgacagaagaaagtgaagtgtaaagatgagaagataagaaaatgtgtctctcagagttgttattaatcaccgtcaatatttcattagagtgcattgcctaatgtctgtttatgtaatttaacttttttgaaatagtctttttcctcacatattttgactaacttaatgacccacttaatttattatttcatgtataattgcaattattatgtagatatccgtttgtgttgatatctctgtttttttaaatggaaattaatagaagatataaaatacttttggatctttctgatattcaaaaaatatttttgagaaaaattatcttaaatagtaatatgatttggtacttgactcaattcaatttagcatttattgcttgctgtctcatacaactgttctaagaattcatgtcaaattatatcagttattcctgtgtccatttagcatatatttattgtcaagttcttggctaaagcaagaatccaagaagagaaatttcacagactagtaagagattatttgcaatttctgctttttaaatagtaatgtaattaatatactttccagaaaatttttccatcttctttgatgcataagtagactcttaaaatacacatataaaattatgtgaaagtacacataattctaagaaagcatagcagaagggctagagacccttatatttaactatctacattatatctagagggtatctaaaacttatacaaaccaaacagacatttgatccttgctccccagttccagcaacatcaaaacaaacacaatgaaaatcactgatttttgcctagatctcaccatttcagtaaatggcatcgtgatttttcacagtgactcaagccataaatctggacatgcttgattcgtaacctgtatctcctaaattcaactctatggtaaatattattcattctactttgaaaacatgttctaaaaccactcatttccctatacttcggatttacccaccaatccaaataactgtacatgttctcttggacagctacaaaacgtcctaattgtttcccctatttttccctccataaggtattctctagccagagtgatcttttaaaaatgtagatcaaatcacatcacattcttgcttaacacccttcagtggcttctaattgcacttggagtaaaatctacacttcttaccatgacctcattggctctctgtcttctctggtttcatctcacagcactttgccctcacactgagctccagtcatgcatgccttctgtctgttcctctgctccaagttcatgtcttcatctgggtctttgtattgctatttcatttccctgcctggaacattcttcctctgactcttttcatggctaactgtttctcctcattcatgttccagctcgaataccacctcttcagagaggccttctctgattccaagtagtgactcctcctccaaatactgtttgactctgtgtagttaatttacagccctgatcacaatctgaagttatattctctatttattgttcacttgatcattgaatatttacctcctcttgaatagaggctccttgaggacagtgaactcttttgtcttgctcactgttattacctgtactatgatgaagcctggtaaatagagcacacttagcaaatatgagtaaaacggatgaatgaataagggcatctcagtgaagatggggtgagaaagggttatgctagctggtgcttggatcctacctaaaagaaagaacagaagttaaccaggtagagaaaaagagggaaatgcattctagactgtatcggaaagggtgcaagaacaagtctcctttggagagttgcaggaatttgggatgattgcatgttggcattgctggtgataaacaggagcccagtgcaagaacatttatggacttttatgccttatcgagtaagaagtttagaggttgtcatgaaggtaggaaatcctaaaggatgttataaaagtgaataacataatcatgttgacaatgtaataagatcactctcctcacatgggaaggagtctggcattgggtgagtagggtatccttgtagggtatcctcctactggcagtgtgaggaggtgtccacatgtggagggcagccagggtagagtcaaggcactgtaaaggtgagaagggtatccatcaggggccaaccaggcatgaggaatcagagcatacacaaagtaaggagcagggtggatgtgtgtgtgccatgccctgagcaggaggtgtccatgtggagctttactggcatgcggtatcagagcccaagtgggatgaggccagtgtccacatttggagatgaccctaaatgagaatcaggacctgatataataacaaaatacactatgaataaaggaagctaggtttctgactgtcagagaatagaactacaaatataaaaatgaattatgtgttgtttagatcgaaatcacattacttctgtaaactcatggctttcaatatatgttgagatggatggacacagaaatatagatgttcctgtgcatgtgtatatttgtgtatacatacccagacccacgtgcatacgtatatgtacgtactatgcttatatacaaatattctctagccctgcccactgagagagtctgagaacagtgacatcccagtagcaattaatatacgtagtgcctaaatcttggcattaaactaccattttatactaagaggaagtaaagcttcttagagaaatagctgattccacatctaggactggaaaatcatatatgagataagcctagaaatcccgatgttccagaaagtaaggaatgctcaaagagtgatggagataagtcaaaaggacacaggaggactccctttggcaaaactctaaataattcaaatatcaaaaccaataataataataatggagtataactaactcaataaaataggaaacatgggtctctgcaagtataaacaaatacacaagtaaattgaacgttttgtgaggaatgggatattcacatagttttaaagtacctccccacaaatgtatacacatttcagaagagaaacaaacaaacaaacaaacaaacaaacgaagagaaagagtaaccttacaatggagaagtctgaaagaaaccaccttaatcaagtgaccaaggtgaacatcatttgaaaaatcattatcacaaatcaaaatcatgcaccagctgataggatgcaataagaaaaacagagtcatctctgggtttttctgacaaagatacataccctgaatctaattataaggaaatatcagacaatccaaattgaggaacattacacaaaatagctgacctgttatattcaaatttgtgattgcttttaaagtcaagaaaagactgaagaattattccagatcaaatgagattgaacaggaatgaaaactagaagaatgtatgattctaaactagatacttttaccataaaacatattattaggacaattggtgaagtttgaatggagtcttaaggttaaatggtagtaatatatcacaattcattatctgattttgatgtttgtgttctggttatagataaatatccttgtttgtaagaaataacatggggccgggcgcggtggctcacgcctgtaatcccagcactctgggaggccaaggcgggtggatcacgaggtcaggagattgagaccatcctggctaacacggtgaaaccctgtctctactaaaaaatacaaaaaattagccgggcgtggtggcaggcgcctgtggtcccagctactcgggcagctgaggcaggagaatgacgtgaacccgggaggcgaagcttgcagtgagccaagatcgtgtcactgcactccagcctgggcgacagagcaagactccgtctcaaaaaaaataaaaaataaaaataaaaaataacacaccagtgctaatgaggcattagaacagcaacttactcacaaatagttccaggaaaaaaaaaaaaagatctttagaaaaaaaagatctttgcattgtgtttccaacttctctgcaattttgtgattgtttcaaaatataaaataataatcattttaaaatccatgaagatcactctgtgataaatatagaagataaattagaagtagaagagatgacatcaaggaagccatgatgggagctatttcagtaatcaagtcaaaagaattaagacaggtacagtgggagtagaagagaaaagcttagaaagataggaaacagaagtgacatgctttggtggctaatttgatacagaaagagaagtagaggaggagtctaggtggtacagttaattgatataaggaaggaagagcagatttttggagaaagatgaagattttgatgtctggcaagtaagtgtagtgagtcttatcttccaaacactgtacgttacttgaccaaatgaaatacaagttattggcttattgttaggatgaacttctattctctggcttcatgtttccacaagaagggaataccattagagtaacatcctccacctattctccgactccttattaatttatcccctaaggaattagagttactgagctgtaaaacgacattggggaaggaactaagcatgcttattattgcctcttccatgtttctcctcttcagagacataataaatatgttctctgctcttctgtagtaaaatcaccttgtaggttggctagctgtgccagtgactgggttaggatgtgtgtctaatccaagagtgaagttacagcaagcatattcagtaacatatctagaatcacattgtccaatcagttctcatgatgataataaaaagtatggcatttggtttcaatttgtctaactcttggattccatacctcagttggttctgaatctgggagagaaagcaagcagtgtggttaatttgtttcctaaattcaaaacaattataaaactctgtttattcctcccagtgtctaatatagtgcttaatactcacttattgaattgagttcaattaatgtaaaataaaatgatgctaaaataatactgtcttaaaggcgaaaatataggtccttctaattatttgtttttccattttaggcatttagcaccattgatttaaaacttgttcttcaacatgacataatctaaagatacttatttttcctttcctcacagataaaacagaaatcataatggtcttatccatctcacgtggtttctcaaaggattaaagtagacagtgtgtagataccactctgtaacatcataaataaatggcatatttattgctgagtttgggtgttccctttctcaacagtgtgaatttgtgcaagatgagtggaaaatcaaaccagaatggaattgttagggtcagctataaagaggcctatgaaatgccctagatcatgtttttcaaattaagttttgtgcatcactagttgtgaaatatattaatgggtttacatgggtggtagcgaaagaaggctctgaaaaatcattcagtgaagaaattatttaaccctgtatttccccaatatatttgacaatggaaactttttatataagaacatcacttacagaatgagtaatccatagatattaggacattctgactaagaggaaggtggcagaatatctggttgggacttcctaattattagaatgccctaagtaaatcagcacagcacttaagtaaaaagattctaaatcccttgcttatcctattcttctccctggactatgtatctgcctgctacgatatggatatggcttagtttgtccccaccaaaattcagattgaaatttgattcccaatgtggccgtgttggcaggtggggcctagtagagggtatttgggtcaagaggacagatctctcatgaatggcttggttctgttctagcaatactgacagttccaagtctgccaagactggattaattctcatgggtatggagtaattcccataagaggtatttgttataaagccagacaccactggagttttgcctcttcacatgttttcactttccctttgaccttctgccatgttgtgatgtatcaccagcagctgggcagatgtcaacacgatgcttcttgtacttcccagcctgcagaagtgtgagttaaataagcctcttttcttagttcattttatgttccatataatggaactcccaacctcaggtgttccattatagcgacacaaagtgaactaagacttcacctatctaatgcctattcaaacataaaggtcactttgagcatttcctctctggaatagtcttcactgccctttccccaactattcttaattaattcaggtggtacttattgacagccagttgtgaaccaggtactgttctcagtgccgaaattgagcactttataaaacaaggaaggaaggagggaggaaaagagagggatggaaggaaggaaggtagaaagaaataaaggaaagaagttcttattctcatggcatatccattccaggtgggaagaaagacactgaacaaatcaacgcataatgttagttcgggagtgaaaattgttataaaggaaaatagcataacagagacagagaataaagtggtagctactttatattcaatggtcaaaaagggcatctctcataaggtagtatttgaataatgacctgaaggaaggatgataattagcagtgttaagtctctgggagaagggctttccagacaattcaatgataagtacaaagaacctaaggcaggagctgtttggctaatctaaggtactgttgggaagatgacatggctagtgtaaattaaacaacgtggagaacggtaggagatgggttaagaggttttagagagtcagattatattggatgtcatgcttctttactttcagtgagatgggaagacattggaaggttgagcaggtgaataacgtgatctgatttatatatgtggccaagttacaaaaggacaagagcacaataatcaatgccagtaacaagatatgaagctttttcaaaggtctaggccagagatgttagtggctcatacaatagtgacagatgacagatggtaagattcaagatatatttttaaagaaaagttagaggactgatttttgaactttttggtctcaagatcccttgatgcccttaaaaattaataacactgaagattttttgttcatgagagtcatatctgttaatatttatataaaaactaaaaataaaaattctttaagcataatacacaagtgcgcattccattagccatcagaggtatgatgatgtcatcacttaccatatagcttctggaaatctccatttagaactcatgtacaaataaaagcagaacaaggcaaaatgtctttgtattattatggaaatatttttgacctcacagacctttgaaaaggttttgaagcctgctaagaggtcctgaaccacacattgagaactgctggcctagaggatttttttgatggaatggatctgaggtgtgagagaaagaaagaaatcaaggatggggtcaagtttttaagcctgagctgctattaactgaaatgcaaactgcagtgctatataagttaagtttaagacatcccattgagatttagggtagcctgctggacatgagcctggagttcagggaagtgggcaggcctggagatacaaatttaggaataatcagcacataaacagcattgaaagctctggaactggatgagaacacatggggagtgaaagtagactgagaataggtctgaggatgatccttggggcattggatcaatgaactccatcagtgaaattccaaaagttctctatttagagcacagtctcctttggttggttaaaagttattttaggatagaatccatattttagtcattttcatactcaaatcaccgcttaagatgcccagcatatggtaggcactcaactgtgtttattgaataaataaataaattaattaatgatgtcctttgtggtactttcacagctaaattccagaattttagaacaggcaagattaggaagttggaatgatcaggttcagattcatacagtaggtatactattcattgtatagtcaaacagatttccttgaacttagaggaagatgtaattgactgcaccctgtgctgtcaataataagtgacctaaagggaaggatagactatatttcaaattctagtctgccatttaagatatttaaagcaataatgccaactctactttctgatcattttattttgcaaggaaattttttcccagaatattttttctttctatgcattcttttatttaattacacaataaatttaaccagctttacagaccaatacatatatatctacaaaggatgtatttcatttttgatgaacatactatggcttatttaacaagttatccttactaataggcattaaggtttccaataaatatttcaataatgaacatccttgaacatatttttatttatttattaccattttaataaccacatttattttcattattcttatagcacatctattcttagccactcatgtgatttgaaaatacttttatattaaatgtctatttaatcaatatttcctcatctttataatgattcatttgcatctcttccaaaacttcaagttaatgtctaaactcaattttcttttgtttctcttcttctatttttattttaggtgccaggggtacatgtgcatctatgctttctcattcaggctgtctagacatgctctaggggaaaaagctgagccaaacaatgacacccactgagaattttatgcatgtgggagaaaaacccctgaataacacaaaaggaaaacacaatattaatacagtcttgctattactggcaatgtgggcacaaagtataaaaaattacatttcatgtttaggaaaaaagatgaaaaaatttttttacttgtagaaagtgccaaataacaaaaattctccatattcctgtaggataaactcacctggaatttcatcaaatgaatagaaatgaggatgaataatattccactggcatataattggcatgaccactatatggattgaaggtgattttaatcatcaatggaagatacaatgtacagtggttgttttctggattccggcttttccctcccctgtattaggtcagcctgaccctgtactgtgccatttatcctcactgactcctcccatatcccaaattccaggagtttatacttcctgtggctcacttaagcagaggcatctaaagaatgagatgcttgaaggtgagtatcaccccatatgtagccaacatcttcttaagtaggttccaatgatttagggaactttaaaaggttcccaaatacattttctaaaatccacagttgccatgatcagagctacttggggatgacacagagagttagaacattacttctcagaggtcttatttcaattgtaggcaaacatgatctaatcaccattataataacaagttgggccactacagggctttacaatgtacacagcaccatggcaccttttatctggtttgagtctgactacacccctgagaagcaggcaaggcaaataccattctcactttgctgaaaaactgagggtgagaagggtaatacagagtgcatgtgacagaagaaaggttggaactaaattccttttaaagaggcacctacaagcaaaattttgcacataattccaggaattgtgtagaccacccatagcctatccaagaacaccaggttaaaaatatttgccctcagacagactgatttaattggtcaggggtggaactcaggtatttttttaaaaagcttcccaggaaattcatatttgtccaaaactacttcaaaaattcatatttgtcaacgttgactgttgggtcctgttgccttctttctcattttttttcctttccaaatcgctctttgttttacttaatattattttctattacgtctatctttctgtttttagccttctcttctcactcagcttttgttgcaagtctggaaattactgaatacagtcttctttggctctttccttcagactacatactactgccatctatgtttctgttcttcctcctttttcaaaactattattctctcctgaagcttcacccttctagaatatcagtattccacctcgattattttctacctaatgagctaattagcattaatggaaaaactactgaagttaggaaatcagagatcttccagtaagtcagtggcctcaggcccaatcagtaaaataaggaaaaatatacctacctgatagaatttttgtgagaaacaaatgaaacacatactcaatcatgggaataaaatactcaatactcaataataaaaatatttttaaagactatctccttgaagttctttttattccttatctattttttgctgcaacccaatacaatattctgtactctttccaagttatatgcctctgttttttacatacccactctcatttctaattttaaaatttagcatatgtattctataaccccacagtgcccagaaaaatgttattctggatttggcaagaattttttgtaaccccagttctaaactgttaataatggcagggagaggtgctatggcttattattaaactgctttattgttagctcattaatcatacacaggtccagaagaatattcaaaatgtttctttcaggttgagtaggtacctgatctaaacatggtccattatgagtaggtgttcagaaatgactcatctttcctccaatcatctcctttagtgtcttgagagctctgagcctttgacctttctccttattttctttacctctacagcctctttgcttctttttgctatggtccctccttagctgcaaaagaatgcagcctggtgttatttcattctattgaattccatttaggatgaggttttgggttagtggtgaggtttggatggtactaggaacatctaaagccaattggaatgtcttttccggctgctattaacaaataccaaaaagttatggggtctctcccagttctggaggttgagaagtccaagatcaggtttccaccttggttgggttctggtgaaggtcctctttcagattgcagattgccgagttcttgctgtgtcctcatgtgttgcaagggtgaacaagttcccatgggcctcttttataagtgaactaatcccattcatgagagctctgccatctgacctaatcctctcctaaaggccccactttttaatactattacattggggatttgaattcaacatagaaatttggggaaaacacaaatattcagatgatagtacagaatttcaaattttccagattgacttcttaggatattcttatgctcattatgctaaaaatctctgttcaatattgagcccatttagatgacttgtctgtggtattgtgccaaaatagcctctttttctgcccgtggtcacttctcaagagcccccttctattttagacttgatttctatcatgaaacagggaaaggagtgtaaaaacccatctagctaaaaccaccacccagagcacagaccaggaatccagtgctctgtcaactgctaatgttagtttgtttgaactttggaattaattagatgtatacacacctcctaacaaaatatttaacaattgagtccctatcattcatgtctcttcagtcaacttttaggctcttctttctcattctctgcaaccagaaactgtttccccacctctgctcatcctttaacatgctgtcatactgccttatttccttttaccatcaaactactaaaaagattagtctacaatcagggtatcttttcccactcttcaattcctttcatcttaagcttctacattcttcacctgaaggaaattgcattcttgaaggtctctgccctcataattgccaaataaagtgacattttggtctctcttctcctctatcttcctggaagttttgacaatgttgactaatcactttaaaattttttttctttatatccacagtaagagttgtctttcttcttttatttttctcaatgattctctctctcttttttgctaaagacttctttctaaagtacatgtgaggaaatcacttaagttcctggttctcaacttcctcacctataaaatgaaaatatccattccaaaaagaatcatgaacattaaattatattaggtactccaaaaatataattatcctcctttagtgtaaacatttatcagaattctgtctttggtactatctctcttcatcattgaattttacgaatgagaataaaatctttaccttaagccctcaactctctccagaaccccataccaatatttccaatttgtatatcatgcttcatgttcagtaaatctacaaaaccaaacttatcatgtcatcttctccctcatcaaaataaacatctgttcaattctttcctatccttattagtagcattccaaagtcccaatcaacaaggctcaaatcattagtcatctttggctcccttagacctaatccatctatctactgctaattctttatccaaagtgtctcttgcaccaaagactacataaaatgtataaaacattatagccaagtgttacttatattagcatccaaagtaaaacaatgtaatctgccatatcaacagaaccaagagtacacgcaataaactgatagcctacattgtagttaatgttgaaacactgtaacattgtctgctttccccaaagatagggaacaaggcaataattcttggttttaccacttcattgcatcattttactatagtcacagcaataagaaaaagaaataaaaggcacaaatattagaaaaaaaagtcaaactatcattattataagatgacataaaagaatcctatggaagttattttttaaaaaagcaaacaagtactctagcatttaaataaaattaaaatggtaatataaaactcaactgcatttctacatgccaacaacaaacaattaaaatatgaaagcaataaataatactaaattattaactcagtaaataacaatttttttccttgtagcaaaaattaaatcttgacccccacctcacaccatacacaaagcaatctgagatggattatcgacctaaatataaaaaccagaacgagaaaacttctagaaaaaagtgggagcatatatttacaacctgggacaagtcacaaaaacactaaccatagaagaataaaatgatacatctgacataaaaattaaaatattctgctcatcaaaaggcacttgagaaaatgtttaggcaaatcacagagtaggagaaaatatttagagtgcatacacctgagaaaggacccatatcttgtggggttacagaagaatttataaagaattactacaaataaacaatcacaaagctgaacacccctaaaaaaaagaggtgagcagatacttcacaaaagaagatctaagaattggcaataaccacagaaaaaggtagtcatgatcattagtcaccagaaaaaatgcaaattaaaaccataatgagaaatcatttcacacccagaagaatggctaaaataaaaaagtttaaaaggcgagaatgtggagaaatgaaaattctcacacattgctactggtgactataaaatggaacaacttttttggaaagctgttgggaagctttttataaagttagctattcatctaccctgtgatccaacaatgccattcttatttatctatatgaaaacatatgtttataaaaaacacttacatgtgtatattcatagcatattcactcataatggtaaacaatgggaaacaacgcaaggatcaatcaacaggagaattaatgaacaaattgtaatataccatagtatattaatccaatggtaaaccacttaccatgaaagaaacaacatggattaatttccaaaccattatgttgagtgaaagaaacccaaacagtgatacgcacacagaaaacatactcaccataggattccatttatataaagtccaagaatagccaatcctaatacatgatgataaaaatctgaacattcttgcctccaaggcaggaaggagggcaactaattagaaaggggcaagaggaaactttctggggtgatggcaatgttctatattttgttttgagtggtgttatacctatgtaaataattaaagttcatcaagctatatacttaagatctgtgtatttgattcttcaattgtgaaaaacaagatgtttcacgaggaactattttaaaaacaaagccaacacaagtaacatataactattcagtaaaaagaagataactagaatgtcaatagacctacctaatatatatttcaaagatttttttttcaagtatttaagtacaagtaagtagaaaaattcaggcttgtgggttaatatactggagagaaacaaagagaaaagagtaataaccatttcagtcactctgaatttgaaatagattgcttcacaatctagaggattttaagacgtgaaataactgaaagaaacaaaggtgaaaaagatcaaacacaggatgcagaactaacagctgtgacttagttaatgcatatgctgaataaaaacaaactcaacaaagcactgggaagccggcagcttccaagtaattaactaagcagaaacacatgcaatgtgttatcagccctatctcatattgaaagcaaggactccttcgttacaatggatgctctccatttacaggtagagttacaagaaaataaactacataaaggtatacaagaggcaaaggaaaaggaaccaatttgctacatctaagtagtatctattttcagtgaatgagataaaagttctgccgttacctcacctactcaatatcagtcttcccacaataaaagactgaacacatcagctaatggtcaaagaattgtaaattcatgaataagggtcacatttacatttttattttcaaagttcaacacaagttttaaaagtgaaattatcatttcaatcatattattaatttttaataaataaatttttagaacggtctttaatacccataaatcaatctaactccacactttctgcattttcagagagaaaaccagaattaacaaatatgttagagtattaaacctgtgattaaaatataggcttttatataagttcatcaataattatcttttctttggaacagtagctctcaaccattttccatccctgacacacctgtgatttgtcagaacacagcaggagtctcctgttctatccatccatccatcctctatgcacatcctctagtcttcaaatcctttcctgaaacctcatgtcctacctgaatactctctcataagtatttccatgtgaatatactactccctttctacaatgaatgaggagccccctgaaggtcataactcatatggagaaataagtcatgcaccaatgtctccagggtggaagaaagagtagcctaattgaagttatattctttctgcaattatatatagagaaagaaaatatatagatatatagctgttattgttctattacataaatacaggctgcattggttctaatttaaacaccatcatcctgagttacttaactttctcacttatttgtttttctccttaaagcattgttataacatttaagaaagatggagtcagttactaagataaacatttaagtaacgacagcaccaagaaattgggtcaagatggaatttctggctttaattctacctctagatttcttcaaagataaccaggtgaacctaaactcaattagaatatgcagagaaggatttatgaaataatgcctcagttattcagatcatggatctatagaaaagaatctgtttttcattcattgaatgaccaagtgcatttacattagagaatctacattggtataaaaacaaatatatttaataatgaattttattaacatatataggacaatgtcttacttaaatagctttaaaatgctggaaatgcactagaaacacattaaccccagaaacaccttcatatgagagaaccagtgtcaacgaaaatgacagatagcaactaaatctgggtttagtgaggtttatcttgaagcaaatagaccccatcaaatttccttgaaaaagaggacattttgtaatgagatgaaggtgtcactatgttacccagactggtctagaactcctgggctcaaggtgattctctgcctcagcctcccaagtagctaggattacaaccgtgtgccactgtgcctggcagaagacgacatttttgaaaacatttttcttctccacatattggggcactatgtcaaatgttacctgtgcctaaatgcccctgaacctgcatattccatactcctaaagatgtgtcaaattatacaacctcatgaggatatttttaacctctgagcaggactggaagaggcaaatatactaaagtaaaaaaaaagaaactccaaatcagttggacaatgtagcccctttggagtgccagtgatgttatctataaacactgaaacacaaattgcacttgaattgatgaaggatataggaaacaatttatattaaagtgttctacaaactgcagtggctatccaaaatttaagtgccattttatcaatgaggatgaagattataataaaaatgatctaaaataacttatgttaaacaaggaaaaatattaaacaaatcttgcttatttagacctaaatagtcttaaaagacacattttccctacaatttggctcaaaggatttattcatactctatatctaagtagatgatgaatggcattgattgaatccaaagtcctcctgtcttggattttatgaggcccattcagaacgagccaggttgagaacaccaccaatttcgtgttctgggtccatctgttggcaaaaatataatgcaaacagctttataagtgctattttcaatgaaatatcacagaacagcttgtcccaatgatatttctaaagcttgcctgcaaaccgcctactggaaaatccaactgaaagagaagggagaaaagagagaaatccatagaggaaagagacaggaatggaaaaaagaacaaaggataaagagagactagctagaggactgggaacactggaggaaaacaaggagcaatattaaacgcagacaatattcattgaaaccataagaatagagaagatagagaaatataaaaatcacttgggttggaagacagagaaataatcacaaaccatgcagcattgtccagaagaatgaagacaaaaggatcaggaaacaccagaaaatatgtaacagctcaataattggagcataattattaaaatgttgtgagagaaaaatgatgtaaaatagctatttttctaagtctcactgcttcatgtaacaggcacaattcatttttccaaaaactaatgcagatttcagtgtttatcaccaacttgaaaggaagcaaacatcctcttctgagtcccctcttttaatttagaaatccattgacataccacataaaacagtccaggcattgcaatataagtgatgtacatgcattgattcaaatcaaaacacattagagggaaaatgatgccattctgggcacttacctggggtcgaatgacttttacaatatttttgagggcagtatcaggggatggaggtgaacaatcaggtgttgggcctgttgagctgtttctatggttactagttcctggagtagtaactgctacctcagaggcattatctgtgaataaaaatagaactgccatgaacctaatcactcagtttaccttttaagacttgaaattaattttctgaacataaattgagatttcaacttttaaaactggtatcaattacaagatcataatgaggaatatgctcagtagtatattttaaagataatgctttttgaatgctttgtttccttctaaaatggtaactatcaccccctggaatgttgttctgagacaagtgtattattattcaattcataatgatagattatccagcatagctcttaagactgctactactatatgaataactaaaaccttaccttaactaaaaagaatataattttatgatatgattgggctaaagctttcccaataatctcttaaatgagtattaatatttattaaagtgggagttttatatctccctgatgcataaaatccaaattcaagcctcctcaaatgacttttcctagaaatcccacaaactatagaaaagcaccctagtgaatgaagcttgatgaaaaactgaaatttgtgcaaaatggttttatgatgtagataaacacaaaattatcactcctagataagtatagcaacctatgtggtcaaagctaaatgaataaaatttcagaatctaaattaatcttctcttatgttcagtatttaggaggggggaataaagaaaagatgacttgaaaatcaacaacatgtgtaacatttttttcttaaattcatattaaagcaaaataacatcaaggatgccattttagaatgtttaaaatacttgggaaaggatgaaaattattctataaataacttctggtagcacatagaaaagttattttaacaacaatttggcaaacttcaatagctttttatgaaaactgctgcaagctcaaatctgccaaaaaaataaaaaataaaaagtttacttctctgttgtttttaattagttcccaataattttctttcctagacagttagctgaactgattgcaaaagagactgagactgaattttttatagaccaggaagtttctctgttcctgatcgctgtctacaatccccagtgaaatacaggaattcatcaaggcatcttttcctcataaaacacaaagggatgaattatcataaaactctacctaccatataaaaatataactcagtctcactgaggaatccagacaaaggcccataaaacaaaaaattcaagtatgacacatagaattacttggatgactcataaaataagtcttaaaagtgtccagagcacactcttctaagatttaacagaaaaggtgggatttgaattggcatcacaaaagagatggggtggtcttctgagtagattagaaaaccatgagtcaatactgaaacacacaaaacattagtcagcaagatgctctgattctctccaacctatcccttccttctttcattcatctaaaaactacacatgtaagaacacttatttggggcaactatgagtcaaatattatgttatgttctaaagattaactaggaagaatctctggccaaggactggaggcaggtagggatgaataggttaagcactgaggattttcagggcagtaaaactattatatttaacagtataatggtgagtatacatcatcattatatatttgtccaactcatggaatgtataaatcgagaatgaacctgtataaactataaactttgggtgataatgatgtgtccatgtagtttcatcaattataacaaaggtatcattttggagcagaatgttgatagtagaggaggctttgtgtatgagaatatatgaactttgtaatttctgctcaattttgctgtgagtctaagaagttctaaaaataaaatctatgaattttttttcaaaagaatccctgccctcgagaagtatactgttgggttttttccttttcttttttgagacagggtctcactaccatcacccaggctggagtgcagtagcatgaacacagctcactacagcctcaacttcccaggctcaagtgatcctcccaccttagcatcctgagtatctgggactacaggtgcacattaccacatctggctaattttttgtatttttagtagaaatggggtttcgccatattgctcaggctagtcttgaactcctgagctgtagtgatccacccacctcaacctcctagagtgctaggattatagccatgagccactgcacccagcccaaaagtatactcttaaatgtgtcatcagacatgtaaacaaattacaatgcaatataacttgagaactgataacagataaaggaagcatgataaaaaaaaaacagggtggggtgggggagtaatcagactatggcttggacagaagatagctgtgaaaggcttcagttttcaggcaagaaagctggaacaaaacattagatattagggcatgaaggtaggaagagcacagttgaagctgttatttcatatacaaaaaaactggagataagtttgaatgagtgaaaggaagttttattagaatataaacatacttaattctgtaggcaatgagaaatattgaagactgagcagggagtgacataataatagataacttttattgagcatttattatgtgcagacaagccatgttaaattattttacttattgaatctcatttaatacccaaattaacttacaaaatacattccactatcaccatccctattttacagagaaactcatctcaaagttatattctcagttactggcagaaaaggattcaaatttcagactgatgccatgttacccttctgagagttagcatgtcatagcaggtatgcaaaagatatgcataggtatgattgggttcatagaaacatagcctgaagaagatcggcatagttgaggtaggagcacactctacttcaaaatatagttgaaccaacttccagaaacttaaaaagtagacatagacactatgaaaaataaataataaaaacaacaaaaaagtcaaccataaaaacatctttagggtatgcctttgagtactatatagtataatatttaatatttggaagctggaagatatgttaagactagagacccaagctagaggtcatgacgttagcattttggagttgataagtgattagattctggacatgtgttgaaatgtccagaactgttgaaatagaccaagaatttttttgatggctcctgaatagacaaagcaaccttgaacaaaaagaaaaaactgagcacattacactacctgacttcaaaatatactacaaagctataataatcaaaacaacttgatgctggcatagaaacagacacatcaaccaatggaaaagaacagaaatcccagaaataaatacacatatttttggttaatttatttcaaaggtgccaacaacacacaatggggaaagggcagcctcttcaataatggcattgggacactggatattcacatgcagaagaataaaattagaccttcatctcacactatatacaaaaactaactcaaaatggattaaagctgggtgcaatggtacatgtctgtacttccagctacttgagaaactgaggcaggaagtttgcttgaacccaggagtttaaggccagtctgggaaacatagggagaccactctctaaaaaaacattttcttaattaattaaagacttaagtgtaaaattgaagtggtaaaactattagaagaaaacacagagaaaaacctccacaacattgatttgggcaatgattttttggctatgacctcaaaagcacaggcaagagcaaaaatagacaaatgggattatgtcaaactaaaaagctctgcacagcaaaggaaccaatgaagagagtgaagaaacaatttatgaaataggagaaaatatttgtaaacagtacctctgataaggagttaacatccaaaatatatggaactcaaacaactcatagtgagaaaacaataacctgatttaaaaatgggcaaaggatctgaatggacatttctcaaaagaggacatacaaatggccgacaggtatatgaaaaaaatccctaacaacactaatcatcagagaaatgcaaatcagaactacaatgaaatatcatctcaccccagggaaaatggcttttataaaaaagacaggcaataacagatgctagcaagggtgtggagaaaggggaaccactgtacactgttaatgggaaggtaaattagtacagccattagagagaatagtatggagttcctcaaaaacaaaatatagaattaccacataatccagccatcccactgctgggtatatatccaaaggaaatgaatcattatgtagaagagatatctccactcccatgttattgtagcattattcagtagccaagacatggaattaacttgtgtccattaagagatgaatggataaatggaaagaaaatgtaatatatacatacagtggaatactatgctgccttaaaaaagaagggaattccgttatcagtatagatgaacctggaggaccttgtgttaagtgaaataagccaggcacagaaagacaaatgacacgtgatctcacttatatatgaaatctaaacaaagtcgaactcacagaagcagagaatagaatggtggttaccagggactggggagatgttggtcaaaggacacaaaatatcaattagaaggaataagttcaagaggtttatcatacaatatggtgactatagttaataacaatgtattgtattctttaaaagagtagatcttaagagttctcaccacaaaaaaaatgctaagtatgtgaggtaatacatatgctaatcagttcaatttagctattccacaatgtatacatgttttaaaacagcttgttgtacacaataagtatatataatttttgtctatttaaaaataattaaattttttaaaattattgatgtgctggatatagggagagaaagagagaaatcaagaatgactctaaggcttttggcctgaggaactaaaaggatagagctgccatcagcagaaaagggacagactataggaggagcataaattctctaccatataacttccaatattgccttcccattctctctctccctttggactctattgaagtaatgctagacagactttattcttttaaccatttattctctcttttcattctgtctctctgttgcatttttaatagtttcttctatttattttctagtttattggttctttcttcagctgtgtcaaggctgctatcaaaccattttcttaattttagtagacttttctgttctaaaatttctatttggttcttaatcaagtatatgatgtcagtagtttgtattttttagttcctaaaaacattttcaagcttacttttatattaaaatggcaaatacaattggctttggttttttaatctgataattccagcatctaaagtctttacggatccatttctggatttgtggttctgactcatgcaatcctgttccgctgttagtttcatcatcaattctgtgttgcttattattcaacctgttgttacaagatacacatttaaatataactaactcttagtcttttaataaatgttaatttttaaaagcatcgaaacttatatcctaataccagatgctgaagtctgtgaacaacttgcctgtgtaacactagatcatttatttaatctttctggatttcaagtttcttaactgtaaaaatgcaaatgattaactaccatcttctatcatttacgtgtgcagataaaagaaaagaaaaataacttgtatgtttttaggcacataataggggttttcagtatatgagtttccttttccattatcaaaagaaacaccatcagaattaaaataaaatatggaagatcaaagaaacccagagggaaaacaagaaaacaaatagttatcctttttagacaacacatctagagtacttgcgtgatatttgagagcagtatcttttagctattaacacaaattggtagggacagaatttagttccagaaatagcagatgatcctttgagacattgtactgttcaaagttatccagagaaataggaccaacaggatctatccatctatctatctatctatctatctatctatctatctatctatctatctatctatctagacaaagatttactgtaaggcattagctcatataattaatggagcctaagaagtccaaagatctgcagttggtaagctggaggtgcaggacagcctatgtgtagttccattgtaaatccaaaggcctgagaaccaaggaagttgatgctgtaaattctaatccaaaggttggcagactcgaagtcaagagccaacatttcagtccaagtctggaggcctggaaaaaaacagtgttccagctcaagaggtcaggcaggagaaattcccctttactcggcctttttgttcaattcaggtccgcaatttattgaataaggccaataacagtagggtggatgatttgctttactcagtctgccattcaaatattaatctcatccaaaaacaccttcacagatacatcccaaataatgtttagccaaatgtgtgggcatctcacggactagttaagttgaacttataaaattaaacacaacaggaatgattcattgcaagggctggtcttaactgcttttgcactaaagccagaagaaaatgctgggaactccctgcaaactgtaagccaacagcttcttgaatgttttttttctgagtattttaatacatagtataagacagtggataattaagtactaaattatttagaaaagactaagtatcttcatcttctgaatccatgagctataccattacactgataatttgattttgtactatcttgcattgttcattaactcttccagactaggttatatttttgcataaagtcatatttctctctatatagctcttagcttaatgcaatccttttaaagtaataaatgaagtaaagtagataaagcaaaacctgtgtcaatggaaaccaacacaaatgtatttaataatatgaagaaagctggtctggcttttataataattccatgatcctttcaaagaaaatccaaatgagaagcatattctagaagatatatgagtcttaagaagctggtttattcccaaaatatccttgataatataatttacaaaaaataccaattatccagtggacttggtaaaatagcagcctatgaccaagacagttttacatgctcaacctacatttcacatatgcagttacaaaatattgctgataaaaaggaaatgaggcacataaaactgcttagggaaaactgcaaaatatacttgcaatttcagattgaaataagaggactatcttcttgtcagattcccttactacatattaattattcattatgaatgtcagtttagtctataataacaacattagaaaaaatacttatagtttattttatcttttagaagaaaaatattctatgactataaaataattcatgtgcaacattacagtctagtattttaacatcaatacccagcatgtaacaaacagtttaagtataccagggaccatgatagatgcttttcagctgaagaataggactgagattacttctggctgggaattcaagaaagctgtcatggaagaggcaggagttatgaaggcctctgacagactagtaaaattcaggcatgaagaaatggctgggaagggcgttccatgagttggaagcaggttgagcaaaatgtagagagatgggaaagaggcacatttgtggaataaagaagagttcagtttgaataaaatataatattcatggaggaaatgctaagaaatggaggagtcatacacaaagactttgggctttgaaatcagaaaaccctaagctgaaattctggtatatttaacttcagtttcatcttctgtaaaacagtgcctttcacatagtgttacaaagacaaatgaggcatgtacagatacgtgtgtgtgtgtgtgtatgtgtatgtctgtgtgtgaatacattgcctgacacatagtaagtgctcaataaaattatctattactattattatcagatatatgaatataatcataatagcaaataaaactagataggtggcttgatgccttattatggaaaatcctaagtgcatcacttgcatcactaagtaatcatcaaatataagtatttaataaatcctaatctaacaattcatgaagcacaatttttacgttttggtattaagtcaagagttgacaaattttttctgtaaagggccagatggtaaatattgtaagctctgtaaggctacatgatctttgttgtaactactctactctctttgggtagcgagaaggcagccacaggaaatatataagcaaatgggtgtgtccgtattccaagaaaattttacttacaaaaacaagcagtagacaagattaagtttgttggtgataacttgtagatccctgtcttaagtacttcctatggaaatgttttcccttttatggacagacctagaagaatgttatattatacattttcatttccatattcatattatagatgaacattctcactgtgtaattaaaaactaaggttttcaatataaagctagaaatttgtcatttgtacaaaaaatggcattatatctaacaccagggcagtcctttgtacacagcaactgttcaatatatgctcattaaatagataaataaataagaccaatgaaatctttacattttaaagtaactttgttgtagtgattgtacatgactaccacttctgggagaaacagtacagaaatcataagtaaaaaagcccaagtatcctgtttcagtattttcagtgagaaagtactcactatgtaccacttgaggaagataatatttaacagtaatttaagagaattagttaataatccaaataattaacacattttactttctctagtgaaggtttgttaaaaagtaacaattctcttaaatataccgggtttgaacttccattactatcaccaacaatagtgttaaatattcaagtcttaattagccagcaactttaccagatgaaatgtgtggtagacagcctctaggatggtcccaattgagccccacctcatggtattcacacttttgtgaaattttgtcccctagggtgtgagttgaactcgttgaattgcttctaacaaagaagagatgaggccgggcacagtggctcacgcctgtaatcctagcactttgggaggccaaggtgggcggatcacaaggtcaggagatcgagaccatcctggctaacatggtgaaaccccgtctctactaaaaatacaaaaaattagccaggcgtggtggtgggtgcctgtagtcccagctactccggaggctgagccaggagaatggtgtgaacccgggaagcagagcttggagtgagccgagattgcaccactgcactccagcctgggtgacagagcgagagtccgtctcaaataaaaagaataaaaaagaaaaaaaaagaagagatgagttgtacttctgggaataggttataaaaaaagactgtggcttccgtcttgtgtgtgtcctccttctcagatctcttgcactgaggaaagcaagtaaccacattgtgaacaaccttatgcaaaggcctacgtggcatggtaaggagctgaggccctcatttcaacagcccaccagaaactgaaccttgttaacagccacgagttagcttggaagcaaatccttcagccccagtcaagccttgaaaagactgcagttctagccaacagcttgcttacagcctcccgggaaatcttgagtcagaggcatcccgctaagtccctcctagtttcctgaccctgtgagataattaatgtttgttattttcggccacaaatagcaatagataactaatatagtaaatgtttggttaacgtttataacatggccaacatgtttgtgctacaatggtgcttagactttcagccttgttttgaaggagctgactacttaatggaaaacatagaagggcaaatataattacaaaattgtgttacttatgctacaaattcagcaatatgggaacacagaagaatgagccactaaccaaatgagggggccagagcagaaagttaggttataggcagaaagagaaagtgaagaaaaaaaatgtaatagccttgaggaatgagtgccatcaagaactcaaagagggagaagcattccaggcaaagaaaacagaatatgcaacagggcagaagcatgaacgagcattatgcctttgggaagctataaatagttcagcttggctgaagcacaggatatgtgtggaaaagtgaatggagatgatgttggcaagataaagtattcagatgaaagatggaaaggtgtataaaaagaaaacaaaattgcctttgtaaaagattaaatttttctatttaggaaaaaaagtcagccacattgcatttctaaaattactttccttgaggctatgatcaaatgctactttcatctataaaaagaacagaccacaaggctatagtcactttaaaattctctgcatgcaagaggccacatctgtgtgctaaagagtagaatgattgactagcagcttcaagccaataagaactttggtcttatctacaccagagaagttctagcaaagagtcaaaaactcgaagagttagaggacatctaaaagtccaagatctcaattcaaacataaaaagcagtgcaatgaacagatggttgggagagtgtgctctctcccacctttcctttacttttgtttcctcctctttctcaacccatggcagggagatggtcttttagcataataattcaccagaggtatgctgtaattggtgagcaatattagtaggagaaatgtttccttgtcttataaattctctactctgaagaatctcaaggatttatgagaaatgcaggagtcttgtagaattttaccttcctcctcccaggatgatgccaagaatgacaattccctggccttggctagcaagactgaactagaatcctggagaactgcacagttaagaaaatgaaagagaaagggaggccatagaagatgggttccctcccaatgcttacttttatggactaaatgttaagcaatgaagaaagtaaaaaagaaagaaaatattttgcatcacatcagtaatccgtggattctctgttttactaatgcacttgtgcttcaattcttattttggctcttcaggctctcctggttttgagtcccattttaggttgtatgctttcccttttgtcttaacaacctattcttttctccggttgtactcttagtggtccctgtattcatcttctatatctttctattcattccaaaattatgtaaacacccaacctgaccaagacacaccctagcactagcccaccaggccagaacccctactaagtagccactgactctctatgaaaggaagttagaaaatgaacctgctgagagtaaagggggaaaaaggtggataggaggcaggactaacttgcagctgccactcagatggacagagcagcatgtggagacccacatcatgaacttttgctccaagaactaccataggaacataccaggaaagcagagaaaaccacagaccctttgaaggagtagattgccactgcaggctctgtgagtcagcttgctttctcagcagggaggtttgtagcctggggcaagttcttagtcctgctcataggctgcctggaaataaacggtgctgttggcagggcacagtgggaatgagactggccttttgggctgtgggctgtgtgggagttgggtgaggtctgtggctgctggctttccaccactttcctggtgacctgtgcgactcagcagaggcagccataatccccctgggatataactccattggcctgggaactgcaaccccacccccaacagtagccacagcaaaccccacccaaggagagtctgagctcagacacacctaaccctgtccccacttgatggttattgtctgctggccctggtagctgaagactaaggacataatctcttgggaactctatggccccacccacggcctgatccttcctatactactgcagctgatgtgctattgaaagcaccacctcctggcttgaggacaaccaaaacaaaaccagcgcacttaacaaaaatacaaccaaggaccctcagagagtccacttcactctcctgatacctccaccagagcaggtgctggtatggtatccacagctgagagacctgaagatgggtcaaatcacagaactctttgcagacactcccagtaccagcctggagcccagtagctccactgggaggctagattcagaagaaaaataacagtcacttcagctctcaggaagccccatccctaggggaaagggaagagcaccatatcaagagagcaccccattagacaaagaatcttaacagaagcccttgagtcctagatcttctctctgaaatagtctacccaaataagaaggaaccagaaaaaaacaattctggtaatatgacaaaacaaggttctttaacacctccaaaagaacatactggcttaccagcaatgggtcaagatcaacaggaaacctctgaattgccagaaaaagaattcagaaggtcgactactgagccaatcaaggaggcaccagaggaaggttaagtgcaacttaaagaaatcaaaaaagatgatacaggatatgaatggaaaaatctccagtgaaatagatagcataaaaaaaatcacaacttctggaaatgaaggacacacttagagaattacaaaatgcactgggaagtctcacaatagaatcaaacaagtagaagaaaaaaacttcagagcttgaaatcaaggctttcaaattaacccaatctgataaagacaaagaaaattttttttttaaaatgaacaaggcctccaagaaaatttgggattatattaaatgatcaaacctaaaactaattgatgttcccgagggagaatagaaatctaaaagtttggaaaacatatttgagggaataatagagaaaaactttcccagccttgctagagatctagacatccaaatacaaaaagctcaaaaaacacctgggaaattcatcacaaaaagatcatcgcctaggcacctgatagtcatcaggttatctaaagtcaagatgaagagctgtgaggcaaaagcatcagataacctataaaggaaaacttatcagattaacagcagatttctcagcagaaatcctacaagctagaagggattggggttctctttagcctccttaaataaaacaattatcagccaagaattttgtgtccagtgaaactaagctgcataaatgaaaaaaagatggtgtttttcagaaaaataaacgctgaatttgccactaccaagccatcactaaaagaatggctaaaaggagctctaaatttttttttaacctctaaatcttgaaacaaatcctcgaaatacaccaaaatagaatctccttaaagcacaaatctcacaggacctataaaacaacaacactatgaaaaaaaaaccaaggtattcaggcaacaaatagcatgataaacagaacagaacttcatgtcttaatattaacattgaatgtaaatggcctaaatgatccacttaaaagacacagaatggtagaatggatgagaattcactagccaagtatctgctgtcttcaagagagtcacccaacacataaggactcacataaacgtaaggtaaaggggtgaaaaaagatacttcatgcaaatagacaccaaaagcaagcaggagtagctgttcttatattagacaaaacaaactttaaagcagcagcagttaaaaaagacaaagaaggacatacataatgataaaatgactagtccaataggaaaacatcacaaacctaaatatacatgcacctaacactggaagtcccaaatttataaaacaatttctactagacctaagaaatgagatggacagcaacacaataatagtcggggacttcaatattccacagacagcagtcaggtcttcaagacagaaagtcaacaaagaactataccctagaacaaatggactaaacggatatttacagaacagatatttacagaatattctacccaacaactgcagaatatacattctactcatcagcacaggggacattctccaagatagaccatatgataggccataaaacaagtctcaacaaatttaagaaactcaaaatcatagcaagtactctctcagagcacagtggaataaaattggaactcaactccaaaagaaaccctgaaaaccatgcaaatacatagaaactgaataacctactcctgaatgattactgcataaacaatgaaatcaatatgaaaattaaaaaatttacactgaacaataatagtgacacaacctatcaaaacctctgggatacagcaaaggtggtgctaagagaaaagttcatagcatcaaatgtctacttcaaaacatctgagagcacaaatagacaatctaaagtcatatctcaagaagatagagagacaagaaccaaacccaaatctagaagaaaaaaagaaataaccaagatcggagcagaactaaatgaaattgaaaaaaaaaaaatacaaaagataaacagaaagctggttctttgaaaagataaataaaattgatagaccattagcgagactaactaagaaaagaagagagaagatccaaataagtgcaattagaaatgaaacaggagatattacaaccaatcccacagaaatacaaaagaccatttaaggttactatgaacacttttatgtgcataaactagaaaacctagaggagatggataaattcctggaaatatataaccctcctagattaaaccaggaagaaatagaaactctgaacagaccaacaacaagcagcaagattgaaatggtaattaaaaagttaccgagaaaaaaaggccaggaccagatagatacacagctaaattctctcagacattcaaagaagaattggtaccaatcctgttgatatctattccaaaagatatagaaaaagagaatcccccctaaattattctatgaagccagtatcaccataataccaaaaccaggaaaggacataacataaaaagaaaactacagaccaatatccctgattaacatagatacaaaaatcctaaacaaaatattacttaactgaatcctacagcatatcaaaaagataatccaccatgatcaactgggtttcatacaaggaatgcagggatggtttaacattcacaaatcaataaatgtgatacaccacataaacagaattaaaaacaaaaattacatgatcatctgaatagatgcagaaaaagcatttgatgaaatccagcatccctttatgattaaaaccctaagtaaaattagcataaaggtcattcgttaatgtaataaaagcatctatgacaaacccacagccgacattatactgaatggggaaaatttgaaagcattccccctgagaactggaacaagacaaggatgcccactttcaccacttctattaaacatagtactggaagtcctagccagagaaatcagataaaagaaagaaataaaggccatccaaatcaataaagaggaagttaaactgtcactgtttgctgatgacatgatcacatacctaggaaaccctaaaggcttatacaaaaagttcctagaactggtaaatgaattcagcaaagtttcaggatacaaaattaacatacacaaatcagtagccttgctatacaccaacagttttcaagctgagaatcaaatcaagaactcaaccccttttacaatagctacaaaaaaaaaaattaggaatatactcaaccaaagaggtgaaagcctgctacaaggaaaactacaaaacattgctgaaagaaatcatagattgacataaacaaatagaaacacatcccaatctcatgaatgagcagaatcaatattgtgaaaaatgaccatactgccaaaagcaatctacaaattaaatgcaattcccatcaaattaccaccatcattcttcacagaactagaaaaaacaatcctaaaattcatacggaccccaaaaagagcccacataaccaaaacaagactaagcaaaaagaacaaatccagaggcattacattactgaacttcaaactatactataaggccacagttgccaaaacagcatggtactggtataataacatatggaccaatggaactgaatagagaatccagaacccagaacccataaataaagccaaatgtttactgtcaaccagtctttgacaaagcaaacaaaaatataaagtgcataaaggacaccctatttaacaaatggtgctgggataattggcaagccacgtaaaagaatgaaactggatcctcatctctccccttaaacaaaaatcaactcaagatggattaaagacttaattctaagacctgaaaccataacaattctaggagataacattggaaaaacctttctagacattggcttaagcaaagacttcatgaccaagaacccaaaaacaaatgcaacaaaaacagagataaatagatgggacttaattaaactaaaaagcttctgcacagcaaaagaaataatcagcagagtaaacagacaacccacagagtgggagaaaatcttcacaatctacacatccaacaaaagctacaaggaactcaaacatatcagcaagaaaaaaacagtctcatcaaaaattgagttaaggacatgaatagacagttaccaaaagaagatatacaaatggccaacaaacatataaaaaaatgctcaacatcactaatgatcagggaaatgcaaatcaaaaccaaaatgagataccaccttactcctgcaagaatggccataataacaaaaaaaaaaaatggatgttaacatggatgtggtgaaaagggaacacttttacattgttgatgggaatgtaaactaataaaaccaccactgaaaacagtgtggagattcctcaaagaagtaaaagtagatctaccatttgatccaacaatcccactcctgggtacctacccagaggaaaataagtcattatacaaaaaaagatacttgcacacacatgtttatagcagcacaattcacaattgcaaaaatatagaaccagcccaaatgcccatcaatcaacgagtggataaagaaaatgtggtggatatatacatgtatatatatatatatatacacatacacacaccatggaatactacttagccataaaaaggaacaaaataatggcatttgcagcaacctggatagaactggtgaccattattctaagggaagtaactcaggaatggaaaaccaaacatatgttctcactcataagtgggagctatgctatgaggatgcaaaggcataagaatgatacaatggactttggagactcaggggaaagagtggaagggcagtgagggataaaagtctacacattgggtacagtgtacactgttcaggtgatgagtacaccaaaatctcagaaatcaccactaaagaacttattcatgtaaccaaatacgaactgtttcctaaaaacctattaaaattaaaaaaaaagaagaagaaaatgaacttgctaaatccctgaataaaatatcacagtagttggaggtgaaatgacattcattcttccacatgacagtgtaaattccagtagtattccttcacactcatttaaaaatgagtctaatctcatcagatgatgctatagtccatacttcctcatagctataatttatgaacttctttttactctcttttatttatcagagaattagcatgtatctcccaatcttgctttccacctcaagcctatcatcattttgggaactgtcagtttcctcgtacattttcaatcaatctcttgagcctgagtgttttgatttctacttacgtaatctttgctttaattctattcagattaccatgtctaaggctaacccatgtatttcattatgaacagcaactacttcatatagatatttaatctctagtaactcattctgtggatacaatgtccaatcacttcctctctcttccacactacatctattgtttaatcccatctctatccttttatccatctagtttcatccaacctatcagtccctttccatcttcacatttacttatttagtttagacacaatggcccatcacttaacaactctcttgccagtaactacattcactcttgttattttaccacatacactgagcaaaaccctattcctatttgcagttgacactttaatgtaccacccagattcaacttcagatataaaacatttattctcctagctgtatgatgtgttgctggcagacagtcttcagctgtcagctttcttttggaattgcctcaactgaagagaatggactgacccaaggccatgcccccttccaggtgcaagctgctttcaatgtcaggtcaacacaagtgtataatagtcctgtcctatcgccaacttggaatgactttgaagagtcatcccagtttcagaattccctagggagcctttggatggctatattgagacttcatcacagcctgatctctccagctgccatttctggcttccctttaacaggtgttgcctccgaaatcactcaataaatctcctgtatgctaacctacatctcaaagtcagctttctggtgaatccatcttggattgaactcagttgttctcagtggccccttctgcatctttttaaccaattaggtactaatgactgagacagaaaaatcatacaactgctagaaattaatgttatcaaatgatttgatattctctgatatggtttgtatacttgtctcctccaaatctcatgttgaaatgtgttccccactgttggagatgggcatactgggaggtgtttgcattatgggaatggatccctcatgaatggcctggtgccctccctgtggaggtcatgagttaccatgagatctggctgttaaaaagagtctaggatctacctcttctctcttgctcactctctcatcatgtgatatgccttctccccctttaccttccaccatgagtaaaggttcctgaggcctcattgtaagctgagcagatgttcatgccatgcttgaacatcctgcagaactgcaagccaaacaaacctcctttctttataaattactcagtctcaggtattcctttacagcaatacaaaatggaataacacatgctttcacaaataattcacacggtgaaaaaaataccctaatagaaaactggactaaaaactaccaacaggcacttcacaaaagaaaagtacaaataaatgtataagccttttgcctcagcttctgctcaagcctttgtataggaatgcatggatggaatacagtcttctggttttgttttgattaatatgtgaagacaagatattcacaagcttaaacattcaaatgcggcagccaagatggccgaataggaacagatccggtctacagctcccagcatgagtgacgcagaagacgggtgatttctgcatttccatctgaggtaccgggttcatctcactagggagtgccagacagtgggtgcaggacagtgggtgcagcacaccgtgcgcgagccgaagcagggcgaggcattgcctcacttgggaagtgcaagggggcagggagttccctttcctagtcaaagaaaggggtgacagatggcacctggaaaatcaggtcactcccaccctaatactgcgcttttccgacaggcttaaaaaacggtgcaccaggagattatatcctgtgcatggctcggagggtcctacgcccacggagtctcactgattgctagcacagcagtctgagatcaaactgcaaggtggcagcgaggcttggggaggggcgcccgccattgcccaggcttgcttaggtaaacaaagcagctgggaagctcgaactgggtggagcccaccacagctcaaggaggcctgcctgcctctgtaggctccacctctgggggcagggcacagacgacaaaaagacagcagtaacctctgcagacttaaatgtccctgtctgacagctttgaagagagcagtggttctcccagcacgcagctgcagatctgagaagggacagactgcctccccaagtgggtccctgacccctgacccccaagcagcctaattgggaggcaccccccagtaggggcagactgatacctcacatggccgggtactcctctgagacaaaacttccagaggaacgatcagacagcagcattcgcggttgatgaaaatccactgttctgcagtcactgctgctgatacccaggcaaacagggtctggagtggacctctagcaaactccaacagacctgcagctgagggtcctgtctgttagagggaaaactaacaaacagaaaggacatccacaccaaaaacccatctgtacatcaccatcatcaaaaaccaaaagtagataaaactacaaagatggggaaaaaacagagcagaaaaactggaaaccctaaaaagcagagcacctctcctcctccaaaggaatgcagttcctcaccagcaacagaacaaagctggacggagaatgactttgacgagttgagagaagaaggcttcagacgatcaaactactccaagctacaggaggaaattcaaagcaaaggcaaagaagttaaaaactttgaaaaaaatttagatgaatgtataactagaataaccaatacagagaagtgcttaaaggagttgatggagctgaaagccaaggctcgagaactacgtgaagaatgcagaagcctcaggagccgatgcgatcaactggaacaaagggtatcagtgatggaagatgaaatgaatgaaatgaagccagaagggaagtttagagaaaaaagaataaaaataaatgaacaaagcctccaagaaatatgggactatgtgaaaagaccaaatctacgtctgattggtgtacctgaaagtgacggggagaatggaaccaagttggaaaacactatgcaggatattatgtaggagaacttccccaatctagcaaggcaggccaacattcagattcaggaaatacagagaacaccacaaagatactcctcgagaagagcaactccaagacacataattgtcagattcaccaaagttgaaatgaaggaaaaagtgttaagggcagccagagagaaaggtcgggttacccacaaagggaagcccatcagactaacagctgaactctctgcagaaactctacaagccagaagagagtgggggccaatattcaacattcttaaagaaaagaattttcaacccagaatttcatatccagccaaactaagcttcataagtgaaggagaaataacataccttacagacaagcaaatgctgagagattttgtcaccaccaggcctgccctaaaagagctcctgaaggaagcactaaacatggaaaggaacaaccagtaccagccactgcaaaatcacgccaaattgtaaagaccatcgaggctaggaagaaactgcatcaactaacgagcaaaataaccagctaacatcataatgacaggatcaaattcaaacataacagtattaactttaaatgtaaatggactaaatgctccaattaaaagacacagactggcaaattggataaagagtcaagacccatcagtgtgctgtattcaggaaacccatctcacgtgcagagacacacataggctcaaaataaaaggatggaggaagatctaccaagcaaatggaaaacaaaaaaaggaaggggttgcaatcctagtctctgataaaacagactttaaaccaacaaagatcaaaagagacaaagcaggccattatataatggtaaagggatcaattcaacaagaagagctaactatcctaaatatatatgcacccaatacaggagcacccagattcataaagcaagtcctaagtgacctacaaagagacttagactcccacacaataataatgggagactataacaccccactgtcaacattagacagatcaacgagacagaaagttaacaagaatacccaggaattgaacccagctctgcaccaagcagacctaatagacatctacagaactctccaccccaaatcaatatacatttttttcagcatcagaccacacctattccaaaattgaccacatagttggaagtaaagctctcctcagcaaatgtaaaaaaacagaaattataacaaactgtctctcagaccacagtgcaatcaaactagaactcaggattaagaaactcactcaaaaccactcaactacatggaaactgaacaaactgctcctgaatgactactgggtacataacgaaatgaagacagaaataaagaaggtctttgaaaccaacgaaaacaaagacacaacataccagaatctctgggacacattcaaagcagtgtgtagagggaaatttatagcactaaatgctcacgagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaataaatccaggagctggttttttgaaaggatcaacaaaattgatagaccgctagcaagactaataaagaagaaaagagagaagaatcaaatagatgcaataaaaaatgataaaggggatatcaccaccgatcccacagaaatacaaactaacatcagagaatactacaaacacctctatgcaaataaactagaaaatctagaagaaatggataaattccttgacacatacaccctcccaagactaaaccaggaagaagttgaatctatgaatagaccaataacaggagctgaaattgtggcaataatcaatagcttaccaaccaaaaagagtccaggaccagatggattcacagtcgaattctaccagaggtacaaggaggaactggtaccattccttctgaaactattccaatcaatagaaaaagagggaatccttcctaactcattttatgaggccagaatcatcctgataccaaagcctggcagagacacaaccaaaaaagagaattttagaccaatatccttgatgaacactgatgcaaaaatcctcaattaaatattggcaaacctaatccagcagcacatcaaaaatcttatccaccatgatcaagtgggcttcatccctgggatgcaaggctggttcaatatacacaaatcaataaatgtaatccagcatataaacagaaccaaagacaaaaaccaggtgattatctcaatagatgcagaaaaggcctttgacaaaattcaacaatgcttcattctaaaaactctcaataaattaggtattgatgggttgtatcgcaaaataataagagctaactatgacaaacccacagccaataccatactgaatgggcaaaaactggaagcattcccttgaaaactggcacaagacagggatgccctttctcaccactcctattcaacatagtgttggaagttctggccagggcaattaggcaggagaaggaaataaagggtattcgattaggaaaagaggaagtcaaattgtccctgttcgcagatgacatgattgtatatctagaaaaccccactgtctcagcccaaaatctccttaagctgataagcaacttcagcaaagtctcaggaaacaaaatcaatgtacaaaaatcacaagcattcttatacaccaataacagacaaacagagagccaaatcatgagtgaactcccattcacaattgcttcaaagagaataaaatacctaggaatccaacttataagggacatgaaggacctcttcaaggagaactacaaaccactgctcaatgaaataaaagaggatacaaagaaatggaagaacattccatgctcatgggtaggaagaatcaatatcgtgaaaatggcatactgcccaaggtaatttatagattcaatgccatccccatcaagctaccaatgactttcttcacataattggaaaaaactactttaaagttcatatggaagcaaaaaagagcccacatcgccaagtcaatcctaagccaaaagaacaaagctggaggcatcacggtacctgacttcaaactacactacaaggctacagtaaccaaaacagcatggtactggtaccaaaacagagatatagatcaatggaacagaacagagccctcagaaataatgctgcatatctacaactatctgatctttgacaaacctgagaaaaacaagcaatggggaaaggattccctatttaataaatggtgctgggaaaactggctagccatatgtagaaagctgaaactggatctcttccttacaccttatacaaaaattaattcaagatggattaaagacttaaacattaaacctaaaaccataaaaaccctagaagaaaatctaggcattaccattcaggacataggcatgggcaaggacttcatgtctaaaacagcaaaagcaatggcaacgaaagccaaaattgacaaatgggatctaattaaactaaagagcttctgcacagcaaaagaaactaccatcagagtgaacaggcaacctaaaaaatggaagaaaattttcgcaacctactcgtctgacaaagggctaatatccagaatctacaatgaactcaaacaaatttacaagaacaaaacaaacaaccccatcaaaaagtgggcaaaggatatgaacagacacttctcaaaagaacacatttatgcagccaaaaaacacatgaaaaaatgctcatcatcactggccatcaaagaaatgcaaatcaaaaccacaatgagataccatctcacaccagttagaatggcaatcattaaaaagtcaggaaacaacaggtgctggagaggatgtggagaaataggaacacttttacactgttggtgggactgcaaactagttcaaccattgtggaagtcagtgtggcgattcctcagggatctagaactagaaataccatttgacccagccatcccattactgggtatatacccacaggactataaatcatgctgctataaagacacatgcacacgtatgtttattgcagcactattcacaatagcaaagacttggaaccaacccaaatgtccaacaatgacagactggattaagaaaatgtggcacatatacaccatggaatactatgcagacataaaaaaggatgagttcatgtcctttgtagggacatggatgaaattggaaatcatcattctcagtaaactatcgcaaggacaaaaaaccaaacaccacatgttctcactcataggtgggaactgaacaatgagaacacatggacacaggaaggggaacatcacactctggggactgttgtggggtggggggaggggggagggatagcattgggagatatacctaatgccaaatgacgagttggtgggtgcagcacaccagcatggcacatgtatacatatgtaactaatctgcacattgtgcacacgtaccctaaaacttaaagtataataataataaaatttaaaaaaaaattcaaatgtttcctcttttacctcattatgatttctttcaaggcagacacaatgtgtctaatttgtctttatatcaccattacacattacagtagaattcactttattaggagtcaggactcaatttttgaacagtcagagtattacggacaaaacaatatttcatgtatttttaaacaaagtatttcacatcatttacttaatatctatatttgttaaatactgatgagaacaaaatttcaagtatctagaatttagcaaagaagttaaatgtccaactaaaataagtttaaatttaaatgattaaattgtttgttgtatttcagattctatccattttactttaatagaaaaatatcattcataaaaaagtttggctggccacagtgactgacaccaaaaatcaaagcattttgggagactgaggtaggaggattgcttgaggccaggagttccagacaagcctgggcaacataggagacccccgtatcttcaaaaataaacaaattagtgggatttggtggtacaggcctacagtcccaacttctcaggagactgaggcaggagaatcacttgagctcaggagttttaggcggccgtgagttatgattatcccactgcactccagcctaggtaacagagactctgtctctaataataataataataataataataaagttttcatgaaaaaaagaaatattaataaaatttcctaaattggagacatgcactcattatccacatatatcaacattggtcttattttcattatggtatactgtatgagctatggaaattattaagtatcaagcattaaattacctgccaattcttgttcattatacaatcactggtctcagaagaacataatcattacaaagacaacttcaaaagtaggagtgactatctttaatgctttaatgacattgtagagcatcacatcatgatttgttatggagtttagttttcctcttaattactatcacacttcaatctaaatgaatttagatttcatgtaacattttgactttttggaaggtcatggtttcttcattagtaggcaaaactcctacttaggaaagctatcaattcctcaattctcctattatttttatacatgtggttatagtttaatagattacttcttttatatgcccactgcagcatgtgaattttatgctaacaagagtgtgcacttaggcacacatgcaatatagctatgatatgtctatcatataaattaaatatgtgccaagtatttcatggagctaatacattttactcaaaatgtcagtaaattctagaaaaactggatggaaattgccaattataaaatgagagttttgattgaagtccacattagccaggaacccatactttggttacctgatattttggcataaatgtgaccacatattcatcttactatattattaccatatgaacatatatttcctttgaaatgctatcatgttcttcaagttatatgaatactaatgataagagatcttacatgttataaaaggaatacattgtatggaattacaatttatttagacatactttgggaaaagtttgattgcatttcatatgcgttcataaatcaaattgaactgtttcaggattttcaggaagcaaaatgacaaccaaaagtataatttaatcctaaagcatctttcctctttttttcttaatactcacagctaaacttaactgaaagtaaagttttcattctaagctttccaggttcattaaattgttcctatatcctcacaaaatcatgatttttgtttaaaatttaaggacatttttgttgttgttaacaaaatattgcttaaatacttgttatacatcatatatatttatgagtccaaaagtacctagttattataactttggaagcccagagtcctgtttaaaaaaaaaattagatgtcacaaaaggcctctgagctcttgatgaatgtgttataagttttgtgtacatcttaagggacctctttcacaagcaaccagaagtccttttgtaattacttatgctcaacatctatttctaatttgcagagctatgatgaggaacatccccagttcacacaccacttggcaactctgaactcactgatcaatgtgtcagtagacaggtttgtaatgagtagacataaaacaacatatcacatatgcgtgcacacacacacacacacacacatacacacgctctttaaagtgctttgaagtgtttactctttggtctgctactcatggaccaaatattattaaaaaatatgttgctgctactcttccaaatatacttaaaactctgacatgtaatgcaggttttcctataatctgtgaaatccctgctgcctttcaaaaaaatcattctaataaaaacagagataaatttacccagaagagtaaactagcatgaaatgccctgtttttgctgttgtcacaattcattgttaagttatttagtggtcccttattaaatgcccttagaattcgtagtgcaaaacgtttttacatagaatgggagtcctatatgacatattttaatttttacatggaatgacattcctatataacaaattttaatcctgttaatttaactaattacataaacctaaccaccacagtaaattatagtctgacctaaaagaaaatatggcatgagctgagacaaaatgtatccagttctcagaacatatctatgtctcctctaatttgtaggtcttttttcctttgtatgacactccacttaaatatcctgccggacctagctcaaatgctattttttctgcagcgtcttctctggctcggtcagtcagtaactgatgtttcttccatcatttcttcatataagatcaggctcattacattataattatttaggtatccctctgtctccctacagagcgtgagctccttgaaggcaagaacctttttacattttctttacactctcagacctaagtatagtactggatgttaaattaataaatacatgcaagatactatatcaactaaattagatatttcaaaatagttttgttgttgtaacaaaaattggatgttttgtagatgtttataattctgttttcattttaactaatacatagagttccactttattaaaacatatcctttgattaccttatagctagacacagaaggaggaaaataggagggtaaaggattttaaaagcatttggggatttttaaaaaaggcttccagagactaataaatcactgaacagtagtaacaatgctgtcatcaccaatctctatacaccgagtttcatgcagcatttaagaaagcctatgagttaaactgcgcttaaaataagatatatatttgcttttaaccatgtcaaattgtgcatgaaaagaaagtccttgaaggcactataccaaatgttataaagctcacctctggctggagagattatggattaattttttaaaatatttttcctatttccctaatattcttctaagagcatgtcttactttgatttacttatatttgtttcaaatattggctattattttttaaagcattacagatacttttaaaatctcttttatatcctgtcacaaacctatttccatgttgccttcatgagttaatcaccatcctgaagttggtatgtattatccgtctgtgcctttatacttttactatttatgtatatagtcattagacatattaattatgtcacagacatattgtgttttaaatttacattaatatcatatgacaattctgactcctttttttcatttaacactttcaatatagatccacatggatgtttataatcctactgttttattttaactaatacatagtgttccattttattaaaatttatcttttgattattttatgaatagacattttgttttttcgtaatttttcattcttacaaacaatattgcagtgaatatccgtgagagacttaaagttttcttttcaagagccatacctagtagtacaattaattgatagatagaagagtatgtgcatttcaaacttttaaaaatattgatgaattgtcatccaatgtggagtaccaatttatagtcctatgagaattcctgtttttctatatcctttacaatacttgatattgtcagaactcttgttttctgtctttctagtagatggaaatacaactggcacctcattggggccttaatttaaatgtccctgttacctgtgttaactatgtttattggttattcaaaattcattttcagggaattgtctttgccaattgtttccattctttgtttgctttttgttgttgtcttttccttactttgtagtgcttataccttctcagtatgtgcattataaacatctttcccagtttgtggcattttaaaagtattttgtgacatgtcatgctaagcatgagctttaatgtaatcaatcctaccaatcttcttaatgatgtgtactttttgtcttgtgtaagaaatccttccctaaactaagatgtccatgtggattactttttttaatttgttaaattgaggaattatattgaaagatttttggtggctgaaatatccttagaagagtgagttaagttctacttagtatgatctacgttttaatgcattattgaattcaatgtggtaatattttgcttagacttagtacatctgttttcacgcagagattaatccatatatactgttcttgtactctccttgtccattttcgtatgtaagtcatgaaagtacaaagttgggtagtttacttctttgtacactctcttcaacagtttgtatagcattggtattatctgttcattaaggtttgataaaactatcttatcaaaccattttgcaattctattctgttaaaatttactgagttatgactagtaattagtacttttcccagaaaattgtacattttatgtcttaaaatataaagaagaaattaataaaatcaagtatatcagtggttacattaaatataagtagaattatccccaataaaaaccaaacatggggctaaaaagttagacacatttttttaaaaaagttctatcctgctcattagaaatacacctaaaataaaataaagctggaaataaatagaaaagaagtgaaaagcaaaggcaaacaaaataacagaaatgaaaatattaaaatatataaggtcatattttagaattaaaattgttaatagaaataaagggaatactatataatgacaaacatgaagaaatttataaagcaattgtggtatcattctaggagtaaaatcctggaaactattttatctgaaacagaaaccagactcaaatgccttccattgccatttgttcaacattgtcttgaaggttctactaaatatatcaaagtgggaaattaaataattactataaatattggggaaaagagtgaaaatatttatttttgttgattacatgattatatatccaaaagcctctataaaactcaaaagccggctgggtggggtggctcatgcctgtaatccaagcacactggtaggccgaggtgggcagataattttaggtcaggagtttgagatcagcctggccaacatggtgaaatgccatctgtactaaaaatacaaaaaaaaaaaattagctaggcatggtggcacacacctgtaatcccagctacttgggaggctgaggcaggagaatcacttgaacccaggaaacagaggtttgcagtgagccgagatcacaccactgcactccagcctgggtgacagagtcagactctgtttcaaaaaaaaaagaaaaaaaaaaaacctcaaaagcttaagttttaaagtaaaatatattaaaattaaaataattttgtaaggtagctgaatacaactaatatattaaaaattcaatacttattgtgcattctaacaataaacacctataaatggaaatgggaaaaaaaattctttcaacagagtgataaaaactatcaaatagaaactactaagaaattcatagaaattgtatcatttaaaaaactatatattttattaaatgtcatgtaaaatctgaataaatctaggacaatataaaatattaaaagggcaattccccaaaagtaatataaacataaaattaaattccatttttttataattccatttttttggatgtagttcttttgaaattggatgaaattatcttaaaactcatatggtaaaataaatgaccaaaataacaaagaaagtatgaaaaataatagttaaaaaaagaatgcctgtccaaatagcagaaaagattatacagctactgtaattacattaatcagtcatataaaaaatgaagagcaataaaaatatgtccaaatatatagaattttataaataacaaagagtgtatgtgagtaggaaaaggaaagcttgtttaattaataatcataacacaaatgaaagaaagtaaatttaaacccctattgtaacacagtattaaaaaatccagatggattacagaattgattttaaacaataaaacaataataatcttaaaataaattataggagttcattagtatagcctgggataagggagaattcttaatcaagacaagaaacctagaagaaagaaagaaaaagattgatatatttcattacataaaaattgaaggccaggtgcggcagttcacgcctgtaatcccagcactttgagaggctgaggcaagcggattacttgaggtcaggagttcaaggccaccctggccaacatggtgaaatcccatctctactaaaaatagaaaaattagctacacatggtggcacacgcttgtaatcccagctacttgggaggctaaggcgggagaattgcttgaacctgggaggtgcaggttgcagtgagcagagattgccactgcactccagcctggacaacagagagagactctgtctcaaaaataaaataataaaataaaaattgaaaagatatcacaattaatcatcagaaaaatgacaaattgagaaagaatagttgtactacatataacagattaagggttaataactgtgatctataaagtgataaaatagtataaaattgggcaatttatatgaatagcaattcagagaaaagcaaatctaaattatcaacaactatttgaaaaggagcttgaactaatagtagctgaggaagtactaattcaaataaaaatgtgatatctattttgcactatcttcactggaagaattaaaatgtagaagaataaagattatattagctatctatttctgtgtaacaaattaccccaaaacttaaaaccgcaaatgtttattatcttgcagttttcatggctgagggtctaggtatggctctgctgactcagggtctcgaaggctgcaattaacgtgtcaattgggcctatggtctcatctgaggcttgactgggagaaattgacttcaaagaccactcacatggttgttggcagcattcagctcccacaggactgttgggttgagggcctcagtttcccactggctgttaatccaaggcctccctcagttccttgtcccatgggcctctccacggaacacaaagtgctccatcaaaatgagtgaaccagacagcaggagagagctaataaaacagaagccagaggtctttgtaacctgatctcagaagtgacatgcattattctttccatattctattcattagaagcaaattactcagtccagtctatacataaagggaagagattaaacaaaggcataaataccaggaaagcggatcactggcagttatcttagaggcttcatatggcagttgtggagaaaaagactgcaggctaacattgttggtggcaatggaaactgatacagctgttttggaaagcaatggcattaagatcagtccctccgcatctcattcagaggtcactttggtttgctaggttatttcccgattttacaactgcaagcccacatcctggaaatcccttcagtcctaggcaaaccagcttggtttgtcagcctactctagagccagactgtctgggtttaaatcatggctccatacttaactagcaatgccaccttgagtaagttacttaatttctctatgtctcagcttccttatttgtaaaataagcatgataatatcatgtttgtgggaaactgagacagtacctgtaaagtgcttaaagcaatgtctggcacattaaaaattctcaatgatatccattgttactatcatagatattaaaatatatgtatcctttcactaaggtatacaaacatttatcatccaaactgggaaacttttgagagtgaaaaggagtgctagtaataattatgccaggtcataaacaggaatattccagggagacttggatgtatgattaacttacatttgacccacagggaaatttctctcatagaaataaaggcacctcagtataagggaagtacacagtgatgtttgttgcagttttgtacttagtggaaaataaaaaagtaattcaaaattaagtgaatgctcaccagtagacaaagaataaatcacaatacataatgtttttaaatattatgcaacacttaaaacaatgaaatacagtgacaccaactgacttgaagaagttctttgaaatatctttgagtaaggaaagtaatatgcacaaaagtacaaatagttccatttgtaaaacaaaaggtttacactcagaggcaaatattgcagcttaagcttcagggtccagctctttcataggcccctcccaagatgttgagaggggtctagaaatgtttcctcatggttacatgtttttgtaaattatgcaaaagtaaaatattttaattgcaataggttaatacctctgtttctttcacctttaatttccctatcatatttctctgtattttgggtagtatttgaatggctgcagacatttttggaatccagctaaaggaaagatgaatcttgggcacatttagtttgggtttagtaatatatatttatgaattctgaagtcactcccatgtacatacagttcagatgtaagaatggcttctaggaatacccctaccacctcctgtgccaactcatcgggtatgcaacagaaagttttaaagccatattttgatatgggtgtgacctatgatgttcggtaccagaaatatttgtgtagtgagtgagaaagatttgaaatgtacagaactagccagtggaaaattcttccaaatcttcaagcttggaagtgaaagaaggattttatcaaagttgacaacaatccccaaaatcagcgtgacagtaccaataaccgattgtgaagctgaaataaactttctaacaaacaatgataaaacattaattttgatcaatcatgctagaggaaagaccgaattacccttttattttctctatcagagcattcttcaacagaaatagcgtgagccacatatgtaactttaaattttctaatacccatattaaaactttttaaataggtaaaatttaatgtttatttgacccaatttacttaaaatattagtatttcaaaacaaaaattactaataaaatattttacattctttttgtgtactatgtcttcataatcagatgtgcaatttatacttttagcacatgtcaattcagacagtaaactttaattgaaaatacacaatctatatttagactttgtagaattacagttgaaaaagtggattcatataaccaagtttttctaaacataaagttttcaaataactgaattgaacaccaaaaatcattttcctttaatatttggacctatgttgataaaactggttcattacttttaaaagaattaagttgactttgaaatataaccatttcaactttaaaattatgtctgcccaagtttaagtaaattctctgactcagcaatattaatagaaaagtcaaaggggtattgcataaattttaaaacagctctaaatttatcaacattaataaagctttcttcaaatttgttttgtttttgcaatacatttccataatgctattgaccatcaatggatggatggatacagaaaatgtggcatgtatatacaatggaatactgttgagccttaataaaagaagaaaattctgccatttgtgacagtatggatgaacctgggggacattatgctaagttaaacaaaccaggcacagtaagacaaatactgcatgacctcacttgtatgtggaatctagaaaagtcaaactcatataagcagggagtagaataatggttaccagacgttggagaggtgggtggaaggagaaaggcagaatgttagtcgaaaggagaatgttagtctaagttgcagttagaggagaggattaagctttagggatctattgcacagtatggtgactatagttaatacattgtatatttcaaaattgctaaaaaatagattttaaattttaaatgttctcactacaaataaatagtaggtatgtgaggtgatggatatgttaattagtttgatttatccattccattatgtatacatatatcaaaacattacactgtatcccataaatatatacacctattatttgtcaattaaagatcaatttaaaaatgaaaaatttaaaaaaatacatagatgactaggacatagagtataccctataagagagagacataaataacatgcatgtattttaaatattcaaaaattttttcatattgattcatattaatgtgtaaaataattatattgatttgttttatgaaaagctctgtttcaacacaactctttgtgtccttctcactaataagctcttcctttccttggagcttcaaacttagcttcttcatgtgtagtgtgatatcaagaaaatgtaggcacattgccatttctttacttactaagaaaagatatttttaatatacttcaaactgtgcaataaatcaataaaggaatttttttgttttaaaagtcaaaaaatctggatttttgatctaatataacaggaataccacatgttgtgatagatactaatgttttcacatttagtagaaattatttctttgatgtaaattttaaaaatctatttcatgagtttgattatttaggctatgagttgaaaatattttttaatttagcaaatctgaaggttgagagaaagcatactcaaagtgttaattaggcagtgtctcatgtcacatgacttacctatagctaatgaaaaatatctgcaattaaacatgttcttaataagttacatatgacattatttaggaaggtttttgtattcaatgaacagttgtttggtggtttaattgaagagcttttggttgtttttggcaaaatatcttcattagttttttcctcaaattttctagcaaaattttcattactgaaattacttcttttaccagatctcacttaaaatgttcttccctttgtttggaacctaatccattttatagctggcaaaaattacaagctcaaatccttccaaaaattgtttttatattttgtgttggatatttaattttgattcaggcaaataattttcactgatttttttttttactgttaagagcaaatgtctttttttaaaaaaaaattcaatagcttttgaggtataagtggttttatgttacacgcatgaattatatagtggtgaattctgagatttttgtgcacccatcacccatgtagtctacattgtacctaatgtgtagtttgtttttttatccctagctaccctctcaccctcctgcttctgagtccattatatcactctatgatgcctttgctgacacatggcttacctcccatttataactgagaacatatggtttttggtttcacactcctgtgttacctcacttagaataatggcctctagcttcatgcaaattgatgcaaaatacattattttgttccttttaatggctgagtagtattccatggcatatatatactacattttatatactacattttctttatccactcattagttgatgtgcacttagcttgcttccacatctttgcaattgtgaattgtgctgctataaacatatgtgtgccagtatctttttcatataatgacttcttttcctttgggtagacctagtagtaggattgctgtatccattggtagatctacatttagctctttaaggaacctccatactgttttccacaaaggttgtactaatttacattctcaccagcagtgaataggtgttcccctttccccacatccacaccaacatttgttgtttgactttttagtaatggccattcttgcaggagtaaggtggtttgaatttgcatttccctgattagtgatgctgaacatttttttcatatgtttattagctatttgtatatctccttttgagaaatgtctattcatattccttgtcaagtttttgaaggaattatttgcgggttttttgttttttgttttttctgatttgagttccttgtagattctggatactagtcctttgtcggatgcacagtttgcaaatattttctcccattctgtgggttgactgtttactctgataattatttattttgctatgctaaagtgttttagtttaattaggtcccatttacttttgtttttgttgcatttgcttttggggtcttagtcatgaattctctgccttggctgatgtctacataagatttttcaacatcgtcttccagaatttttacagtttcatgtcatatatttaagtctttgatccatcttgagttgatttttatatgtggtgagagatagggaaccagtttcattcttctacatgtggcttgccagttttcccagcaccatttattaaatagggtgtccattcccaaatttatgtatttgtctgctttgtcaaaatcacttggctgtatgtatttggctttatttctgggttctctattctgttccatttgtctatgtgcctacttttataccagtatcatgctgttttggtaattatagcattgcagtataatttgaagtctggtaatgtgatgcctccagatttgttctttttgcttagggtcactttggctatttgggctccttttgtggttccatatgaattttagaatggttttttataattctgtgaaaaataatgttggtattttgatgggaattgcattgaatctatgaattgctttgggcagtatggtcatttttccatgagcatggggtgagttttcatttgtttgtgtcatctatgattactttcagcagtgttttgtagttttccttgtagagatctttcaccttcttggttaagtatgttcctaggtatttttatttttttgcagctgttgtaaaagggattgagttattgatttgattctcagtgtgatcattgttggtgtatagcagtgctatggatttgtgtacactgattttgtaacctgagaatttactgaatttgtttatcaaatccaggagtcttttggagagtttttagaatattctaaatataaaatatcatctgcaaacagcaatagtttgacttctatttgaatgccttttatttctttatcttgcttaattgctctggctaggacttccaggaatatgctgaaaaggtatggtggaagtaggcaagcttgttttgttcctgttctcggtggggggaatgctttcaactttttcccattccatatgatgttggctgtgggtaggtcatatatagcttttattattttgagataggtcccttctatgcctcatttgttgagagtttttatcacaaaagtatgctggattttgtcaaatgctttttctgcatctattgagatgatcatatcatttttgtttttaattctgttaatgtaatgtatcacacttattgacttgcatatgttaaaccatccctgcatccctgggaggaaacccacttgatcatgatgaattatctttttgatgtgctggatttggttagctagtattttgttcaggatttttgcatctacgttcatcagggtaattagtctatagttttcttttttttgttgtgtccttcctggtttgggcatcaggctgatactggcttcatagaatgatttaggaaggattccctctttcttaaccttttggaagtttcagtaggattggtaccaattctctttttaatgaatgtctggtagaattcagctgtgaatccatctggtcctgggcttttttgttgttggcaattttaaaattatggattcaatccactgcttgtttttggtgtctttatggtttctatttcttcttgatttaatctatgagtggtgtatgtttccaggaattgacccatttcctctaggttttctagttcatgtgtgtataggtgttcacagtagcatccaatgatcttttgtatttttgtggtattggttgtaatgtatccagtttcatttctaattgagcttatttgaatcttctctcttcctcacctggttaatctagctaatgatctatctattttgtttatttttcaaagaatcagctttttatttcattaatctcttatatttatttgtttgaatttcatttacttttgctttgatctttgttatcttttttcttctgctagctttgggtttagtttgttcttgtttctctagtcccttgagatacaacataaggttgttaaaatttgtgcccttccagtttttgatgtgggcattgagcactataaactttcctttagcactgctgttgctgtatcccagagaatttgataacttatttcattattatcattcaattcaaataatttttaaagttccatcttaatttcattgttagctcagatatcattgaggagcaggttatttaatttccatgcgtttttatagttttgagggttcctttttgagttgatttctggttttattttgctgtggtttgagaagacacttatgatttcgatttttaaaaatttattgaggcttcttttctggcctgtcatatggtctatcttgaagaatgttacgtgctgatgagaagaatgtatattctattgttctagggtaaaatgttctgtaaatatctgctaagtacatttgttgtattatgccatttaagtccaccgtttctttgttgattttacgtctcaaagatctgtctagtggtgtcagtggtaaattaaaatcttccactattgttatgttgctatctcattttttaggtctagtagtaatgtttcataaatctgggagctccagtgttaggtgtatatatatttaggatggtaatatctttttgctgggttgacccttttatcattatatagtgaccgtctttgtgtgtgtgtgtgtgtttttttttttttttttttaccattggtgctttgaagtcagttttgtttgatataagactagctactcctgcttgcttttgtttccgtttgtgtggaatatctttttccacccttttgccctcagtttatatgaatccttccacaaggattcatataatgaatctcctgaagacagccaatatttggattgtgatattttaaaatccattctgccattctgtaccttttaagtggagcatttaggccatttacattcaacgttaatattgagatgtgagattctgttctcttcatcatagtaatttttacttagtttttttcattatgtcattgttttataggccttgtgagttttaagctttccaaaggttcgattttgatacatattgggcttttcttcaacgtttagaacaccttttagcacttcttgtagtgctggtttggtaatgacaaattccctcaagatctgtctgaaaatcactttatttcttcttcatttgtgaaacttagttttgtgggatataaaattcttggctgacagttgttctgtttaagaaggttgaagataggaccccacacctctctggcttgtcaggtttctgctgttagtctgataggttttcctttgtacgttacctgatgtttttgtcttactgctcttggaattctttgcttcatgtttactttagataacctgatgactatatgccttggtaaatatctttttgcaataaatttaccaagagttatttgagcttcttgaatttgatatctagatctctagctagaccagggaagttttcctcaattattccctcaaataagttttcctcaattattccctcaaataagttttccagacttaatattttctcttctctctcagaaatgccaattattcttaggtttggtcattttccataatcccatatttcttgaagactgtattcatttcttttgattcttttttctttattttgtctgactgggttaattcaaaggccctgtctttgagctctggaattctttcttctatttgttctagtctattgttaaaactttccactgcattttgtaacgccctaagtgtatctttcatttccagaagttcggattgctttttctggatgatatctatctctctagaaaatgtttcagtcatatcctgaactgctttaatttctctatgagggttttcatcattctctaatatctccctgagtagcttaataatcaaccttctgaattacttatgtggcatttcaaagatttcatcttggtttggatccattgctggagagctagtgtgatctttcagagatgttatagaatcctgttttgtcatattaccagagttacctttctgattccttctcatttgggtagactattccttctaattattcttaaatttatgtttgatttgactgtgtttttttttaatattccttttttcccctaaaagatgtgactttaatgcttatagttaattattgcctaacttagttcttggtactttcaggggtgaagactctgtaagatttccttggttatagtctttgcatgatggctttctcatatgctggttatattaagaacgttctcagtgtgtgagcaagttcactgtttactatggggttggaatggcagaggtctcttgatgcttatctcattcttccatggcatgtgcttatttatttatttatttatttatttatttatttatttatttttccccagtattttatttgctggtttgatggttcaggcttcaggccaataggggaggtgtcccttgacaggaaccagctgtggctaaagcaagtaggtaaatgcaatacccaatggtgggtagaggtcccagccttgacagaggtggctggaggagctcacagtgatttgcactaaggtcttatcaaggggaagagttgcagttacctcagctcccctgtcaggtcagcaggaaagttatccacctctcagacacactcctgtcctagtgctctggctatgcagatcggataggcacctcttttcatctgtaggaatgttgatactccatgtagaaagcaagtgactctgtgtcttatgcaaccctgaccctgtagggtgctcctcctgtggggatgcagtaaccctgacatgtttcagaaaggctgtctattgttgtacccatgctgagttcccatgggagaagccccaactgtgcctgccatggtggacaaggggggaatgacatctccttctccaaggcctatcaaatgcaccagggctgattgttgggttagagctgaagaatttccctgctgaacccagcactggaactgtgcttctgctgaaggaaacttcatatcagcagaaagatctggtgctcaaggcctgccatccaggtccttctgaaccacagggtattcccttgatttggtacactcccccttctcctaggaggtgggaatcctggaagctagactattatgaatgttgttgaagagtgaatttcttatcaaatttactatgtatttgtgaaatatacctcttactatttcccacttaattatctttaaagttttgttagacaacaaacagctgtttcagtttcctctgcattggcaaattacaattaccatcatcatgacatagacatgcttttctatgtttgtatattaaaggatatatactgagctttgagcattgcttaaaatgaaggtgagctgaagagtgggaacaattgggtcaggcaaaatgtgagacttgattagcattgcctatataaagttaggcattgtttacaggttttaattcagtgctacaagcatgtatgtctttagtaatttataagacattcaatatgggggggggacatttttcaaatataatgtgatttatattttttattgttgattcatatttcattatattatgatttcagattgtgacttatttctctgatgtgttgaaattgccacaatgacctaataagtggtcaatttttctcagggttttatgtgtgcttgaaaagaatatatatattctgtattgatgggcacaaagtcctagatatgtctattaaatcaagcttattaattctattattcaatagttctaatattatatttcttcatttgtcaatattctgaatgaaacatgacatattaaaatcttgcaaatattgtagatttctgtttctcaaaatcctatcagttttggcttttaatgtttcaaggctgtgttgtgtattgttgtatgtaaaaaaaattacggctatgatatcttcttggtattgtgctttctgtggtttgattcttttaatattataaagtattcctctttatcctttttaatgtttttagccttcaattaaattttgactaatgatagtcctgcaatgcctttctttatgttggttttgcttgatctttcctattttaacccaattctttcaaactttctgtgtcactttgatttaggttttactcttataaaaaagcatatagcaagaattttaaaaattgcatgcaatataatctctttgtctttcattagttatcttctccttcgcatttttggtttgccatgtttcttctttgcttcactcttttttccaagaactagggacattttaattaataaattgttgctttattcttttagtcttcattattggtttcgaagatatattttcctaatttttagtggtttctcttaaaatttttaccagaaatgttttttaacaaaaataaaaattattaagtacctttgtttctctagttctttagcaaacctctatcttgcttgtttttattgtctggaaatttaatatgcccagctgctcattctcagcagaggggcagactttctggccctagctccagtgaagctcttttagactccattaccattaagaatgcaatctccccactgctctgcccactgctggaccaagtcacgagctgggctgctattcaagtcccactttctattttgtgcttctgatccagttgagcatcaagatattttctttgcttttcagcacaagtaacgtttataattttctgtttttctattttttctttcattattgtttggaacactgggcaggagaaaataggggaaggattgctttaacaaaaacttgacagatcttgccatgatgacagagccattatacttctataataagaaaaatgtttaaattaattaaaaaatgaatacagtacaaacgcaatcccagaactttgggaggcgaggtgggcaaatcataacatcaggagtttgagaccagtctgaccaacatggtgaaaccccaactctactaaaaatacaaaaattagctaggcatggtggcacgcacctataatcccagctactcaggaggctgaggcaggagaatcacttgaacccgggaggcggaggtggcagtgagcggagatgacgccattgcactccagcctgggtgatagagcaagactccatctcagaaaaaaaaaaaaaaaaaagtacccacaaatgtatatacaccaaatgttcacattgatataaaaactatgcacagcaaagaaagaaaatacatcagaatattaaattagttgctgcaataagtatgatacggggaaagtacttttattctttttactttctatatattgaacaaaatttagtaaaactttattctattttataatgagaatacatatttttgagctactagaagagaaaagaagcattatattagtagctatgctaaaaattttaaagtaatacaatccaacagcaattaaaaggtaggcattttaagtcagctcataccttcagaaaggtatgccaccgtatctcaagatttacacaaatcacttttacacacgtggttatagtaaccaaagtatgcttcagttgaaatgataatccagcatcctcatagatgcctgtgactaaaggtcagttagtttcaaaaggaatggagtgcttagctgattcaatgctctcgacttgtttacggcatagcttttagcattccattattctctttttattgcctttatgcacaggtgaaaaacacagaaaacactagatgattatttggtaataaattgaatggttctatggaaatgaaaagcatagaaaacctatgtgattaaatggcaactgcagtttttctctggattctgcatataaatagaataggttctcccacagagaatgagcctggctaaatctgatagttaaatatacagctctggatgtaataatagtctttgaaccttcttgaatcccagtatctagagtgctttaagctattattttgccaagtactgtagataaagcctctctgttaccctatgtttaatatgtctttgttgtctttgtgtcttacacacctagttgacctggaaaatagtatgtcctcaacaaacgtttgtggaacaaatgaattggtggatagatggattaatgaatgaatgattttatgaaaagagatggttctgaacagtaaaaggaaacactgaattatttgaataatgcactgagaactacagtgatttctcaatgccagatttgcttctgaattcttatctccttcaacaaactattcccctattctgttttagtttccacaactgcaatatgacatctgatgataaatgtgatgaaatcacagatctggatatattttgtacattatttattgactgagattaaataacaaaattatttttaattctctatttttctaaattattcaaacctcatctgttaatacccaaaaataacacctaagaataacctagttttctcttttccctttttgtataaattgcctctgaaaggccaattgaagaactattatgagcttcttgaatttgtgtgttctaatataaacataaaatgtaatctattagataaaatctagaatacaatataatcaaggtaaaattgttactttttaaacatacagtgtgactgtattgtatgtcagttagttgtgttaatgttacttagagtctaggactatgtaaagacagaactagtagtcttcatataatactaaatgaaaagaaaatgaattagtaagtctgcagtagatatatctgacaagtctagaaaatgcaggtaaggtgaatagttaaatatgagactacaagcattacgtaagattgtaagatttctacaagattatattttcagtataaaactatttcccaattaatgttgtatgcagcagctgctaaatagagcaaagttactgagtgattccatgaagtaagagcttaaggctgggcgtagtggctcacgcctgtaaacccagcactttgggaggccgaggcaggcggatcatgagatcaggagatggagaccatagtgaaaccccatctctattaaaaatacaaaaaattagctgggcgcagtggtgggtgcctgtagtcccagctactggggaggctgaagcaggagaatggcgtgaacctgggaggcggagcttgcagtgagctgacataacgccactgcactccagcctgggcgacagagcaaggctccatctcagaaaaaaaaaaaagcttaattgttagtatgtgctgaaattacacaattgtgagttccaagagctataatgatattgcctcttttttaatttttattttagtttcaaggctacattttcagatttgttatataggtaaactcgtgtcacaagggtttgttgtacagattttttaatcactcaagtactaaacctagtatccaatacttatttattctgatcctcaccctcttcccaccctccacccacaagtaggccccagggtctgttgttcccttcctggtgtccatcatttagcacccaattttaagtgagaacttctcacttaaatgatgatgagcacttctcatcatttagcacccaattttaagtgagaacatgcagtatttggttttctgttcctgtgttagtttgctaaggattacagcctctagctccaaggctcaaaaaataaactcaaaatcatgcaattacatggaaattaaacaacctgctcctgaacgacttttgggtaactaataaaattaaggcagaaatcaagatgttctttgaaactaatgagagcaaagatacaacataccagaatctctggaacacagctaaggcagtgttaagagggaaatttatagcattaaatgcccacatcaaaaatttagaaagatctcaaattaacaacctaacatcacaactaaaagaactagagaaccaagggcacccccaaagctagcagaagacaagaaataactgaaatcagagctgaaatgaaggatatcaagacatgaaaaaccgttcaaaagagcaacaaatccaggagctgatttgttaaaaaaattaataagataggccactagttaaactaataaagaagaaaagagagaaggtctaaataaacacaatcagacatgacaaagaggatgttaccactgaccccacagaaatgcaaataaccatgagaggcaactatgaacatctctatgcacataaacgagaaaacctagaagagatggatgaatttctggacacatacactcttccaagactaacccaggaaggaactgattccctaaacagcccaataacaagctccaaaattgaattaggaataaatagcctaacaaccaaaaaaagcctatgactagactgattcacagccaatttctacccaatatacaaagaagagctggtaccatttctactgaaactatttcaaaaaattgataagggactccttgcgacctcatcctatgaggccagcatcatcctgatactaaaacctgccagaagcacaataaaaacaagaaacttcaggccaatatacttgattaacattgatgcaaaaatcctcaacaaaatacttgcaaacttaatccagtaacagaccaaaaagctaatccaccacaatcaattaagcttcatccctgggatgcaaggtaggttcaacatacacaaatcaataaatgtgattcatcacataaacagaactaaagacaaaaaacacatgattatctcaatagatgcagaaaaggctttcaataaaattcaacataaaacctctcaataaactaggtattgaaggcacagacctcaaaataataagagccatatatgacaaacccacagccaacatcatactgaatgagcaaaagctggaagcattccccttgaaaactggcacaagataggatgccttctctcaccactcctatttcacgtagtattggaagtcctggccagatcaatcaagcgagagacagaaataaagggcatccaaacagaaatagaggaagtcacactatccctgtttgcagacaatattgcctctttcaggagcattgaaaataactcttgtcagggtttcaactgcacactagccaggataatctaaatttaaatattacaatgtataagcaaaaatagtagttaaaaatctgtatctttagcagatgcaaggttattgcagaagtttaaggagggtgatgcaatcagatttgtggttttaagattactttgactgcaatgtgaataataaattcacatttctacaaagaagatacaatctacagaatctctgggacacacctagggaagtgttacaagggaaacaggactttaggaaactattataatagtccaaggaagtgttacaagggaaacaggactttaggagactattataatagtccaggacagttattggtggtgacggagattaagagaggcagatggatttgagagatatttagggatagaaatgtacataattaccctcatcctactgtttattccagctaaaagtcacaagacctggcgcttatttgaatatgaggaattgatagggaggttgcaataatgaccttcaggctggatgaataattaaatcatttactgagatgagaaattcagcatgaagaaaaggtttggggggaaagatgtgggagtttagttctagatatgctaaggttgaggtgcccttggagatatataagtaaataagtagatgatattaagtagatatacaagtaaagatattagatggattaatagatgggcctggagttaagagaagtggtctagcctggagataagtatgtcggagtcttcagcatgttgattgtaacagaagccgtactatagatgagataatttatagagagaaaaaagtaaaaagaataaagaggactgtttacgagccttgaggaactctcaacttttagagtcatgcagaaaaatgtcagccatcacaatagagaaggagcaccataataagatgaaaatctaccttagacgacaaagggaagaaagggtctccagatggaggtgtcgccaacctgtgcttctgagaggttaagaaaaagtgaggatcgagaaatgccctttttgattttgtgacatcaaggtcattagtaactttagaaagcacatttccacagagtaatggggaatagacacctgactaaagtgggctgagaagtgaaaacaaagaaggaaaatgaacatattgagagcacgggaataaagagagaacactagctgagtcgtcaggtgggatcaaggaagttttcatttattgtttagttgtttttgctgttagttgttcttgtggtttgctactgcttttcaaacgataaagacccgagcagatttaattgttgatgtgcacaatgcagtaaaaaaggacaattcactttgggaggccgaggtgggcgggttacgaggtcaggagattgagaccatcctggctaacacggagaaaccccatctctactaaaaatacaaaaaattagccgggcgtggtggcgggcgcctgtagtcccagctactcgggaggctgaggcaggaggatggggtgaacctgggaggcggagcttgtagtgagccgagatcgtgcccctgcactccagcctaggtgacagagggacactctgtctcaaaaaaaaaaaaaaaaaaaaaaaggacaattaaaattatagaggagagaaagactgaatgcaggggtcaaattcctgaggaggaaaagacctggcgcatagaagatggagccaaccttgggcaggaggaggaaaaccccctgtatcttaacaggagcagggagcaagaggaaggttacagggcagttgcatttaatcacctaatgaaggaagttaacaaagttccatctggtaaattctattttctttatgaattaaaatatgagaccatctgctgagagtgagagacaagggaggaaaagtatctcaggattgaggaaagcaatacagaacaagagtggaatgtgaagcagtgtggtaagtccactctactttcatgagcatgaacttatgaattaatgaatgtttaccttgttattatacatacactgacattataggagaaattctgttgcataggatagcatacacgacatcataaagagcctatattcccacatcatcaaatcatcaacctagcaggagttcattgtatttttagaaatcttactagtctacaattcatgttattcacacacagtggaaacaaaattgatttcaggggagaaaaagtgtgtgtgtgtgtgtgtgtgtgtgtgtgtgtgtgtgtagtttataatattgttttccaactacaacacatttccactaagttgaacaaattgagatgattatattttttaattggtaaactgtccatatggatgaaggaggcaggtaattcccttcaggtactgctttccttgatttctctctttgcccatccatgaactagcactggtttacaaatttatcatgtagatatctgctttaataaatggctaagacagcactgagcacagagcaaatgccaagtaaataattactgtttgataaaagtgcttcttatcagcaaggccagtatttgtgtgtaaaataatgcttccatggggctcaaaaatagtttgctctcttaaatgagttaaatatacccacagaaatcatgttgacactacccacttgctcagcagagataaacatttgttctagtccagtctgaattcatttaatttcaaaattttggcaatagaattaaggaagtttcaccattcaaaaaatatttaggtataaacaagttacagaatcaccctcacactcctacctatttcagatgttgcagaaggtatagtagagtgtggattattcaccagatggcattttcatttcaggttgaccacagtccagtaagcacattagcaaattgaacagaggtaactaagacccacactatcttggcatgcagctgctgaatgtgtcctttttttatcagagatcatctattctctttcaacatgattggaagcagtctttgctggtggttttgtaaattgctcattaatcaaaatggatttatcgggcatccatagtatacaaagcctgtactaagtgattcaaaataacggttgcctagttaccttaaaatggaaaaattcccctaggaaggttaaaatcaaaggaaaaggagacaagaaaacattatatttgatgacacctggctatttcataagggattttactgccattacagccattttcttttaaacataatatccatccattcattcgttcattcaattattcattcatttatgcaagtgagtcaccactataattaaacaaggtctttagcttgatgctataaaggaaacaaacaggattcaatagtggtcgcataaacatgagtcttagcaaattcaccaagcaagtgctagactactgttggtctttatttaataagtccagtactagaacaatcttattctttacttcatgtgaaatctgtagtcatgaggcattagtaaaatgctccttggaaagagtatccttcattttctggttgaattgtaaaatcttgctgaatacagatctactaataagttgcttttatttaaattaaactagtacatctgataattttttttttcctgtggtcaggattagatttattttgtactagcccttctagtttttaatacaagagaccacagaaaggaaagttaactttgattttctgagcaaatgcatacttataccatgaatacacaatgttgccagtcacaaccaaccctcagctgctcagcccctgagaaatgaaagccaggcaggttgtgtgctgtactgtggcccaagcatcctcaattgcctctccctattatgtattgaatttgtgtgctcagttttaatccctatatttgttacctaggggtgcttcaacaaactacagccatccctcagtgtccaaggggaattggttcccagactccctgttgaggaggattgggtatttgaggatacccaaatctacggatgcttaagtctcttctataaaatggtgtagtgtttacatataacctattcacatcctcctggatactttagatcatctttagattacttgtaatacctactgctacataaatagttgttatacagtattttctttagacaatgatgacaagaaaacaagtctgtacatgttcagcacagacccacccatccatttttgcttctgacatatttttaatttgtagttggttgaatccatggatgtggaactcacagatacagagggccaactatactagtaactgggtggcttaaacaatagaaatgtattgtgtcacagctttcaaggatagaagtccaaactcaaggtggcagggatggttccttctgtgggctgtgagggaaggatctgtcccaggcctccttggtttgcgaatggctgccttttcctgttatatcttcacattgtcttccctctatgggtgcctgtctctgggtctaaatttcccttaaataaggatactggtcatattggattagggtccacttaatggctttattttaacttgattatctttacaatgattctatatccaaattccccaaataagatcatattctaaagtactataggttaggattccaacctttcttttcgggggcataatatgggggggacacaattcaatctataacagtccctcttaagacttgatcacccctcagtctttctctttctctctctctctctctccacccccacctccaccaccctgtctctccaggaaatcttcatgcagttcttgtatagagtagtaatgcccattttgtctgtaagcctaagccatgttacctaacacagttaacctaaagcattgaatgcattccctgaagtacaattctcaaatttccttgaccccttattgtccaagtgtcagcattctcaagatgagaaggatgagctttactcctacatgcttctcagctttgtttccccttgcctttctctgctgcaattgtctttgttctggccactgtcatttcttgctgagtgtatgcactgatttgctaatgaatcttcccgctttcaacttcatctttctccaatctatactctatactccacattgcttctagagggatcattctaaaacagaaacctgatcatgccatgttcacttctgctgtcagatgaaatccaaacttctgcctgttactccttgttctttatgcattctaccctagtatcattctatgctctaaccatgccaagtgggcatagtctctgaatgtactctgttctttcaccctctctgcatctctgcacacactgccccttgcctggagtgccataccttattcatctatctaactcctccttctttgaggctagcaaatcatgtagcacttcctcccacaagccttccttcattcacattcctccccttctactctcccagagcaccctatgcttatcttgttcattgcccttattatccttaattttaacacattctaagctcctaaaggtcaacacttataccttttgctctgttccttatgcaatatttagcacaatgcctagaacatcagaggtactcaataagtgcttattgaatggatcagaactatagggtatttacccaccaagatcaatttgagggtctctaaaagactcgtgtgcatcaagaaatgtctccacgtttgcaaattctacctttactcactaaagaatttagtaacaaagggaatacatcagtaactccaagagaggtcagtaacttccctgagttctccagatcagttagttggccctaagggggaaatgcatagctaggtatgagtcacaagggactagtcatagcagttgagagacttggaagtaataggattgatgcaaaacctaaactatgggttaatggaatcaacagaggaaaaaatgcaaactatttccttacctaaccagaaaagaagtaacagttatgttgatgctctcctctacctgctatggcgcttattgggggcaattctgtggggctgagtggataaggtctcatataaaattacatagaaactgttttgatctatattcatcccaattctaatcattttttaaaaaccacaaaatttccctttaaattctggactcctttaccttagaattcatgatcacagcccaaagactatcaattattatgaattaagcctgggtcaactgagcaaactggcttcttctatactaaacccaagtgatcaaacacaattggggaaaattatgtagccatgcaaactaagtctttacccaattttaacaacaacaacaacaaactcaggcattgtaggagtttatattttctgaaagtggctgcaagaatatcttcttataatgtgactttagttaacactccttcatcaaggggaggcaagaattaaattccctccacttaaatgtaggcaggcttttgactacaatggaagtgatgttgccttctgatgtctcattttcttagaatgtttgcttagaatcccaacacagaccacgagaaagtccaagtaggccatggcagcgatatgagtatggatcttgagaataaaacctccagaccccagttaagcttcccccgttgacaccacatggaacagagacaagctatccctgccaagccctccccaaattgcagatttaaaagcaaaacaaatgactgttgttttcactcactaagctttggagtggtttgttatgcagtgacaataaccagaagagattttgatagttggatatggggtgctgccaaaacaaaaacttaaaatacgtggcattagcaccgagattgggcagcagacagaagctggaagagccccaaagccagtgcctgtcaagccaaaagggccaaggaaggatggatttgtggaagccttaaaagctataagaaaggtgttgatgaaagcttaaaggaaagaaaacgtaactgtaagctgaaagaaagtttcttctctctctgcagtgttttacctagacctgtggcaaaaatctaagactcactccctctctctgtgcatgtacaaagaagaggtttggtaagcagggtgatgacagccttcaacaagccaggaagagagctctcaccagaacctgaccatgccagtaccctgcagatttccagcctccagaacaaggacgtaatacaaatgatgcagcttcctcttagttctttggggatgcttgctctcagaatccaggcagtagtcaggaggaaacccaagcagtgcctggagagcaaaaaaggcctccagtccattgccttagccaagttactggtacatagccaacactaactttcagccatatgagctggccatcttaaaagtgttcctctattccccagttgaacagcccgagatcataagatgtgacacagataatcagtccctgacaagccctgtcaaacttgcagatttgtgagcaaaataaatgactgatgtcagtttgttttggggtggcctgttaataacaatagataactgatacaggcatcatctcctttatgtcttcctcaagctccaggtaaggttaagtactcccccatttttgctcccaaagaactctttgtgaaacactatcttagcaattattgtgctctgttgaatttaactcttcacttgtctacctcttcgagctcaagggtaatatcatgctttttgaaaaattacctcctcaaatatattatatttgtcacattctctctttcttctcctctggaactttgattagacgagaaaactttgcagtatatctttcaagtctctcagcttctctttcatattttccacatttttgtctctgtgcaacattctgaaaaatttcttgtggcttaatttccagttcactatatctcccttcagctgaatctcatctgctgttccactcattcattgagttttaaattgcatgtgtgtatgtgtaagtaattggaatttttttcatttctaaaagttttttttttcctctccaatatgctaggtcattttcttttagtttctattcccaaaaaatatcttcaggctcactttttctttataatggcacagtcattgtatagtctacatctactaattccagtatttgaaagcacttaaggtgtggatcggctcttccttgtttttgttggttcctgttgggttttctttccctataggcttaattattagaaactgttaattttaataataggaaaattattcatagaaattatttggggccctggaggagagtatatttctctccagagggattacatttgcttccacttgatacctgagggtattagtttaaatgcatgaactgacattttttggaccaccaaggtgatatgaattttgtgtggcaatctgtgagggctagttagtagtaataattcttcaggaatttcccaccccctgacctgccttgttctgctcacaaaaaatcatctttccttggagtccccttggggtggggaatacaggattacctctgattcctctaaggctgtagcccttggaatcctagttctatggaggaaggatttcctattacagtccctgagctggacaggctgtgtagatatttgttttcagtatccaaagccacagaagtcttgagcactgaagttcattagcaggttcagtaagctcccccaggacaaatgtgactttagtgcagcatttatttcctaccctcgccaatgttttggcttgattatttcttactaaccaactaataaaaagaaattcctaatttagatgtgattcgatttctgtaattttcatatcagctttttgatacttttaagaagtttttttcttttctatatcgtatccagcatttttatttgttttcagcaagagttgacctgagcctgatcagccttgttatctgtgtccatgtcattttcatccttgtatcctcagcattcaaaattgtgccccagcatgcataagaactcaattagtttttgactacttaatcaatacatagctgtgtcttcaattttgcattccttcctctatcacacctgatattcccctaccctctgtgccccaattaaagctctttcacattttgcatatctatttcctgcattttcctattttaatgaagcttccccccctgaatatgctatttccctcattatctctcttacggaaaaggaaaagttctcattcttgtcaacttccatagcctggggtcagcattgttttcattctccatgaccgctgtgggtcactttctattatttggccttcatccaaactctgatgctcatctgaagtttacactattctattataacattctttttgtaattttattgttatcatatgtggacctccagtcatatctctacatttcttgagggtttcagtatttgattcctaatatctaccccacctcatcccctagtaaaatgcagcactacagcatagtgtttaagagcacaagttagacaactcaaggtcaagtaccaaatctacccctcattaacatgtaaccttgggaggccagctaatgtttcaatgcctcagtttccttatctctaaaatgagaataatgatattaatacctcacagcattgtaagaatcatatggaataatgcatataaagcacttagaacagtatctgccacataataaatgctcaataaatttactattttcattactgcactattaccttaaaagtcttccttctgtatgtttatgattcattaacaccctagcctcagtactgctcaaaaatccatttttttcacttgtacaaaattccctagactattacgtataatggcttttctgaattttatttacttatttatttagagacagggtatcactgtgtcacccaggctgcagtgcagtggtgtgaccacggtttactgtagccttgacctcccaaactcaggcaatcctcccacctcagcctcctgaatagctgggactacaggcatgggccatcacgtccagctaattttttaattgtttgtagcaatggggtttcaccaggttgcccaggctagttttgaactcctgagctcaagtgatccacccaccttgtctaggattacaggcatgaggtagtgtctgtaataggctagtgctaagaatataggcatgagccatcgctcctggactgaattttaatttaacccttcttaagatctagctcttactttcggccaataaccttttatcttacccagaaattgaatccatttgaaaataaatatttcagaatttctctatattcataaccatgctgtcttctcgctactctgtggggaagcaaggtctgtgtttccctaaactagctgagtcttaacttctacccattctgttctttttattctttatcttcaataccttgctctaccagaaaattcctctaaacttgatcaagtcttatttatcctaacataaaccagctatttccctcttgcacctgctttcttcttatgttactatcatacctcttcttctaatctccttgaaagagtcatccgtactctctactccatttcccagtgtcttatttcccatttcccaatgtctcactattaacttccagacatctacttgtaccacatcacttctaaaatttactattcaaaagtaagttgcgactgcattaccaaaccaaaaaaaaaagcctctcttcagaatttttcttacaactccttcacagcattaaatatattgaccatccacttgaaaatttcctccttcattagctttcatataatcactctgtattctttcttaaagtaatagaaagaaactataatggtagtcaaaaatccatgttcaagcataggccccactattgctcttaaaactctaatttctttatcagcaaaatagggataatatttgtcttgctttgttcactagtttgtaatgcaaaaaataaaacaaaataatgaatctgataatgccataaaagacatgaaatatataaagcagctaagtaagatttgataacttggtaacagataggctacagaaaatgatacaaaaattgctaccaattggctgtgaactcctgaaggaaccaaagctgtgtatcttacctagaaggttttttcagtattaaaaggtttcaaagcatcttcatcaaagcattaccatgtccattatggcttttaccaggaagttaggagacttcaaataaaaaaccttctgacctacctggactcacttcaaaatgaaaaaataattattggaactacattgggggaactttcattttgataacatagtaggaaaccaaaatgttaatgatgcatcttcatatgaataagcaagtaaattgaatcaggccaattgtgagtaagagatattaccagttcttggggaaggtgcccttgcaatttctaaggagcaaggtttctttgtaacagctgtgtccatgagatcacacagaaagttctcattttctgaaggaaatgtatccagagaagcagatggtacaatttccatagtgtaatttctcttctttggataggactcctgaaaagaagaaaaaataaaaacagctttgtgatgaagaaacagccttgtttaatttataaaaactagaaaagataatcaggttcattagttctttccaaagtgattgacagctgatgattcatctgtttgaataaattatagaatcatgtaaacccaatatcagtgatatttttaagagtcctcataatttaaaaggactgaatttattactgaattagtaaaggtattgcccttttttgtaatatatatctattatctagttgtggcataaactgctggttaactaatcaacagtcatccccaagactctactcctttgccggcctcctggagacacccatataactcggagacacccatataactcaactttggcccattagatgtaagatgaagtttgctaaaaggctggtgggaaaaaatttttccccaaggaagaagcatataaggaggctctttcagagccaaggccatccccaggctcctctctttggatgcagttttgatatctggagctagggcaagcattttgtgaccaaaaggcaagaatcttcagatcaaaaaggtaacaagccaagaatggcaacagaaggataaaaagagcctgggacattgatcatatcattgagctgctcaaatagacccagggccagtttctccagtcttcttacataaataataacattcttacagtttgagccattgctaattgggttttctgtcatttagagttaaatgtcttgccatccagcacactagtatctttccttgtaaataccattaactaatatactaaggtactcttttcaggttaggataaaatataggtccagttctatatgattgattctttgatatattctaaaaattagaatttatttcattttataagattttgatttcctgtacataaggcattaattggtcaacaaatacttattgggcatctactatatatatgtagaatatatatagcatatttatatattatatatatatgtatatatatataatgtgctaaatgctggactgtttttaaactaatgagacataatccttgctctgaagaagttcacagtctgctggagaagactgtgaaattctgcatgatgaaattcacaattaatcatattttatttttgctacagatcctcctcagctttacaaaaaaacccaaagtaagttgaaaatattgtaagtagaaactgcatttaatacacttaacctaccaaacagcatagcttagcctagcctaccttaaatgtgctcagaacacttacattagcgtatagttgggcaaaatcatctggtaacacagtacattgtagaatattagttacttacccttgtggttttgtggctgactgggagttgtggcttgctaccactgctcagcatcatgagagagttatctatcatagggtatattgctagcccaggaaaatattcaaaatctgatgtacggtttctactgaacatacactgctttcacaccattgcaaagtcaaaaactcgtaagttgaaccatcatgagttgcagaccatctgtatgtgctacttttataaagtatgcctcacaatcaagaaaaagacaaataagaaaatagactaatatttttgaaaaatctccctaagtatattctagggctgataaagatttagtacgaattcctagtttttctacagtacagcagaattcaaggtcagggtaattgctttcagacaataccagaccctcacacatcagagagtcaattatggtcatgatactccattgaaagcaggaaattgggagtaatttatttttaacaacaaagggtgacaaagtagaaggcatccagaggaaagtaatcaggatggcatataattctgaaaccatgtcagagaagaaatgatgaaaggaactgcagtgttctatccagagaagccttatagccacataatagttttctcaatgatttgaaaggctatccctcatcaactatcccacaaaggggggatggagaaaagttgatgtggtagatttattctaaggcccataaagacaagacaaagactaatgtttataagtcaagaagggcaaatttggctcaatacaaaaaataattttctatgaattaatgatattgtttaccttttaaaataaaaaggcactataaaatgagttaacaaatagcattataaagcaacagaaggaagtcctcattactgaaaatcttccagcagaattatctgctgataaaattgtggatgaaacacattgtacaatgagtccaacaggttactataagctccatgaaggctggaatttgtcttgtccactactctgtccctagaatctaatacaggtcctgccaatagttgatgagttgatgctcaataaatatgtattgatcaactgaacagtctctagtgtcctttaaacaaagctaactacaagttatggaaatgattttttttcaaatgtaaattattttgcctttcagttcagttaatattgttcaccagtttgcatataaaaagtgaaaaactgagattacaacgataagattgtaaagattctatggaaaaaaagagtctccagttaaactcctagttccatcctgaaattaaattaatcaaaacaacccatggatttagttaagttggaattttacagtgtgtatgaacacttctgaggatttttaaagcctcgaaaaccactttgaaatttaatcacaaagcatgggttaatttgctttcttccttaaaaatgaagtatataggtttattagagaataatttgaaaacataaagaaagaggaaaataatcacatgaaaatcaagcatgctgagataactgagggtaatattttggtgaccatcctcccagactgtttcactctgtgaatgtgtgtggacatgtgagtatgtgcaaaggaaagaaaaaatattttaaacaataatgaagtactccctcttctgcttcctaatggagggccataatttcttcttagaatgtaagtctttgtagaacctggcttccttagggaaggtgaggcccccgcgggaaggagttggtaaaaacgaagatagtgaaacaatgcttttgtaaccaaatatttcaatgtcaagaaagagagatagttgaacaaaatatctgacaagtgaccgtcaaaagaggatatgcaagataatttttttaaaaaaatggatccatgtgtccactactcagtttaagaggtagaatattaccattgtatcattgaaacctgtcccccaacccaccccatgttcatctttccaattttaccctttttcctcctctaccagggctaaatgctttctgagctttgtgtttttaattgcttggactgtgttaaattttaactatacatgtaagtatcaataaaaaataaatttttagtactgtatgctttcaaactttatatatatagtatcaaatgctctagttcttctgtgatttttctcaatcaagattatgtttctgaatttcatctattttcagtgtggtacaggagctcattgtttaagattaccacaattcatttacacattctcctgacaatggacttttaaatgtttcctaggtgttttgttatttaggataatgttattataaattttcccatatgaagtctcttggagcaagtaaccagggttatgctgcctattctagtagtgatggggaagagtcaagaacagacagcagacgagaaaaataaatgaaatcaagagatgataatgagaatggaaattgtatgccctgtagattctatagaatcttaaggatagcatttgcagttttctacccaaagtggcaggagggttcaaaggatattctgtaaatcttattaaaatattatatataagtatagtattatataaaatatttcctaatctgttatttacctctaatgatatattttatacccttttcaatgacaattatatgtctacatgatgaacttgggtcccaatatatacctggtcataatttatttggccaatcctatcatattgaaattttaatgttttgctttgaaggaaacatttttgttcatatattttgtttacatattcaactattttgaaatagaattcctgtgataatacatatatgacttatgtttacatataattgaatctgtatctggactttctaattggttccatatatatgtctattctagtacaggcatacctcaaggtgtatcgtgttttacagatattgcatttttaaaaaaataaagatttatggcaaccgggcattgagcaagtctatcagcaccatttttccaacatgttcttattttgtgtcacattttggtaattctcctaatatgtcaaatttttcattattattatatctgttatggccatctgtgatcagtgagctttgatgttactgttgtaattgttttggaatgccacaagccacaatcatataaaacagtgaacttaatgcataagtgtagtatgtgttctgactgctccaccgaccagccattcccctgtctcatcttctccttgggcctccctatttcctgagacacaacaatattgaaattaggccaattagtaacccttcaatggcctctaagagttcaaattcaagaagagtcacatgtctctcactttaaataaaaagctaacaatgattaaggttagtgaagaagacatgtcaaaaagctaggcctcttgtgccaaacagctaccaagctgtgaatgcaaaggaaaagttcttgaaggaaattaaaagtgctactccagtgaacacacaaatgataagaaagggaaacagtcttattgctgatatggagaaagtttcagtggtctggatagaagatcacaccagccacaacattcacacaagccaaatcctaatccagagcaagactctaattctctttaattcaatgaaggctgccagaggtgaagaagctgcagaagtttgaagctggctgtggttagttcataaggcttaaggaaagaaactatctccataacataaaagtgcaaggtgaagcatcaaatgctaatggagaagctgcaacaagttatccagaagatcccgctaagacaattgatgaaggtgactacactaaacaatagatttgcaatgtagatgaaacagcctcataccagaagatgtcatttaggactttcacagctagagaagagaagtcaatgcttggcttcaaactttaaaaggacagtccaactcttttgttaggggctagtgcagttgatgactttaagttgaagccaatgctcatttaccactccaaaaatcctagattccttaaaaatgatgctaaatcaacttttcctatgctctataaatgaaacaacaaatctggatgacagcatgtctgttggcagcatgtctgtttacagcataatttactgaatattttaagcccactattgagacctactattcacaagaaaagattcctttcaaaatattactattcattgacaaagccacagatcacccaagagctctgatagagctgtacgaagagattaacgttgttttcatgactgttaacacagcatgtattctccagcccatagatcaaggattaatttagagtctcaagtcttattatttaagaaatacattatataaggctatagctgtcatagaaagtgattcctctgatgaaactgagcaaagtaaattgaaaacctagacaagattttccattctagatgccattcagaacatttgtgattcatcagatgaagtcaacatcaatgagtctagatgaagttgactccaaccctcagggaggactttgataggtttgactttggtggaggaagtaactgcagatgtgacggataaatagcaagagaactggaagtggagcctgaatataggactgaattgctgtaatcccatgataaaacttgaatggatgaggagttgcttcttacaggcgaacaaagtggtttaagatgaaatacactcctggtgaagatgctgtgaacattgtagaaatgataacaaaggatttagaatattacataaacttcattgataaagcagtggcagggtttgagaggattgactccaattttgaaagaagttctagtgtgagtaaaatgctatcaaacagctttgcatgctacaaagaaatctttcatgaaaggaagactcaaataattcagcaaaactacattgttcccttattttaagaaactgcccactgattttgtatcctgagagtttgctgaaattgcttatcagcttaagaagcttttgggctgagatgatggggctttctagatacaggatcatgtgatctgcaaacaaatattgtttgacttcttctcttcctatttgaataccccttatttctttctcttgcctgattgccctggccaggacttccaatactatgttgaataggagtggtggagacagcatccttgtcatgtgctggttttcaaggggaatgcttccagcttttgcccattcagtatgatgttggctgtgggtttgtcatatatggctgttattatttgaggtatgttccttcaaaacctagtttattcagaatttttaccatgaagggatgttgaattttatcaatggccttttctgcaggcaaatcatgaatgaactgccacatcatgaatgaactgccattcacaactgctactaagagagcaaaatggctaggaatacagctaataagtgaggcaaaggacctctttaaggagaactacaaaccactgttcaaggaaatcagagatgacacaaacaaatggaaaaacattccatgctcacagataggaagaatcaatatcgtgaaaatggccatactgtccaaagtaatttatagacaatgctattcccattaaactaccattgacattcttcacagaattagaaaaaaactaatttaaaattcatatggaaccaaaaggagcccgaatagccaagacaatcccaagcaaaatgaaaaaagttggaggcatcacgctacctgacttcaaactatactcaaggctatagtaatgaaaaaagcatggaactggtgacaaaaacagacacatagaccaatggaacagaatagagaactcagaaataatatcacacatctacaacaatctgatcttcgacaaacctgacaaaaacaagcaatggagagaggattctctattttaaaaatggtgctgggagaactgactagccatatgcaggaaattgaaactggaccccttccctacaccttatacaaaaattaactaaagatggattcatgatttcaatataaaatgtaaaactataaaaaccctagaagaaaatctaggcaataccattcaggacataggcatgggcaaagacttcatgctgaaaatgccagaagtgattgcaacaaaaacaaaaattgacaaatgggatctaattaaattaaaaagcttctacacagcaaaagaaactatcaacagagtgaacagacaacctacagagtgggataaaatttttgcaatctatccatctgacaaaagtctaatatccagaatctataaggaagttaaatatataagaaaaaagcaattccattaagaagcgggcaaaggacataaacagacgcttctcaaaaaaagacattcattgtccaacgaacatgaaaaaaagctcaacaacactgatcattagagaatttcaaatcaaaaccacaatgagatcacctcatgcagtcagaatgatgattattaaaaagtcaagaaacaacagatgctggcttgttgcagaaaaaaaaaggaatgctttcatactgttggtgggagtgtaaattagttcaaccattgtggaagatggtgtggtgattcctcaaagatctagaaggagaaaaagcatttgacccagcaatcccattattgggtatatacccaaagtattataaatcattctattataaagatacatgcacatataagttcattacagcactgttcacaatagcaaagacatggggtcaacccaaatggccaccaatgatagactggataaagaaaatgtggtacatatacaccatggaatactatgcagccataaaagggaatgagatcatgtcctttgcagggacatggatggagctggaagccattttcctcagcaaactaatgcaggaacagacaaccaaataccacatgttctcacttataagtgggagctgaacaatgagaacacatggacacatggggggaaaaacacacactggggcctgtcagggaggcagggagaggagaccgtcagaaagaatagctaatagatgctaggcttaatacctaggtgataggctgatctgtgcagcaaaccaccatggcacacgtttacctaacaaacttgcacatcctgcacatgtaccctggaacttaaaagttgaaagaaaaaaaaaaaactgtcacagtcacctaagctccagcaaccattactctgatcagtcagtggccattcaaatcaaggcaagaccctccaccagcaaaaaattatgactcactgaaggctcatatgatcgttggcatgttttagtaataaagtatttttaattaggtatgtactcttttttagacataatgctattgcacacttcataaactacagtatagtgtaaacattactttaatatgcattgggaaaccaaaaaaatcatgtgactggctttgctgtaatagtcactgtattgtggtggttgaaaccaaactcacaacatttgtgaagtatgtctgtaccagaattacactgtcttgattagtggagcgtttaaattgattttactatctggtaggataaatctttcatcatgttaatctttcccaaggcattaattattaacttcatgtttatttttcaaaaagaaaaaatttgaaacattttgttaagttttcctcaaatcattccttctcatttgttccctatcagtaatcaatacttccatatatccaggcactaaaagaacctgggatatggttcacttttcattctttctctgtcattcccaataaatcctcaagtcctatactttgccattgaattatacctcaaacacatttatttctctccaccccagctaccgcatgctagtccagaccaccattatatttcacctgaactgctggaacaacttccaaagtatcttctttgtctccagtcctgcctctcttctaatcaattcattttcaaaactagcttgaagcttctaagagtaagtaaggtcaaagcaaactcatttattttcatcataactttatttgatgagagaatcataaaatgctagtcatagaacacgttgattctttttaaacatttaacacggtctctcataatatctcagaatttccttgctgaatgatttcattaaatacattaatgatctaaatagtaaattcatttaattaacaagataggaaagaagaaacaaagttccttgagtaataagtttaaacgtaatcccattagttgataagataaatgggattaatttctaaagacatacttatctagcacctagcaaaattccatgttcatagtaggactctatgaatatatgatgaaaaaataaatgcataaattaccatatcagttagaatttcatggcttgcaacctctgctagaattaaagcaccataggggcaagaaccatgataatcttcatatagtacgtatttaataaacatttgtcaaagtctgaaacaatgtcatccaaaaacaatcacagattcaaactatcacaaatccaaaactaccacaaattccccactgtgggaagaattacaacttatatttatgcagtgttttatcatctgcaaagtgaatactattttatttgcccagatgattctcatttagccctcacaacaatccagccaatgctactatcaccgccatccagaaactaggactgaaattattaagtgacttgtccaatattaagcatcttgttaatggaaatgttagggatccaaccttggtcttctggcaccagatctagtgttcatgtgattgtgtcaaagataaaaatgactatgaccagatatttattgccagaactaagggaaagaggacactctgcacatcgttaggtagtatctagctctgccaattttcaagcctttgtatgtccccttccctgcactgggaaacgttgacctcaatacacagattaactgccaacatatccttgatggttaatcctggtaataggcaagagggattaaaaggactgcaatgcaacaatttctgactccttcaagactcaattttctccagtctagcaatattgggctcaaaatagattagtagtttttgcttttttcttgacatttggcctctatcatttaaaaaaaaaaaaacttttaaatatgcaacttttgtgggtgtatagcaggtatatgtatttatgtggtacatttgatattttgataaaggcaagcaatatgtaataattacatcatggaaaatggggtatccatcccttcaagcatttatccttgtgttacgtaagtccaattatacccttttagttatcttaaaatatacaattaaattgttattgactatagcgcccctgttgtgatatcaaatactccattttatttattctttctaactatgttttgaaccaataaccatccacaactcccaccctcagacccccactattcttcccagcctctggaaaccatcatcctactttatgtctccatgagtacaattattttgacatttagattccacaaataagtgagaacatgtgatatttgtctttccatgcctggtttatttcacttaacgtaatgacctccagttctatccatgttgttgcaaataaaaggatctctcttttacggttgaataggtactctgctgtgtataagtaccacagtttctgtatccattcttctcttgatggacacttagattgcttccaaatttttctattgtaaacagtgctgcaacaaatatgggagtagagccatctcttccatatagtgttttcctttgggggtggggggtgtatataaccagcaatgggattgctgaattacatgatagctccctttttagttttttgaggaacctccaaactgttctcctcacattcccaccaacagtgtaccatggttcccttttctccacatcctcaccagcatttgttattgcctgtcttttggataaaagtcatttaactggggtgaaatgatatctcattgtagttttgatttgcatgtctctgacgatcagtgatgctgagcaccttttcatatgcctgtttgccatttgtatgtcttcttttaagaaatgtctattcaaatctgttgcccattttctaagtgggttattcgattttttcctatagagttgtttggactgcttttatattctagttatcacctgtcagattattagtttgcattttctcccattttgtgggttgcttcttcactgtgttgtttcccttgctgtgcagaagcttttgaacttgatgtgctcccatttgtccatttttgttgtgtttgcctgtgcttgaggggtattactcaaaaactttttgcccagaccaaatgccctggagagtttccccaaacttttcttatggcagtttcatagtttgacatcttggatttaagtctttaatctattttcatttgatatttgtatatggggagagataaggttctagtttcattattccgcatataggtatcaagttttgccagcacagaatactatgcacccataaaaaggaacaagatcatgtcctttgccgggacatagatgaagctggaagccattatcctcagcaaactaacacaggaagagaaaaccaaacacctcatgttgtcactcataagtgggagctaaaaaatgagaacacatggacccagggaggggaacaacacacccaggaccctgtcagggaggcagggggagggaaagcaacaggataaatagctaatgcatgtggggcttaacacctaggtgatgggtggataggtgcagcaaaccaccatggcacatatttacctatgtaacaaacctgcatgttctccatgtgtatcctggaatttaaaataaaattaatttaaaaaaaaaagactgtttttttcccaatgtatgttcttggcacctttgtaaaaaatgagttcactgtagatgtgtggatttgtttctgtgttctctattctattccattggtcaatatgcctgttcttatgcagtactatgctgttttggttaccatagctctgtagtataatttgaatccaggtaacgtgattcctccagtgtggttcttttcttctcaggatagctttgtttcttctgggtcttttgtagttccatataaattttagaattgcattttctatttctgtgaaaaatatcattggtatttgagtagggattgcattaaatctgtacattgctttgggtagtatggatatttcaacaatactgattttaccaatctatatatatgaaatatcttttcattttcttgtatgatctttaatttcattcatcagtattttatagttttcattgtagagatctttcacttctttaggtaattcctagttatttaattttagttgtggctattgtaagtgcaataactcttttgatttctttttcaggttgttcactgttggcatatagaaatgctactgatttttgtatgttgattttgtatcctgacactactaaatttatcaattctcattctttttggtggagtctttaggtttttccaaatataagatcatgctaggtgtggtggctcacacctgtaatcccaacactttgggaggccaagatgggcggatcatctgaggtaaggagttcgagactagcctgaccaatgtggtgaaaccctgtctctagtaaaaatacaaaaaaaaaaaaaaaattagctgggtgtggtggtgggcgcctgtaatctcagctactcaagaggctgaggcaggagaatcgcttgaatatatatagccaacaagaatactttgacttctacctttccaatttggatgccctttatatctttctcttgttggattgctctatctaggacttccagtactatgctgactaacggtggcaaaagtgataatccttgttgtgttccagatcttggaggaaaggctttcagtttttccccagtcagtatgatactagctgtgggtctgtcatatatagctcttattatgttaagatatgttccttctatactcagttttttgaaggttttctgtgatgaaaggatgttgaatttcatcaaatgctttttcagcatcaattgaaatgatcatatggtttttatcctttattctgttgatatgatgtattatattggttgatttgcatatgttgaaccatccttgcctcctagggataaatcccacttggtcatgataaaacatctttttaatatattgttgaattcagtttgctaacattttgttgaggatttttgcattaatattagtcagagatactgaccagtatttttttttatgggtctttgtctggttttggtatcagggtaatgctggtcttgtagaatgagtttggaagtattctctcctcctctactttttggaatagtttcagtaggattagtattagttctttaaatgtttggtagaattcagcagtgaagccatcaggtcctaggcttttatttgctgggagactttttattacaccttcaatctcattacttgttattagtctgttcaggttttgaatttctttatggctcaattttgataggttgtctgtgtctagtaatttatccatttcttctgggttttccaatttatcggcctatagttactcatagaacccattaatgatcctctgaatttctgctttataggttgtaatgtctcctttttcatctctgaatttatttggatcttctctctttttttcttagtctagataaaggtctgtcaatctgagtctggctaaaggtttgccaatgtttatcttttcaaaaaaacaactttttgttttactgatatcttgtatggatttcttcatctcaatttcatttatctctgctttgatttttaatatttcttttctactaattttaaatttggtttgctctagcttttctaattctttaagatgcaccaattggttgtttatttgaagtgtttcttccttttgatgtagacacttataggataaactttcctcttagtactgctttcactatatcctatacattttggtatgttgtgtttccattatggtttgttttgagaaatttttcaatttccttcttaatttcttcattgacccctggtcatttcagggcatattgtttaattttcatgtgtctgtatagtttccaaaattcctcttgttattgattatatttattccattttggccagagaaaatgcttaatattatctaaatttggttgaatgttttcaaatttgttttgtgagctaacatatggcctatccttgagaatgatccatgtgctaaggaacagaatgtgtattcttcagtcactgagtgagatgttttgtaagtatctattaagtgaatttgatgtatagtatagattaagttcaatgtttctttgtagattttctgtttgaagatctgtccaatcctgaaagtgggatgttgaagacctagctattattgtattaaggcctatctgtctctttagctctaataatgtttccattatatatgtgggtgccccatggttgggtgcacacatatttataagtgttatatcctcttgctgaattgacccttttatcattatataacgaccttctttgtctgacttgtcttatagtttttgtcttgaaatctactttgtctgatataaatatagctattcctattcttttttggtttccagtggcttggaatatctttttccatccttttattttcagtctatttgtatctttatagatgatgtgtgtttcttgcaggcacagatcattggctcttgttttttcacctattcggccactctatttgaagtcagtcttctcattcagactctcattcagtattctcttccctctttccttctgtcttttctcccttttagtgaaagtgattttctctggtgctatgatttaatttcttcctttttattttttgtatatccattgtatgtattttgatttgaggttaccatgagccttgcaaataccatctaataatccattattttaactggtgacaatttaacaatgattgcttaaacaaacatgcaaaaagtaaactaatgaaggctctacactttaactttgtctgcctgctttttaacttcttgttgcttctctttatgtattattgtattgtgtatgtcttcaaacgttgttgtagttgttatttttgattggctcattgtataatctttctacttaagatatgagtagtttacatgccacaattacagtgctataatattctctgtttttttctgtgtgcttattattgccagtaacttttgtacctatagatgatttcttcttgctcattaacatgctcttctttcagatttaagaactccctttaacatttcttgtaggacaggtctgttgttgatgaaatcccttagctttggtttgtctgggaagatctttatttatctttcatgcttaaagcatattttcaccagatatactattcctgggtaaaagtttttttccttcagccgtttaaatatgtcatgccattctctcctggcctgccaggtttctactaaaaagtctgctgccaaacatattggagctgttatttgttatttgtttcttttcttttgctacttttaggatccttcctttatccttgacctttgggactttgattattaaataccttgaagtaatcttctttggtttaaatctgcttgcattctataatcttcttgtacttgaatgttgatatctttctctagatttgggaagttctccagtattatccctttgaataaactttctacccccacctcctctttaaggccaataactcttagatttgaccttttgaggctattttccagagcctgtagttgcgctttattgttttttgttgttttttcttttgcttcctctgactgtgttttttgttttgtttagttttttgttttcttgagatggagtttcgctcttgttgcccaggctgaagtgcaatggcatgatctcagctcactgcaaccttcacttccttggttcaaacgattctcctgcttcagcctttaagtagctgggattacaggtgcccaccaccatgcccagctaattttgtatttttagtagaaatggggtttctccatgttggtcaggctggtctcgaactcccaacctcaggtgatctgcctgcctcagcctcccaaagtgctgggattacagacatgagccactgttcctggtctgactgtgtatttttaaacagcctgtcttgaagctcactttcttctgctgcttgatcaattctaccattaaaagactctgatgcattcttcagtgtgttgattgcgttttttcagctccagaatttctacttgattctttttaattatttcattctctttgttaaatttatgtaatagaattctgaattccttctgtatcttatcttgaatttcttttgagtttcctcaacacagctattttgaattatctgtctgaatggtcatgtacctctgtttctccaggattagtccttagtgccttactgagtttatttggtgaggtcatattttccaggatggtcttgatgcttgtagatgttcatcaatgtctggacactgaagagttaggcctttattgtagtcttcgcagtacaggcttgtttgtgcctgtccttcttggcaaggctttccagatactcaaagggacctaggttctaagccccctaatgctgtggtttttgcagactcatagaagtatcattttggtgatcttggataagatctgaaatgattctcttgattaccaggcagagactcttgttctctttccttactttctcctaaacaaatagagtcagtgtctctctctcaatctctcgctctctctctctctctgctgagccacctggaacttggggtatggtgatgcaagcacccctgtggccacagccattgaaactgtgctctgtcagacttgaagccagcacagcactgggtcttgccccacacacactgtaaacactttctggctaccacctctgttgactcaaggcactagggctcagtgatcagcaggtagcaaagccagccaggtctgtgtccttccctttagggcgggaagttcccctaggtcctgggtgggtccagaaatgctgtttgagaagcagagattggagtcgaaaaccttttaagtttacctgatgttctattctactgcaggtaagctggctctcaaaccacaatacaaagtccttcctagtcttctccttactgtttttctaatgcctgattatggatcctagacttgtttttgtacttgaatttttacaatagtagcaggcctaggactgtgttctctgccttggtctttgacagttctcttccaagagattgatgtccagtccctgaatcccaaacaggtcctttaggccctgtgccacctaaatttacagctccaatgggaatgaatagctttgatgctttgccttacttagattcctttatcctacctgctactgtcaattgtgcaatgtgcagaccaaatagtactgcttcaaagtgactaatcatgcatactgacagcacttaataagtaaagagaacattatgccccccaagaaaaataaatattggcaataagaaatctatataataagcgttcatacgttgtttacactgtgttttctataacatttaaaactatcagtggtgggcagaatataacaagtcaaactttattagtgactcagtaaaaggttctatgcttcagtagagaaaagagttataaaaaattcatcatggagctatgtggattagcaatactatgaaaaaaatattaggagttacagctgacagtatgagtcagactgtaacatgccagttaaagaaattaatgtgacattagctgatttaatacaagtatgatatttcacctagaaagagtgacaggcctccactcttcagtgctaattagtattgggaatgatctggcttcacaatttcataaaaggcgggctaactggattgtgctgaatttcctttagtaaggctgtgcaaggtcttattcatcaaagagactgggggagacttggccttctgacttacgaaagatcttagcaacaatcaggaacccagaggtagacacagtagttgcccaaaagtaccaataatgtagtttttcaaatcagaaattaggtggcctagaggcttttctagactactttgatagggcatctcactgaatttgcttcctagcacagctctattcttagccacatgggaaaactaaagcatcttaattgacactacaggggaatcacacatgatgcacttggcttggtgctggggctgacacttgaggagaggcaaagaccaaatggaccgttttctgtgaacataagtgaggaaaatggtgagtattaaacccctgtcatgtgagaaaagattaaataagaaaaggtgctgaggaacgtgtatgacaaacatttaaaaggtaaaatagtgattagaattgttatctatctctaaggaagtagaaataatgcagatggggagatggtaacagggacagatattgcagctgatgataagatttctaataattagagctttgcagtataaaactggctgcttactaagtagcaaactctctgtccctggagtcttcaaggctagcctgatctatacaaggcatcttcttttttttttttttttttttgagacggagtctcactctgttgcccaggctggagtgcaggggcgcgatcttggctcactgcaagctccgcctcctgggtttacacaattctcctgcctcagcctcccaatagctgggaccacaggcgcccgccaccacgcccggctaattttttgtatttttagtaaagacagggtctcaccctgttagccaggatggtctcaatctcctaaccttgtgatccacctgcctcagcctcccaaagtgctgggactacaggcgtgagccaccacacccagcctatacaaggtatcttctgagtgtagaagatagcagtttgaattagacgagttttaagatgctaagtaaatgagagaatcagaatagaagttttgtattagtactatggtacaagttacctgaatatattcactgcttcctgaattttttctgataatgggggaagtaacactaatacaagagtgtgggtttatggcttttttaaagttagaaatgactcacagttccaaatgactcaaggtaggtgaaagtttttggaagtggtctgactactctgacatcttcccacaatatcaagaaaaagtatcccctgaagatttacaatgacattcaaataagaaaaactacaacatgaatatgaaatcagaagaaaaataacttttttttaaaacgaagatactttaggtgggagcaaagaatgaatgacagaaaggcagccatgggggaaggagcatcacgtaacagtggtaggcagaataatggctctgaaagatgtccatgtctgaatccctggaaactaggaatacattacgtaacacatagcaaaaggaactttgcagatgtaagtcaaggatcttgctatgaggagatcatactgcattatccaggtggcccactatactcagaaaggacattataagtagaagagggagaaaggagagccagtgtcagtgatgcaacacgaggtatctgactggctgtcactggttttggagcttgaagttagccatatgtattagtctgttttcatgccgctcataaagacatacccaagactgggtaatttataaagaaaaagaagtttaatggactcacagtcccatgttgctggggaggcctcacaatcatggcagaagagcaagggacgtcttacatggcagcaggcaagagagaacgagagccaagcaaaaggggaaaccccttataaaaccatcagatctcatgagatttattccctaccatgagaacagtattggggaactgcccccataattcaattatctcccacaggatccctcccacagcataggaatcacgggaattctgggagctacagtccaagatgagatttgggtggggacacagccaaatcatatcaccatgaatcaaggactgtgagcagctcatagaagctggaaaaggcaggaaaacagattcttccctagagcctccagaaaggaaagcagccctttctatattttcgactggtagggcccattctggacctccagaactgaagaataatacatttgtgttgtttttttatgccactaaatgtgtggtaatttgttacagcagcgttaggaaacaaatgcaataatataccagcagaaggcatcacacagggaggcatgggctaagagaaggacataaaattggacaccagtgggaaaatacaccttatcattttgtactgactcagtattttaaagatggtgattctttctcgtttttaaatgtaatacaataccattgcaatacagtttccctccaactccaacttagttcttgacaagtaagcctaaagtgcatttggaaaaataaatgtgtgacaatagacaggttatcaatttgaaaagagaaaggtaatggagggagtggagatcaacctttatcagatatttatgtaaactacaaatggttctggtacaataattgaaaggcaagataacagaaaaaatactttaaaagaaggttctgatgcttgcagaaacttattacattataaaggtggtatttcaaatcagtaagaaaaccacgggttatataataattgtcagtgaggtaaccaactagtcatttagagagaaataataaacttgaattactactgcattccttatatcaaattaattcctgataaagatttaaacaattagcaaatatatttgttataataatcttgaaataagaataacttttgaccagaagctacaaccagacacataaccaaggttgtacagaaaaagattgataaatttgaatatatactactattaaatttgtataaagaaactaaaatatcataaagatcaagagacaaaaaatttgggaaaattctttgacaaatataacaaagggttaatctctttaatatatataaagataataataaattgagatgaaagagaccatcaacctaagagaaaaaaatgagcaaagattacaggcagttgtaaaaatagctagaaatttcttacatgaaaagatgctcaacttcatttataattaaatatatgtacatgaaagcaagataacacaccattcttgatcaaattgctgtagataatacacagtgttagtgagggtttgaaaaaaatgggcactttatataaaagttaaaagactaaccatctgttagtcaaagtgtgaattgatgtaaacctctttctggctaatttgtcatttgttacaggagatcgttagaaagcagatctttagacagcatggactttagaacttttgccatgttaaaatttttccctcacctcggaacaggtgggattgataaactaccattactatttctaaaacatggtactgtaaagcaccatttacaggcattgcataattattactctatctaaaaaatgctaaatgctggatatgctgtatgtttctattaaataataaaatgggagtgtgggtggagggaagcctgcctcttggtgtcatgcatgagaaaaactaatcagatctcaccaatatcaatcgtctgagctgtgaatgggtgtcgggatagcatccctctttagaagttactgatgaaaccccatgaagcttgattcttagataagccttgcttggtcagccacttcaaaattggaggtaccaatttaacatttgaaaacaaaaaatctcaacaacaaagttctgagaaaccagtgtgggtactacctaagaatgttactttgggtatgatatgggttaaactatgtcctcccaaaattcacgtgtcaaagtcctaaccccagtacataagaatgtgacattatttagaaatagggtcactgcagatgcaattagttaaatggagatgaggttattagggtggaccccaatccaatgacaagtgtcgttataaaaagaagaaatctggagacagacttgtacacaggtataacatcatatgaagattggagttatgctgccacaagccaagaaatgctaaacattgtcagaaaaccaacaggaatggaacaaattctctctcacagacctcagaaggaaccagtcctgctgacaccttaattttgaacttctagcctttagaactgtgagacaataaatttctgttaaggtatgcagtttgtagtactttcttatggaaaccctagcaagccaatatagagttaaaaaaaacagtaaaaggtactcgttgaaaaacttttgattaatctcttagcattttaacatatttactccttgggaaaaaaataacaattagggactatcaaaaaaggggattatctttcttcttgataaaattcccaaaagtgtaataggtatcaaaattttaaaatcacgtaccctttaataaaataaataagtattgttgctgtaaacaggcaatatagtacaatatagaggtctacagactttagactgcacaaagtccacctggatcacttgttagtaatccggatttgtggctctccccggaattcttactaaatcggaatctctggtggtagccatggagagttatatcttacaattatcccaggtcatgttgatgcaaattgttggtgaaatatacttggaaaatacaggaagagtagttcaagagcatgagccctttaactggagtcagaatcccaactctgccttttttaacaaagttgccttggcaaagtcttacagtttcctcatctgcaaaattagaatagtaatagtatctgcttcaaggttttgttggtagttgtgaatgaaataataaaatcaataaataactttgattaaaatgtatcaaaccaccaatgacattcttaacataatgagaaaaaaactattttaaaattcatatgggaccaaaaaaaaaaaaatggcccaaatagccaaggcaattctaagcataaagaacaaagttggaagcatcacattacctgacttcaagctatatactacaaggctacagtaaccaaaacagcatggtactggtgctacagtagacacatagacaagcagaacagagtagagagctcagaaataaagccacatgtctacaaccatttgatcttcgccaaacctgacaaaaacaagcaacgggaaaagtactccctattcaataaatggtgctgggataactggctagccatatgcagaaaattgaaactggaccccttccttacaccatatacaaaaaatcaactcaagaaggattaaagacttaaatataaaacctaaatccataaaaaccctggaagaaaacctaggaaataccactctggacatagaactagacaaagatttcctgatgaagatgccaaaaacaattgcaacaaaaccaaaaattgacaaacgggacctaattaaactaaagagcttctgcacagccaaaaaacagaacaaaaacaaaaacaaaaaaaaaaacaaaaaaaaaaccatcaacagagtaaacagacaacctacagaatgggagaaaatatttgcaaagtatgcatctgacaaaggtctaatcccaaatctataaaaaacttttaaaaaattacaagcaaaaaaaccaaacaaccccattaaaaatgaggaacataacatgaataaaatgattcatttcaaaaagatgattcatttcataaagcacttagtctagtgtctaaaagcctaagtgatcaatcaatgtagccattattactactcagtaatttttaaaatgagataaatgtgcaagtactgatatgttaagctaaaacaataaacaaagggaagaataatatgtgatgtatgttcatatctgtgtgaaaaaagtatgcactcaaattatatattcctggaatatttctagaagatattattagaaacatttggtgtttaacactgggaaatgagatcatattctcttttgctttgcttgatttaaaaaaattatatgtacatgtgattttcagggaaaaaatatagtttgtgaatctaccacctgaggaaagagatgataccatttcaaatacaaatgagctttgatttttatttctggcactactgtgtagaaatttgcataccccaggtgaaattggaaatggtgaaatcccaagaataatctctgtaatgaatcatacaaatgcaactgaaaacatgccaaatgtcaggtaaaactaaataggaaccacctttgtacaaatcctcaaaaaaagacctagatgatctagatcagaagtcaacaagaagtcaaaagaagtggaatgtagttcaccaataagaagatgacaaagaggagaatgttcacctagactcgaacccttgaaccatttatctttctcttgttctatcatgcttactgtttctgtaaagaagccatcaacaagttgggcgtattagctcacacctgtaatcccagcactttgggaggctgagatgggccgatcagctgaggtctggagttcaagaccagcctggccaacatggtgaaatgctgtctctactaaaaatacaaaaatgagcagggcatggtggcgtgtgcctgtaataccagctacttgggaggctgagggaggagaatcacttgaacctgggaggcagaggttgcagtgagcaaagattgcaccactgcacaccagcctggtgacacagcaagactctgtttccaggaaaaaaataaaagaagaagtagtcatcaacttctgtaagcttttcacttcctaattacccttaaatccacactatttttctacgtccataatcactaagctagttcaagcttcatcagctcatacctatgttacatatttaaataatctccaaactcccatctaatttagctccattttaaccaggagttcccatcattctgaatactaaaacatttttttcgaagtaaaaatttttacagattctctaagtgataatattaggattaatttaggaatgtagacagtataataaatgactttcttatttactctctaaattatagataagagtccagggttcaagaaaccaaccagagattttaaacatttaggctttgcaggccacatggtctctgttgtaactactcagtattggtgttgtagcacagaagcagccacgtacaatatgtaaatagaaaagcttgtccagatttggcctgcagtgagtcagaactgtcctagtgaccacagattgccagactgtggcaaagaggtcatgcaaaagagtttaaaacatcagtaaggctagtgatgaagcagatactggtttaggcccttggcagtgtaggcttcctactcctacactctagaactacatagactggcatcaggtctcccaagcgagttctttattgctaggcttaccttacatactttctgcaggtgagaagatcacaaagagaataagtgacacaagctcagtttctgctcccaagtttaggagtcagttaacttccctgagaaaagaacaggaacagagagaagcccagtcacacttatccataactctccacgtgaaaatacaaagtcaggggaaagaatctcactttccttgcccaactgcaacaggtaagttgtaccactgtattaaaaaaatcagcaaaaagcaaaagtgattttccatttttattaatcacaacaaaacttatgcaaattttaaaataataaatatggacatggatatgtaaaacctaccatttatttaatctacagacagaggttagtatctgtatggattttcaagcccttttcagcaaccccatagtggcccacttgagatccacagcttcataccacttctaaaaggtagggactattataaccctcacagtatagtactgtcagaggacaatcatgatcatccaataaatatttgttgaataaaaatatgaattttatactaatttattctttaaagctttcaaagcctctccaaggataccttttaatacaaaccctctcttcccatatgcctgatatactcagtagcctccatcctgaatgacatattcctgcctctgtcttcttgcttatgttctccttattccctctgagtagcagggccctcccaggcctatagaaattctccctttccttcataggcaatcataaattctacttagtccagtaagaattttgtggctacacttgactacatagcttgctttcttctctgaacctaaaaacaacagtaatattctgtttgatattaaatcagtatctcatgacacattagcttttcaggactgcatttataatcaatatttttattgttagctacttttgttgttgttgtagtatacatttttatttttactttttatttcaatagctttaggaatacaagtgttttttggttacatggataaattataggaacctcccaactctccccccttctgagtctccagtgtcaactacaccacacagtacacctttgtgtacctataacttagcttccaattataagtaggaatatgtggtatttggttttctatttccaagttacttcacttaggataatggcttccagttccatacaaggtgctgcaaaagacataatttcattctttcttatggctgagtagcattccatggtatatataccacattttctttatccggtcatcagttgatgggcactgagattgattccgtatctttgcaattgtgaattgtgttgcaattaacatatgagtacaattgtctttctaataacttccttttctttgaggaaatacccagtagttggattgttcaatagatggtagatgtgcttttagttctctgaaaagttgccacactgttttccatagaggttttactaattcacattcccaccaacagtttataagcattctcttttctccgcatctgaaccaacatctattgttttttgactttttgaaaatggccattctgactagggtgatcttgtagctcactgtggttttaatttgcatttctctgatgattagtgatatcgagcatgtgtttgttggccatttgtatgtcttcttttgaaaaatatctgttcatattgcttgtctactttgtaacgggattgtttttttttttcttgctgatttgtttgagttccttatagattctgcatattagtgctttgtcagatatacagtttgtggatattttctcccattctgtaggttgtctgtttactttgtggattatttcttttgcagtgcagaagctttttcatttaattcaatcacatttatttttgttttgttggatttgcttttggggtctgtgccctaaattatttgccgaaggcaatatccagaagagttttcctaagttttcttctacaatttttatggtttcaggtcttacatttaaggtttttttgttgttgttgttgtttgcttgtttgtttgtttttgagacggagtctcgctctgtcgccaggctggagtgcagtggcccgatctcggctccctgcaagctccgcctcccaggttcacgccattctcctgcctcagcctcccgaatagctgggactacaggcgcctgccacccaacctggctaattttttgcatttttagtacagacggggtttcatcgtgttagccaggatggtctcaatctcctgacctcgtgagccacccacctcggcctcccaaagtgctgggattacaggcgtgagccaccacgcctggtcacatttaagtttttaattaatcttgagttaatttttatacatggtgagagataggaatccagttttcattcttctatacgtggctattccattttctcagcaccatttattaaataggatgtcctttccccagtgcatgtttttgtctgcttagtcaaagatcagttggttgtaggtattttgctttgtttctgggttctcaattctgttacatttgtctctgtgcctattttataccagtaccatgttattttggttactattatagccctgtagtataacatgaagtcaggtcatgtgatgcatctagatttgttctttttccttaggactgcttttgctagttaggcttttttggttggttccttgtgaatttttggattgtttcttctaattctgtgaagaatgacattggtattttgataggaattgtattgaatctgtagattgctttgagcagtatggtcattttcacaatattgattcttccaatccataagaataggatgtttttccatttgtttgtgtcatctatgacttctttcattggtgttttgtagttctccttggagagacctttcacatccttggttaagtgtattaggtattttattaatattatattattttgcagctattgtaaatgggattgagttcttcatttcattttcagcttggtcattgttggtgtatagcagtgctactgattagtgtttatgttgattttgtaatctgagactttagtgaattcatctatcagatctaggagtcttttggaggagtctttggggttttcaaggtataagatcatatcatcagcaaaagaagatagtttggcttcctcttttccaatttggatgttctttctttctcttgcctgattgctctggctaagacttccagtactgtgctgaatagaagtgatgaaagtgggcatccttgtcttgttccagccttcagggagaatgctttcaacttttccccattcagtatgatgttggctgtgggtttatcatatatggctcttatcattttgaggtattttagctactttttagattctaccctcccagtgagctagtgctccatttggtgtttcatttgtgtgtgtgtgcacgcttctattttatgcttcacagaaatccatacaattcctacacagagtagactttcaaaatattgaattatttatgttaaatgactcaattaattaacaaaagaatggataaataaataacataaatgaccaatattaataaaaattaagtcttaaaaatatggagaaaaacttgaatggcctcccaaaaccttccaatccctgtgctattttaacagaaacattaattatttttaaaaaaccctctttgtagtcatttacttcacagagacaagaaatatggtaacataaaggtaaataatataaatctgtgacttgaatccttgaaaaatctggaacaacaaaaatattgacaaataatatcattgtttaaaatactgaagaagaatatattgcaatgacaatatgaaaatatgttttggtatctccagtctcagtcttgttagaagtatgttcagaagtgaacaactgaatgagaagtgaagtgctcataggggaaggataagtccagaaatctgaatttagtcccacatagcaatgaatgtttctcaattatacaaattacagtcaccacttcagtgataatcatgtcatttgccatttattgttttcactcatcaagggataaagaaaaataaaagatgaaagttacttgaaaaataatgatgaatccatatgctgagagaaaagcattgtgttctaaatgacaaccaacacctgaacccaggactcacttatttggttaattaatatacattcgaggctgtgaaattgtcatttctacacataataattaaacaccattaatggaaacacctaaaataactacatttgctttctcagagaattacacattaggaaagtaagttaatgtgataaacattttacaatatatttagacttttaggaaactttttttttcttttttcttttctttttttttttttttttgagatggagtctcactctctcacccaggctggggtgcagtggcattatttcggctcactgcaagctccacctcccgggtttaccccattctcctgcctcagcctcccgagtagctgggactacaggcacctgccaccacacccggctgattttttctatttttagtagagacggggtttcaccatgttagccaggatggtctcgatctcctgacctcgtgatctgaccacctcggcctcccaaagtgctgggattacaggcatgagccaccgcgcccggccctttttaaaaaattaacgtgatttaggaggccacttgaagatattcagcttttgatggcataaaattctggctttaataaccaaccactagttatttaatatgattgtgtacctgcaaaaagcttaagaaacttttagctaaatgaaggaattctttaagaagacaaaataagaattagtcacatatctgcttttccactattcttgttaccattactctaccagcatccctgcaaagcagatcagcaatatttgtgtgttttgaaactcctctggtttcctggcttctaagatccagtccatcaccaagtcccatgattggtccactcttgttgtcccacgtccatgttaaactaggtttcagcatcacacatgcagattaatgtcactgtctctgaactcatctcccttcttggacagcttcacttcatcctatataccaccattagaagaatctttgaacacaattattctcaaattattcctagcccaaaaactcaaatactttctaaataaattttattcaaatcaaaactctctagcatagcgctgtatatcccaacatgccaatttcaccttctttatttcattttccattcaactgtatgccaaggctctactttgagctcatctgcttgttagatcagcttaacactgaatttgaacatgccttacctcacaattctacttcttcaagttcttcacctattttaaaagccagtgaagaagcacttacagaggtagaataagaatctccagaactccactccttcataaaaggcacaggaacactcaaaaagttgtcaaaataaactttagcacttaaccaaaggtttgcaataatccatcaaggatttattcaagaaaatcatcagaatttttgtgaaaacagttaacattgtgtatttaaatttgctctaatcccatttccatctccccagctccacaacagtctcacaatcactcttaaaaccaacatatactagagggcgttaaatgggtttggagctctacaaactgtcttgcactcacagagaattcatatttgatgtatgcagcagctccctggaaaagctccatttataggacatgtctttatttgacctgatacagaactcactcagtgggaaaggctctgttcttaagatgttagtcaaaatcaatcctgacccatagaatgtacatcaagaatgaaccctaatgcaaactatgaactgagggtgatgatgatgtgtcaatgtaggttcatcaattgtaacaaatgtagcactctggtggggatgttgataatgggggaagctacacatatgtatgggggcaagggagatatgggaaatctctgtactttcctcttaattttgctatgaacctaaaactgctctaaaaaattagtctttattataaacaaaactatgtatttttctacaatcaaatttcttcacagctatatgttcttagctcctttcatgcttttatgtgtttgtataccttttgtgttccagtggttgggaatagttttgtgaaaataaaaaatatttccataaagaaaaaaagctagaaaagttgttgctattagacctactctataagaaatatgaaatttttattttaatttaaattttgtgtaggtacacagtaggtgtatgtatttatagggtacatgggatgttttgatacaggcatgcaatatgaaataagcacattatgaagaacggggtatccaatccctcaagcatttacccattgagtttcaaacactccaatcacactctttatttttaaatgtagagttaagttataatttattatagtcaccctgttgtgctatcaaataggtcttactcattttttctaagtacttttgtacccattaaccctccccaccttaaccacaaaccccacactaccattcccagcctctggtaaccatcctccaactctctatctccatgagtttgttttgctttttagatcccacaaataaacaaaaacatttgaagtttgtctttctgtgcctggccaatttcacttaacataaagatctccagttccatccatgttgttgcaaatgacttgtctagatctcattatttttatggctggatagtactccattgcgtataagtaccacattttctttatccattcatctgttgatggacgctttggttgcttccaaatcttagctattgtaaacagtgctacaataaacataggagtgcagatatctcttcaacatactgatttccttttctttgggtatatatccagcagtgggatcgctggaccatatggtagttctatttttagttttttgaggaacctccatattatcctccataatggttgtactaatttacattcccactaacagtgtataaggttttcctttttctctacatcctcaccagcacttgttattgcctgtcttctgaattaagccattttaactgggtaagatgatagctcattgcagttttcatttatatttctccaatgatcaatgatgttgaacaccttttcatacgcctgttttccagttgtgtatgtcttcttgtgagaaatgtatattcaaatcttttgctcatcttttggcaaagttattttcctatagagttgttcgcacactctatatattctggttattaatcccttgtcaaatgagtagtttgcaaatattttcttccattctgtgggttgtcctttcactttattgattgtatcctctgctgtgcagaagctttttaacttgatgtaatcccatttttccatttttgctgtggttgtctgtgcttatggtatattgctcaagaaatttttgcccagaccaatgtcctggagaatttccccaaagttttcttatagtagtttcatggtttgagggatttgatttaagtcttaattcatttttatttgatttttgtaattaatgacaaataggggtcttgtttcattattctgcatatagatatccagttttcccagtaccatttattgaagagactgtcttttccccagtgtatgttcttggcacttttgtcaaaaatgagttcactctaggtgtgtttatttgtttctgtgttctctattcttttccattggtctatgtatatatttttatgacagtgtcatactgttttggttattgtagctttgtagtataatttgaagtcaggtaatgtgattcctccagttttgttctttttgcttaggatagctttggctattctggtttttttgtggttccatatacatttttggattatcttttcctatttctgtgaagaatgttattggtattttgatagggatttcattgaatctgtacatttctttgggtagtacaaacattttaataatattgagtcttccaatccatgaacacggaatgtctttccatttttctgtgtcctcttcaatttctgtgtcaatggtttatagttttcatcatagagatcattcacttcttttcttaattcatttgtttttaatcttatgtgtggctattgtaaatgggatatttttatttctttgtcacattgttcactattggcacacagaaatgctactgatttttgtatgttaattttgtatcctgctactttaccaaatttactagttctaatagttttcttgtggagcctttaggtttttctaaaatcatatcacctgcaaacaaggataatttgacttacacctttccaatatggaggccctttatatctttctgttgtctgattgctcttgctaggacttccagtactacgttgaataatagtggtgacagtgggcatccttgtcatgttccagattttagagaaaaggctttcagtttttctccattcaatgtgctactagctatgggtctttcatatatggctttaattatgttgaggtatgttccttctattctcagtttttgagggtattttatcacgaagagatgttgaattttatcaaatgctttttcagcatcaatcgaaatggtcatatggtttttatccttcattctgttgatatgatatatcacattgatttgtgtacgttgaatcatccttgcatcccagggataaatttcacttgatcatgatgaatgatagaaatactaaattattaaagggaggctttctggctgaaaagacagtaaacagtaatgcaaattcacactaaaaaacgtaaaaagtgtgggtaaaggtaaatataagatagtataaatgtacttttatttatactcttttcaccacccttatgccttaaaaaatcaactgcataaagcaataattacaaatctctgttgatgtgcttatatgaagatgtaatttgtacaaaagcaacaatacaaataagggaggaggaaatattggggcaaagtttttttgtatattattgaaacaaactgttgatattaattcaaaatagattattttaagttaaaaaatcaattataacctctagaataccaactaaaaaataactcttaaaaatatgtatgaaaaacataaaggaaattaaaagaataaactagaaaatatctatttaatacaaaggaaggcagtaatggaggtatagagggacaataatgatataagaaatattagaaacaaatagcaagatggcaggcataaatactaccttatcaacaattacattaaatgtaagtagattcaacactccaaacaaagagatgagcagaatggactcttctgtttttgtttgttttaggttttgcttttttgttttcttatagacagggccttgctgtgttgcccaggctggtttcaaattcctggcctcaagggatccttctgcctcactctgcctgccacaaaatgctgagattacagacaagccactgagccaagccagataaattttgttcaaaaaatgatccacatgttgtccataaaagatacacttaatattcaaagacattaataggttgaaagtaaaaatatgaaaaaaagatacatcatgcaaataacaaccaaaagataacttcagtgactatactaatattgaacaaatagactttgagacaaaacttgtcactagagacaaaaaaaaagacattttataaagataaaacagtcagtcaggaagacacaacaagcataaacatatatacacctaaaaatagggcctccaaaacatgaaacaaaaagtaacagaattgaagggagaaatagacaattaaaaaataatagttggagacttcaatatcacattttcaataatgaatagaacaattaggcagaacatcaaccagcaaacagaagacttaaataataccataagccaagtagacctaacagacatctatagactactctaccaaacaacagcagaatgtgcgttcttcttaagtacacgtgaaacatcctgcagaatagaccatgcaatatgagacttgccataaacaagtctcaatacattttaaatgttttatgtcatacaaggtatgttctctgaccataatagaaaaaaattagaaaacaataaaaatgaaaattgagaaattcatgaatatgtggaaatagtcaacatgctccttaattagcaatgtgccaaagaagaattctgaagggatattaaaaataatttcaaatgaatgaagacaaaaacacaacataccaaagcttatggaatgccgcagtgcttagagagaaatttatagctgtaagcctatttttaaaaagacataagtcaattataacctttagtattaagaaactagaaagaaatataaattgaaagcaagcagaaaagaggaaataataagagcaaaaataaatgcaaataaagaatagaaaaacaataaagaaattcaaagaaatgtaagttggttctttgaaaaaaaatacaattgacaaaatttcaggtagactgaacaaaaaaaaagagagagaagactcaaattactaaaatcaggaatgaaagagaagctatcactaccaactttacagaaataaaaaagtttataaggaatactatgaataactccatgccaacaaaacagataggctagctgaaataaacaaaatcctaccaaaactgacttaagaaaaaataaaaatatctgcgtagacctataacaagtaagagattgaatttgtaatttcaaaactttccatatattacggccaggctcagatggcttcaaaggtgaattaaaccaaacatttaaagaagacaataacaatccctcacaaatgcttctttaaaaaaaacaaacaaacaaaaaacacaaaaaaggaaacactttcaaattcattttaggaatcttgtattacactaatatcaaaaccatataaacacatcacaagaaaagtagacatcaacatcccttataaatgtagacacaacaaccttccacaaaatgctggcaaactaaatgcaacaacatacaaaataattatatatcatgaccaagtgcctcaggaatacttggctggttcaatatatgaaaaatcaaccaatatcatacactatattaatagaataaaggacaaaatccacaaaatcatctcaacagacacagagagtgcatttgacaaaatgtaacatgcttctggtcgggcatggtggctcacatctataatcccagcactttgggaggtgagtgaatcacctgaggtcaggagctcgagaccagcctggccaacatggtgaaaccccatctctactaaaaatacaaaaattatctgggtgtggtggcagacacctgtaatcacagctacttgggaggctgaggcagaagaaccacttgaacctgcggagcggaggttgcagtgagccgagatcatgccactgcactccagcctggcaacagagcgagactccgtctaaaaaaaaaaaagagtaacatgcttccatgataaaagcactcaacaaactagaaagaatgagaattctctaaatctgataaaggcgtctatgaaaaacctacagctaagattctatttaatggtgaaaaactgaatatttccccctaagatcagaaacaagaaatggatgtcactcactatttccattcaacattgtactgaaggttctagtcagggcaatagataggaaaaacaaacagcatccagattggaaagaaagaagtaaaactatcttaatttgtagatgacatgaacttacatatgtagaacaatcctaaagaagccacaaactttatttgaaataatggacaagttcagcaagtttgcagatacaaggacaatactaaaaaaaccaattgtatttctatatggtagtaatgggaaatgcaaaattaaatttaaataaaatttcatttacaatagaataaaataaattacttagacatgaacttcacaaaaaaaatctaagatttgtacactaaaaatttaaaaacatagttgaaataaattaaagaaggcataaataagtggtaagacattgcatggtcatgggttagaagacacaatattttttaaatggcaataatctccaccaaattgatcaacaggttcatcaaaatccctataaaaaaaatccgtggtgctttttttcacagaaattgaaaagctggttctaacatttatttatatggaaacagaaggaactcagaatagccaaaaaattttgaaaactttgaacaaagtgggaggagtcactcttcccaatttcaaagactactaaaaagctacaataataaagacagtgtggtacagcataagaatagtcatatagatcaatagaaaaaatagttttttcaacaaatggtgctgggataactggatatctatccacatgcaaaagaatgaagttgaatacctacctcatataatgtacaaaaatgaactcaaaatgaatcaaacgcctaaacgaaagggtaaactctacaaaactcttggggaagaagtatagataaatcttcatgaccttggatagggtaatggtttcttagatataacaccaaaataacaagtaacaaaagaaataaataaactgaattttgtcaaaatttaaaacttttatgcttcaaaggacatcaagaaagtaaaaagacattcacagactaggagaacgtatttaaaaatcatatatttgatatgggacttgtattcagaccatatgaagaactcataattaacaataaaaagacaaattatccaatttaaaagtgggcaaaggaataagtatttctctaaagaagatctacaaatggccaataagcacataaaaatactaaacatcattagtcattagagaaatgcaaatcaaaaccacaataagaaaccacttctcaccactaaggtgattaaaataaaaaagactaacaatagcaaaagttggcaaggatatggaaaaattggaaccttcatacattgctggtggtattgtaaaatagtgtaaccactttggaaaatagttcggcagttccttaaactgttaaatatagagttaccatatgactccaatattctacctctagttatatataacaaagaaatttgaaaacaaatgttcatacaaaaacttgcacataaatgctcatagcagcattgctcaaaatagtcaaaaagggtgaacaacccaaatgcctaccaattgatgaatggagaaacacagaattgaatattattttgtaataaaaaggaatgaagtactgatatattttactatatggataaattttgaaaacattatgctgtgatacattctacaacataaataaactttaaaaacattatgctaagtgagaaaaaaacagatagaaaaggccacatattacacgatttcatttatatggcatatgcagaatagacaaattgataaaggtgtatgccaacttagtggtagaaaaaaggaaggccaatatgggacaccgaagctaataagacatgagtaggattaaattttcagtctagtaacacatgaggaatgcctgtggcaaagcaagaccaagataaatgacataagaagacaaataaaattgcaacttcactgggaatgagatatggtagttgaatttgaagattctgccactatgtttcacaaaatatatagagagaaacatatataaatacatagacatatgaacccctgtgaaattgtgtgttgtaagaaaaagaaaaataataaaattctttaaaaaaaaactaccttgtgtttggattgtgccaaccaccacatggtaatatctgaataagtctgggtaatatgtgaatgagcatacagtttgttggcatgaacaaatattgaaatcaataagttataccagttatgaagtatttcaattctcactcctgattctgatatcagtgacagtcaatgtagtaggtttttaaattccaatctgccttaggtgttcagatccattttctggagcaggtttgaagtctgacagtccctacccggactctggttcctatgctttattatgtgcagcaagtcactgaaactgcgagatttcttcatgtataaaatcagaatgataatatgtttctcaaaagtttgtttcaagaacgaaacaaaatgtcctgtgtaaaagatctaataccacttccagaacacagtatgagctttcttttaggacagcttcattgccactgcctatgagctgaactaagcatttcatgacaagagaccctggaatataaggagtctacaaacacctacattatttagtcattcaggatgacagaacaagtgacaagagcaattgttcccaaccttagctgtgcatgtggaacatctgtgaagctttttaaatgcatataggtctgagactcacctcccaacaaccctccagcacctggtcccatgctgataacctttcttctgtataaagtcttacatagttttcacaaatactatttataaaaccctcagtgttttcttcttctggctaaaagtgcctgctgttttaactcttccactgcaaaacactgtctaattattggattattcttaaaactcatctgtgagccctggctacattatctgactgtctctttggttatgtggcttcatttatcattggtcgaacttactggaagtgaaaaggaaggttaccttaattgatagagctattgatataattctaagatatgattaattgcacaggacattttaattatatgatccgttcttcatgagacaacaaaaaccaaggcattctagacacccatgagggagctctatttctatgtctgaaaacgaaattagacttcttgcttttatttttcccttcccaaatgacatttatataacacacttaagttctgatggagtatggcaaatgtatttaactttcgaccaatatttatagaatcctttatttcataagggataaaagcaagcccagaatttttcctgtcttttaactcttgaaattgtcccctaagaatataaacaaactaaaaggcgaagcaaaacatagacaatatccccttgaatgattcataataaccacatttaagcctctctgggttttgtttgtttgtttaggtcacagcactattgggaggcaaaggggttattggctattgaagtgtttgctgttgatgaagaactaaatttaaggcatgtattcttttcttgactagagtttgattagcttcgtcatacttttgctttagggaaagaatggtatagaagaaataaaagaactaacggaagcccttccatttcaatcactgtaaagaatttatcatcataagatcaacaaagcaccatttccatgtaccttttgcaatatatatatacacacacatatatatatattttacacatatataaattatatatatatatatataaaattattgcatcggggcttctttgttgcttttctttttcctcaatgacattgagactttacctatatccaataacatttgccttcctttctattttcttgcatgttttaatctcatagtgtcacatgggttcactttacctaaagatggaatattctcctccgttggagaagaaccccaaattaggccagaagaatactgaaaaatgtatggactttgtagtcagaacctgggaagaaaaatcctaactctgccagatgaaatggtccaagtcaagttgaatggaaggattaaaatagaagattaataaaatgcagctgtagacagctggcacatagtgacagtcaataagtgacaatttataattcattcatttattctacctgcctggagaagtgaaatctaagagaaatagacaatagaaataaaatacaaatctatcaaataaaacaaagtgaattaatcagtaagcattcttgaacactaatatatataaggaagggctaacttaagaaagacatgcttttcaagagtttataaactggcttaccattttaagacattttccataaaaattatgccacatcatataaattagtaaaactctattccaatcttaacctacttgtactctatgttctagtcactctagaagtcctaatcacatgccaaaccatgccacaagtttccagggacacatttcacatatctgctgctctcagtagagggatcaataattcttccctactgggctgcagagcgaagaaaatgggatctctgataagtacaggcaatcaatccatgctggtgtccactgcagaatttaggaactccatgaaatcaggagtaagggaaggctagaccaccctctgaaaactgaacgttaagggttctactttatgcatgataaatacatagagcaaagtgaaagaaatcagatggagtctggtcagaacgaatggaagggaaaaatagttaactataacaggattgtgagatggtctagttctagtaaggggaaaggagctcagtaaggttggagaagtaggcatcaattagttccagggtacatgcagtgtagcaggttgggataaactccaacaacaaggagaactgattattttagcaagaggaaacaagacatctctgacaggggcagggggaggatgaataaacaagaggatgagtgtctggattaggctgagatccctacagcagtgggacactgggtggactctggggggaaatctgtggtaaaattcccagtaagtgtggccttggggagaaaaagagagggaaattccaagaacaaagtacttgggttttggagtcagaccagggtttgcatctgagtttgcccctttactttctagatcttagacttgaagcaagtcacctaaccagtaaataatttcttaatcacacaactttgtacaataatgcctacatcaaaggactcttctgaggattaggagataacatgtgggaaatgcctggtattgttcagatatactttgtttttattttcttttattttggtataaaatataagttcttactataagaagtttatctttctgatcaggagagatgatccaacccctaattcataaaaaagaaacaggaggaatataggaacttaaacacccaggggtgttatgaggcaccagccctagaaagaagttggaggctgaaattttagccccaactctaaagcaaagcaataatattgtctgggagctgaatccacccaaagtgaggtgcccttttctaatcctttcaaaggctctatatgggataatgggtgatcctgaaagtgtctccctaggaggtagaatacaaactactcaactgagtggcaaaacctttcatgttcaacatatgtaacatttcagtcttaaatgttttctgaattgaaccgagcattattcaggaagtgaaacactcccatgtcttgggaatacattgttcaaatagtctaaaacatcaggtatgttttattttctttttcacattataactccctgaattatattccaaaggtagaagagtttatgctagatttttacagaggatgtcttcatgcaaaattaagggattgcagactacaaaactgttggcagaagattcgggttgtttttgaggaataaatgtatgcccttccctgatgctgtcttatatggcaataaactaaataaaaattgtagttgattgacagtaattataaacctgcaacagcaataaaatttgtgttaattatcaaaaatatcagaccagttgtgctgcccattacagaacaatattgaattttctgttaaggaaattggtccacctttccctaatttttgttttgccttcctaaaggtaagcctgaaatatataatagcatatcatcagaattcattccactgactccactaaatgacttccagaaattttgctataggttgctaactaaagacagcagcatctccttgcatggaatatcagattcaaatttctttgcctgattctgggtggctctctaccaaatggccctttcccttttcctgttaactgttttgctttctaatccccaacagtttagcacattaggtgctcaataagtatctgtggaaagaaagaaggaagaaatagagagatgggcaggactatgaatgtttttttaaagacaatagaaatccccccaccaccattctacaaaataccttttgcatctgacaaatataggtaatgttattattaataatatattatttcagatattaacttctttaaaaatgtaaatcttcttggagaatcaacatttagtaatgtaatttactcatccatgccacactaagaagaaattttgaagccagaaaaagagagggtagtagaaatttgaaaaagaaaaacaataagaaaaggagaactctggaaaagatagtgctctttgcctttgtttttgctaaatatattcattcctttgatgaaccattaaaaaattattagctcctatatatcttagggatacagacattcagtcattagaagttgcgaagatcatcattccacaaatattactgggttcctgctatatgccaggtgcataagtgtagggaacaagattgcctacccagaattatgaaaccaaaatagataattacaactatgattaatgcaataatggagaactgccatggggacataacatataacaaaaaggcatactagtggggaactggaggtgggggtgactagcaatttacctatatcttttttccaaaatgatcttcaaactagaaatataagatcagttaacataaagaagaaaccgaaactctagataggtcatacaatagttagagagcatcaacccatgtgaacagtcaagtctccagtccaggtatactatacctcagggcactaaaggaacatacatattgattactgtaaataacttctgtaattctttagaaatcacagtaagcgtgatggcagaagactggagatgggtaaatctttaatccaattttcaaaatagaagttgaggcaaaagactaggaagtttaagatcagtccctgccaaaattcttagagttaagcagatggtttttgaagtcttagtaaataaactggtattcatgaaaaccaacagaatttgctaaattaagttatgctaagatgaatttattttattcttcttcattctctttcttccttcttctctccctcactcttttctttctatctttcataatttctgttattcaacaagtgcttgtccaacactttcatgaatgctttacatggaatgcttgacaagcaagctgttaaccaaaccagtggtttgcttagtaatagcaattagatattgcttagtaatagcaattagataaaaactaatttgcctaaggaacatgcattctatagtcaatgcatgaactaacctagttcagtgaatgtaagataaagaagatcctgttagcccaacattttgtaaactcccgccattccacagaccctggtcacagtggaaaattccactaaggcttgggctgtgaaaaacatcctgctggataagtcccaggcctaactgcctaactgcagaaaattcctcccttttcagcagctaacctcactgtccaccccatttcacaacaagcccagacccctcccgctcggacctataattactccagcatgcaaatggcagcgggctccagcgctagctggtatccccttctgcaggtcttttgtccaataaacctgtgttgttgttgagccagcaactctctctctcttttaccctcgccttcccttcaaagcctaacagatccctagtggtttcatggtgctctctatctatcttgagtgctctctatcttgagtttccagtgtaacatttctctcagtgtcttgataaagtcctaagaatcacagacatgttgtttacataaagcatagaaacataactagcacttgtgtcaaaatcataagggctgcttgctcaaaattcaaattcctacctatcccacagatatatttagtcaaaatttccaatcaagcgcggtggcttaggcctgtaatcccaacactctgggaggctgaggcaggcagatcaattgaggtcaggagttcaagaccagcttggccaacatggtgaaactccgtctctactaaaaatatacaagttagctgggcatggtggctggcacctgtaatcccaggtacttgggagactgaggcaggagaatcgcttgaacccgggaggtggaggttgcagttagccatgtttgggccactgcactccagcctgggtgacagagtgaaactctatctcaaaaaaaaaaaaaaattgaagtttgaagttatgtagaaatttttatttttaacaatcaccacagttatttattttgcacacttaggtctaagaaccctcactgaaatgtttaagacacattacctacccacaatcactaactaaccccatgtgtatagggggcctaattaaaatacaacaacaactataaagcttctgtagataaatgctaaaagatctcaaagatttgagggatcttccttatcctgcaatcccttttggtcttgctgcttatccttgattatcttcctctgctgcattcttttctttgatcattaatttaagtgttatgctctaatttgtttttaatttggatgacccctctgtcctaaggatgtgttttggtaaaaccctggcatcctactaccagctctacttagactccataattaaccctacacaatccctgacctctatgtcccagcctcctggaagcacctgacaacaaatatggaatcaagaaattgtgatagcactttcagtagtgtaaacaaaacacctaaaacacagagtctctgatgaattatctaattttatttctcaccgtttctactcccacttctatcatcaattccagccacataaaataatttttagctcctcaaatacatcatcatactcagcaatatcatatcatacaataaatcttttctgaaaactgccccaagtcccttccccacacctccatctaatttctagctatgtctctttagggctttctaactgtctccatcaaagcacttttcacattgaactatggaactatgatctccactaaaaggtaagccgctttatggcaggaaccataacctaacagtgtcagattcttaggatatgtttactatgagttggaaggaaaggagaggagaggggaggggaggggaggggaggggaggggaggggaggggagaggaagaatactctggagcacacaggtgggaatatctgggaggagcagaaaagacttcagaaaagagatgacatttgagctatgtcttagagtggcagagaaactaaagtgagaaggcagacatttctcttcatcacaatggccaataatcttttttgagacacaaaaatctctggcatgaattagtgtaacagttccctactaggtgtcactatatccaatatttactgtctcctagccattttccacagttcagcctagtggtctcactaaaatgaaaatctgagtatgtcctgactcttaatgtaggttgcaagattgtttataatctgactcctgcttgcctctccagatttaagggccacctccccccaccacacacacacatctgaaacactgttccaatcatatatgtacagttcctagcatgtgccaagcttgtccttttacctctgggcctatgtaccaagaacactgttccttttatttctgcctggatgatccctagtgctcctttaggactcagtttctacatcagttcctgtaggactcagttttttttatctttccttgtgaatgactaggtcaaatcacctatcacacattcttgcagaatcctacactgatcacaattataatgaaatgattgtgaaatacttgtcttccaaaaaagattacgagttccaagaaaacaggcagttggtctttttcttattgtctcctcaatgtctatcatggtgtctggcacaaagaaaatgttcaataaatatttgttggcttaatgaccaaactgaagtaaatgaatagacaaatgtttttatttccaattagattttaagcaaaatgagggcaagtttcatgtctgtcttgttcatcattgtattcccactgtctagcacagtgtctgacacataaaactctcactaaatagttgtaaaataatgaataaatgacagatcaaatgaacatggcatcctgccacattgcattactaaatgctctatgataaacacattttatctttctaaagttatattatggctgggaattaaattataaaacaatgattatcaaaaatcatagatataaacaataacatggctgtccctcagtatccatgggggattgattccaagacaccactgccccagtcccacgaataccaaaattcacaaatgtgcaagtccctatagaaaatggtgttgtatttacatataacctatgaacatgctcacgtatactttaaatcatctctagattatctataataactaatacaatgtaaatgccatgtaactagttgttatactatattgtttagggaataattatgagaaaaaagtctgtacatgttcaggacagacacaaccatctatttttttccaaatgttttccacccatggttgatgaatccatgaatgcagaacccacggacacagagagctgactttatatcacaaaaaagcttcaacagctgtaaacatttgtcatcatttaaagttataaaaattaggctctatatccaataaaacattcatgcatatatttttcacaatagttggagcttcaatgtaaaataaagcctctgtaggccacataaatttttactagctaaacgaagtatactaggtataaaaataatcaacaaaaatttagcaaggctttctagaatttagaagttcttttaaggaaaattaggatagccctcatcattaaacccggttggggtttgttaatattttccttaaatgaaagttgatattattcaatgcagtaaccaaatatctgaacatctcatttaaggtccttagatgagaggatttggaagactggaatcatcattattaatactgttgctatggatgcttttttcctaagctctttgactttatttgaagtagaccaagaatattagatcaaggggccagatggtaaatatcttaggctttgctggccatatgctgtctgtttctactactcaactctactgattcagcatgaaagcagtcatagacaatatataacagaattaatgtggctgtattccaataaaactttacttacacaaacaagcagcagcagtttgttctgcaggccagtttgcagattactcttaagtaaacaattgctgttttaactgcctagcattcattgacaattcatttgctaaaggcaccttgatttttatttgcgggatcatctctcctcctctccaaacccttgtagttgcagtggaattgacccgaggcctttagggccagaattagtcaggtggccgaagactgtccaattagaatgtctttacgttagcttcagtgactggttcaaggttgaacaaatgaaccacgatggtctactgtgtctcaatcctgggactttttggacaattgagaaacattttttatggtggggtcacaatgtaagtcttcagctgctagtagaaaccatgtagagaaaaactgcctgtgggtgatgccaacacagaagaaagcaaagcccagatatgaagagaaagagagagaccaaatccagaagggctcatctaagcaatacaacctagctgtgcctaaagacacatctcagcctacagccaaaagagatccaaattcaactgcatggataacatcaagaaaactcttaaagaagaaaagtaacccaattgagaagtctatgagatactgtggaaggtacagttatatatctctgagccagtgcagaagagtgagaggaataaggaaggatagatagccatggaatggatatgagtcagggattttttaaaccatgaaatgctgaaacagtctttctctcccacgttagtatctaaagagtctgtaattacagaacctacaaattgctccacaaacttgggggtaaaggtggaaggtggaaaggagagtcattagctaaatcatcctgaataagaagataatatacaaaatctcccaaagcagtatttccctgtaatctactaaaggcttaaaattaagggatagggtccccactcaaacagagcttgatgttttctactgcactaaccataatccatgaagaaaagaagctcagaactttaaagagggaagcatttcaggtcactttggtccaatattggaattatttgtttttgttaacttttattttaggttcaaggttacatgtgcagttttgttatatagataatttgtgtgtcacaggggtttggagtacaaattattttgtcatccaggtagtgaacttaatatccaattggtagtttttcagttctcctcctcctcctacactccatcctcaagtatgacccagtatctgttgttcccttctttgtgtccacgtgtcctcaatgtttagcagccacatataagtaagaatatgtggtaattggttttctgttcctgtgttagtttgcttaggagaatggcctccagctccatctatgttgctgcaaaagacatgatctcaccacattttctttatccagtctaccattgataggcatttatattggttccatgtctttgctattgtgagtagtgctgcagtgaacatacacacgcataggtctttatggtagaacaatttatattcctttggatatatacccaataatggaattactgcgtgaaatggtagctccattttaagttctgggagaaattgcccaactaccgtccacaatggttgaactaatttacattcccacaagcagtatacaagcattctctgttctctgtttgctgaagttgtttatcagttctaggagcttttgggtggagactatatggttttctagatatggaatcacacaccttcaaacagaaatagttttactttttctctttttatttggatgccttttatttatttctcttgcctgattccttggctaggacttccagtacgatattgaatacaagtggtgagactgggcatccttgtcttgtttcagttctcaagggttatgcttctagcttttgtgcattcagtatgatgttggttgtgggtttgtcatagatgtctgttattattttgaggtatattccttcaatcctacattgttgagggtttttaacatgaaaggaggttgaattttatcaaaagccttttctacatctattgagatgatcatgtggtttttgtttttagttctgtttatatggcaaatcatatttatttgcgtatgttgagccaaccttgtattccaggggtaacatctacttgatcatggtagattagctttttgatgtgctgctgaatttggttttctagtattttgttaaggatttttgcatctatgttcatcaaggatattggcctgaagatttgttttttgttgtatctctgccaggttttggtatcaggatgatgctggactcacagaatgagctggagagaagtctctcctcttgaatttttttgaatattttctgtaggaatggtagcagctcttccttatacagctgatagaatgtgacagtgaatccatctgatccagggcttttcctggttggtaggcttttggttactgattcaatttcagaactcatagaattgttcaggatttcagtttcttcctggttcaatcttgggaagttgcatgtttccaggaatttatccatttcttccaggtgttctcgattgtgtatgcagaggtgttgataatagttcctgagggttttgtgtatttctgtgggggtcagtagtaatgttccctttgtcttttctggttgtgtttatttggatcttctctctttttttctttagtattccggctagtgggtctatcaaacttatttattctttcaaataagaaactcctggattcagtgattttttttgggggggagcatggcttttcatgtctcaatttcattcagttcagctttgattttggttatttcttgtcttctgctaacattggaattagtttgcttttgtttttctagttcctctaggtgtgatgttaggttattaatttgaaatctttctaacgttttgatgtgggcatttagtgctataatctttcctcttaacactgctttagctatgtcccagagattctgatatgttttatttttgttctccttagtatcaaataatttcctgatttatgatttaatttcactgtttacccaaatgtcattgaggagcaggttgtttaatttccatgtaattgtacagttttgagtgatattcttagtattggtttctatttttattgtgctgtggtcagagagtatggttggtaagatttctgttttcttgaatttgttgagaattgttttctggccgattgtgtggttgcttttagaatatgcgccatgtgcagatcagaagaatgtatattacattgttttggagtggagagttctgtagatgtctattaagtccatttagtcaagtgtcaagtttaggtcccaaatatctttgttagttttctgtctcaatggtacaacactgtaagtgagatgttcaactctctcacctcacttttgtaggtgacctgtcccttttctctagctgcctttaacattttttcttttattcaaccttgaagaatctgatcaatgtgtgtcttggggatggttgtcttacatagtatctcacagggtttctctgcatttcctgaatttgaatgtcgacctctctagtgatgttggaaacattttcatgaatgatatcctcaaatatattttccaggtttcttgctttctctccctctctttcagagatgccaatgggtcatagatttggtctcccatatttcttgaaggttttgttcatttttttaattcttttttctttatttttgtttgaattagttaattcagagtaccagtatttgagctctgagagtctttcctcagtgtgatctatttgtgctattaatacttgaaattgtatcataaaacttctgtagtgagtttttcacctctatcagatgattgtgactccttcttaaaatggccatttcctctctttcagctcctgtattattttattgtatttcttagattccttggactaggttttgactttctcctgaatcttgatgatttttgctcctattcatattctgaattctatgtctgtcatttcagccatttcagcctggttaacaaccattgctagagaactagtgtggtcattctgaatacaaagacaatctggcttttcaagttgccagagttcttgcactgattttcttatctaggcaggctgatgttcccttaatctttgaagaagccgtcttttagatgaggttttttgcttttatctctctgatgcccttgaaggtttgtagtataaggtgggttcagtcaacaggctttgtttctggaagactttagggggccaaggctcagctcagcactgctgggctgtgtgctctaactcttatgggcgtttaccatgcccccagctttgttctctgaccccttgcagttaagaacctgctgtggtggaggggccgaggtattcttagactgctagccacaacgctacaatggagagtgtaagcccaagtgcttcatcagagcaatggcagagatctgtgctcactcattcatgccagcagtgcagtggggatgcacacacatgatggggtcagtgggagtggagtggcggtattcgtatgcatgctcacattggtgaccgtagcggtggggcaggggcaaggcattggcagagatggggttgtcagagtccatgtgcacatccacgccagcagcagtgcagcaggatgcccaagcatcaggaggagcaggatagcatagtgtgctcacactggcagcagtggggcagcggggtacacacacgcatgccagcatgggatgggaggcaaggtctactcacacatgcaccagtaaagcaatgtgtgtgtgtcaaggggggaggggaggtagtggtccatgcctgagtaagtgccagcaaagcagcagtggggaggctgtagtgggtgaggttgtaggtgggttggtgtgtgtcaacaagagctggtctgctggagctctccagtagtcatgcacagactgccagtgaaggagctatgatgagatccctgaggaagcaccttggttgggcttgccaggctgcactgcaagtgtgtggccaggctggagccccaggagaggccaccagacagaggggcactcagattggactggacccatcacatgggaaagaccaccctgctctatccaggtctaacagttgcccaaaagctaaagcctcctggaggagcatggcaagccttggtgtatgggtatccctggccatgctccacttcagccattcccatgccaaaccttctgctcctacaacctatctaggcagctctccctgccagctcaagtgtctgtggggattgtggggtgtcctgctgctaggattctcaaagtccatggcaagagctggtcactccttccctgttcaactcaccccttccttaggagttgctggggaccagtaatgaatcttggtgctccgaaaccctgcgcaccgttcccagcttcctcccgcttcagcccagcaactgaatcctctctccatccactctcaatgccttctctctgaagatctgcttagagtgtaccagtcttcccaatgttcttgtttctcagtgaaagatgttcctcctagttgcatctagttggccattttggctcagatcagaaattgccattttaaaaatcagatcttcattgagacttctatcaagtcaggctcaaaggcttagatttttaaatcagtgttgattttgcacaatattttagaagcttctttctgcacattaaatcaatgtttatgtcaaatacttgttctagacctccccacatctctcaatcagtgatgaccattagttttcacataaattcaagtatttatgtacttgacaaattaacaaataatttgttaagatgatcacatagaattaatattactcgttccagttgcatggtggggaaaagaaagcagaatcaatattttctgaaaacctattttgttgcaggcattatattaacttgatgatttatagctatatccttgtataaccctcacataattcaatgaggtaggttttattttccctgttctcagaaaaagaaacaggttcagcaaaattaggtaacctgtacaaataacatagttaataacaaaagtcagatatttctgcaatactctagtgcctaacatccctggaaacaaagagaaaaatctctgtggatggtgaagataagtattgctgcttaagttttgatataaaaatcatatagaggatgcttacatgcaacagataatatccaaaaaatgcataagaaaaaaatttcctcctgagaggatttaaatctaatctttgaattaaaagtaagacctaaaataattgtagaagacaacatacaatgaggcctcggtcaagtgtttcagtacttcagaaaatgaagaattttacgtgatatagaaatatttacttgaagcaaacattttataaaacagtatgaagcattcagtaatacagctgaggtacacctggggtactaatttggttatttctaggctagaaagtggtttcatgtttaattcactgctttctgaagaggaattgatctctaattgactgtaaagttatggtgagttctagttgcttattttctttgttcctgtaatattaatttcttataatctccaagcaaaatataacattatctaatgttcacttgagtgtctgaataccacacgttacctcaatagatatgttgttttttttcacatagcccaacacatttttcttcaaagtacaatacagttttctatgattttttttaagaaaaaaaaaatccaaattcagttgcagatcctctaaaaccttatccgtatccatttctttctcttgttccctagctgtgatctttaaaataaagttgatatgcaggcataccttggagattgtgattttgatccatatcaatgaagctaatatcacaataaaataagtcacacaacttttttcatttcacccgggcatataaacattatacttacactatactatattctacttagtgtgcaatagcattatatctataaaagcaatgtacataccttaatttaaaaacattctattgctaacatgctaacaatcatctgagccttcaattagttataatctttttgctggtggagggtcttgcctcagtattgatggctgctgactattctgggtggtggttgctgaagattggggttgcaatggcaatttctttcttttttcttttttttttttttttttttttttgagacggagtctcacactctccttcaggctgtagtacagtggtgccatctcaactcactgcaagctccgcctcctgggttcacgccattctcctgcctcagcctcctgagtagctgggactacaggcgcctgccaccatgcccagctaattttttgtatttttagtagagacgggttttcaccgtgttagccaggatggtctcaatctcctgaccttgtgatccacccgcctcggcctcccaaagtgctaggattacaggtgtaagccagtgcgcccggccggcaatttcttaaaataagacaacaatgaactttgccacattaattgaatctttctttcatgaacaattcttctatagcatgtgatgctgtttgacagcattttacccagagcagaacttctttcaaaatcggagtcaatcctctcaaaccctgccactactttatcaactaagtttctgtaatattttaaatcctttgttgtcatttcaacaacattcacaggattgctgagggattgttcacaggattgatgaggcctcattgtatgttgtcttttcttctacaattattttagttcttacttttaattcaaagattagatttaaatcctctcgggaggaaatttttttcttatgcattttttggatattatctgttgcatgtaagcatcctctatatgatttttatatcaaaacttaagcagcaacgttcctcaggagttgattttgtctcaagaaaccacttttttttttgctcatccacgagaaacaattcctcatctgttcaagttttatcatgatattgcagccaatcagtcccatctacaggctccatttctaattcactcactatttctaccacatcttcagttccttcttccactgaagtcttgaacctctcaatgtcatccatgagggttggaattaacttggtctaaactcctgttaatgttaatgttgatatgttgacctcctcccatgaatcacaaatgttcttaatagcaagtagaatggtaaatcctttctagaaggttttcaatttacctttcccagatccatcaaaggaatcattatctatggcagctatagtcttacattatatatttcataaaaaagacttaacagtctaagttaatccttgatccacgggcttgcagaatagatgctgtgttcgcacacataaaaacaacactaatatccttgtacatttccatcagcaatcttgggtgactaagtgcattgtcaatgagtagtaataccttgaaataaatcttttgagcagtagttcttaacagtgagcttaaaatactcagtaaactatgccataaactgatgtgctttcatccacccaggcttgattgttccatttttagagtacaagcaaaatcaattttgcatagttcttaagggccctatgattttcagaatggtctatgagcattggcttcaacttagaatcaccagctgcattcacccctgacaaaagagtcagcctgtcctttgtagatttgaagccaggcattaacttcacacctctctagctatgaaagtcctacatggcatctttttccaatacaagactgtttaatctacattgaaaatctgttgttaatgtggccacgttactaatctgctctcatgctgctacaaagaactgcctgaggctgagtaatttataaaggaaagaggtttaattgacttacagttccacatggctggagagacctcaggaaacttacaatcatggtggaaggggaagcaaatatgtccttcttcacatggtggcaggagagtgaagtgctgagcaaagtgggaaaagcctcttataaaaccatcagatcttgtgaaaactcactcactatcatgagaagagtagcatggaggtaactgctctcatgattcaattacttcccatgaggtccctccctcaatacgtgggtattacaatttggattacaattcaagatgagatttgggtggggacacagagccagaccatatcagccacctttatcaattaccttagctagatcttctcaataactttctgcagcttctccatcaatacttgctgcttctccttacagttttgtactatggagacagtttttttcttttaacctcatgaaccaacctgctagtttcaaacttttcttccgaagcttcttcacctttctcagccttcataaaattgaagagagttaagccttgttctttattagcttttggcttaagagaatattgtggctgatttggtcttctaaccaggagaccaaaactttattcacatcagcagtaaggttttttgccttgcttatcttttgtgtgttcactgtaatagcacttttaattttcttcaagaacttttcctttgcgtttacaatttggataactgtttggcataagatgcctagctttggcctattttggctttcaatatgccttcctcactaagctgaattatttctagctttgattttaaagtgggagatgtggaactcttcctctcacttgaacacttaagagcccattgcagggctattaattggcttaatttctatattgttgtgtctcagggagtagggaggcctgaggagaggaagagaaataggggaatagctagtcggtggagcagtcagaaaacacacaacacttactaagttaactatcctataatgggcacagttgtgtcaccccaaaacaattacaatagtagtatctaagctcattgatcacagataaccataacagatataataaaatgaaaaagtttgaaataggatgaaaattaacaaaatggaacacagagcaaatgctgttggaaatatgtcaccaatagatttaatcaatgcagcattgccacaaaccttcaatttgtaaaaagactgtcattacctatgaagtgcaataaggtaaataaagtgcaataaaatgaggtatgcctggatatctttcccacccactttaaaacatttttactgtgtattttctcatagacaatatattgtactattgcatgcactttaaaattacattaatagccaaataatgtacttaccctctgccacttttgtcagtcaagatcatgtttgcaagatttctagatatagttaatgatatgttttctacattttatagttttctagatatggatatttcatcacttattcactcggttctctagagatgaaaatttggattgtacttgttttgttttggtcttgcaccattacaaacaggattgcaatcaaaacttctatgtacattgaatgaaaacttctctagagttcatacctacatgtgaaattgttgagctcacagaaatttgccaaaaggttcatacaaaaatatttactacagcactgtttacaaagctaaaaactggatacactgaaattataccaaccaatagcagaacaggtatataatttttaatatatttatgcaatgcaattaaagagaattgtatagacgcatacgtgctgatacagaaagacgcccaaaattgattgctcagtgaaaaaaaaattaagttataatactctatataaaattatcccattttttataaaaataaatgataaaattaataatatatgtacatatttagagaaaaaatagagaccaatttaagaaattcatgttaataactatgtatgatatataagataaacttgtattttctctattttaaatttcaatagtaccagatacacattacttcaatctacacttataacctgaatgaatacataatttcttcttatcctaataatgacacattttgcttttctgaccactaacatcccttacaagactaactttttccattaattcctaaccaatttctgtttttagcacaaacaataatagtctgtacttacttacactactgcaatctccttgttgctatatcttgaaatttttcaaacttgaaattaattacattcattaccactgcttttaccaggaacccttctgactctataatattctctctcagacctgaataaatatcatattattataacaaccttctaggtcaattatgggatttcaagttaaaaatatataactgtaaaatttaaagaaggtgtgcagtgagaaggaagagttgttcattctggaaaaatatatttggatacccaatcaagtttccttagaatgtcatttacttgaaaaaattaaccattatccataaatgatactcttattcttaaagaattacaaaaattaatccctgtattatttctaaattgatcagaattatgggttctaattcagtctaataaaggtcacaaataattataaatatttagtaagctgttattcattgggcactatgtgcaagaaatagaggacatagtggtaaataatatagatgagctccaagtctaaaatggcatcaactaaattaggtggggatgaggctcttcattgcaatccattaagtgcagctcctggggcacaaatccttccatatatggacccatgaaatgaaagagacaagccatccttcttcaaaccccccaacctataatggtaggataggcacagcacaacagctatagacatcacagttctaatgggggaaaatgaaaagtaaaaaggagtcacaggggtcactgtttcaaaggagttctgaaatccagggagtaaatgggagtttcttgattaggtttcaagggcagagaataatcctccttggctctcagctccattctctgaaggctccatccttcttggttctgccctctgagtcatccttcctttttcatgaaaggtaacacatgtttgtagcttagtggttttatcagactgcttcctgctggtagaattttggggacttaaccatctcctttccttttgtagtattgtctctgacctttttagatgaagctggcagtgtttctgcttcaataaatttctcaagaactttgtgggtcttccatggatttcacagggattcacaccataaaagaaaagccacatccacagatgtttttaagattgtcccttttctatatcttggcttcctgctgagagggctagaggacaatgcccttcagcctcctagaggccctcaggtttgtgtgaaaaaatcagtgaggcacacccttaatctcttgaaaagagcctttgtactgaatacgctgacattttgatctttctgatatttttagcaaaagtcacacactctcaatgccatacttttgagtatggctatttctcaatgccatacttttggcagccatttctgaattttagcatcttttgccatctggagaggctgcgaattttcagtcacgtaatcctaatccattttctttaacatgtcttccttcaacttatctctcttttgcattctattacaagcagtaagagaaaaccagtagcaacttcaatactttgcttgaaatctccttagcactacatacaagcaagttcattgcccacaagttcttctttccataagatggcagaatgcacaattttgctaatagttctgcaagtatataaaaaggatccctctccttctaatttccaataacatgctcctcacttctgagcctaacagcagtgctctcaaagttcagatttctactaagggtctgttcatggcaactcaggctgctatggtttgaatgtgtcccctaaatttcatgtgttagaaacttaatccttaaattcatgtgttgattagaggtggggtcttgggggctaattagggttagataatgtcatcagggtacagtccccatgatggaactaacggctttataagaagaggaagagagagagctctgagctgacatgcacactcttgctctcttgccttgtgatgccttctgtcatggaatgagcctcactagatgacggcaccatgctcttggacttcccagcctccataaccatgaactaaataaacatctattgcttataattttctctgtctgtggtattctgttacagcaacagaaaatggactaagacataggcttcctctatcatgttctgcaaacatttcctagcctttgtctactgtctaatcccaaagctgctcccatattttaggtatgcctcttggtaccaaaatatgcataacatcttggtggcttaaaacaacactcagtcagtttctcctgcttttcatcagtcaggagtctgggcctggctcagtcttatgctcaaagcctccaaagctgcactgaaggtattggctggactatggttctatgattctgatctagagcttggggttctctctcaggtttactcaggtcattggaagaattcagttccttgcagctgtaggactcaggccgtcagtttatataagctgcctctctccataggcagtttacaaaatgattctttgctttcttctagcccagcaggagaccatctctctttaaagggcttacctaattaggtcaagcccatccagtaaaatctaccctcaataaccttaaatccaactgactgggggccttagttacatgcaaaaagccttttatatgcttatatccctctgagtcaggaaaaaactaccagagttctcactcccccatcaagagccccccgacacacacacatacaaacacatacctaattatagataatatttttttctaaaatacatccatatggttgtgtgattttctccagtggtgctgaacaaccttggttcagaagtaaagaatcttgacactagaactaatccaagaaaagtgggtaagaaaaggtccctaaaaggttctcaacatgaagcagcaggagaaattcagaagaggaagagagatctccatcagccacttggagtagataaaggtatcaggaccaagatatgctaaagggggcagataatcatcctgtcacagaacagaaatctcaattagaaggctttcctaaaaaaatttcaaaagaccataactgctcttaccacactttacgtaaccaagaagtggtaatcagataaatctcctaggaaagagcttatcaactcaattgagactacatttatatggagagggacagaggcagccaggcacatgagtcagctcccctgcccccagcaccaccttccactgtgaggttttcagacttgacaacaaggacaatttattatttcacattgaccaaaatccagtggttaaatgagattacagtcctgttgtattagtttcttattgctgctgtaacaaattttcataatttattggcttcaaacactcacaatattttactattctctaagtcagaactatgaaaatcaaggtggactaaaagtgtcagcagggatgcattccttctaggggctctaggagaatctgttttcttgccttttccagcttctagaggagacttgcattccttgggctcatggcctcttcctctaccttcaaaagccagcagcatatcattttcaaatctctctcctactctgagatttccaccttcatcttattaggacacttgtgattatactcagcctaccttgattacccaagataatctttccatcttaaaatccttggcttactcacacctgcaaaatctcttttttacagaaggtaacattttacaaactttcaggcattaagatgtgggcatctttcaggggtctcattttggttatcacaacttccaaatacctttctaatattcaaactcaatcatttcatttgggctgatgataaaaatgctctgtaatgttttaatgagtttgcttataaagtttatctgaaatatatttctataaattcttatattctctgacaaaatcaacagaggtgttagattgaacaaatttgattagctaatagaaattgttaagtaacatcatgttcttaaggagttgcttcaaagcattcacaaagcacctaatttatccttgcaattgtcaaataagtaaaagtaggtatcataaaagaaaatttcaagtaaggaaatgaaagcacacagtggctttcctagatctcccagggagaaattctggaagaaatatgaatagaactcagcttctcttactcccattcagtagcttaaaaggctaggaataatagttacaatgattcatactgattacctagtgcctcttctccaaagtactgcaaatccacaagagaaatcatcacagacacggtgatatgtctttggttagtttttctacctcctggtttcaacaaagctttaaagaagtatagagaacatggaacaatctgtgagaaactactccacctcgagtggttccacttgaaatgtaaataggtttggaaggtcttaagtaaacatgacttgaaatttaaaaaacatatattgttaacctgactggaaggtaaaaacaaatttagaagaataatggatgtgctgtctggaggctataattactggtgctctaacacagcagtgtagcgagaggctgggaactgcttcatgaaaagtgctggggaactggacagaaattggttggaatctcaattcttctgcttatactagctgtataaccttggacaagctacctaaactctcagattcctcatcttaaaaataataatagctgtcttatagagttgatataaaaattaaaggtactacatgtaaaatacccggcacataaaagcacttaatatctttcctacttgggaaaaaactaaaatgtaggaacagactttcctgttaagaatgtttgtagtggatgctctgttgtgctgcccagattctgcttcagagaggaagagtttattctccaagcggctggaagagctgctaatggaaagctctttgttgtcagcccctacagggatcgccttagttgaagagagccttttcacccaatgtccaccccattaagaatgacttgcctccagtgactgatcaaagagcccatcatcccagatcagaacttgccatggaattggcagaggcctctgttgagccagcctgccagttcagcttctccctcggtccaatcctgcttccttcctatgacttcccttctagaggtgttgatctcaatgccctccctaataagccctccgatatcctagtcacggttgggagtcagtttaccagggaacactatccagcaacaatgttgcaggatgaactgttgctcagacttttatatagcccttaccatcaccaaccactccccacaagggcccaaaggcacataactcacccaagtatcttttggttgctctggtaaggattgaagagtaaggattcttaagccttgaaccttgcttctgctgatgtttaacaagcagctggaataagtgtgaaccctctgccccagctccatttcaccccttctcaacatctttcatctgccagcttgtataaagattcagcctgccacattagaaatgttgcttatgtcacaattgaggaaattttaatatgagctgtatagcaaatgatattaataattattaatattgttgttcttgagctttataatactccagataaaaaaaaaaaatgaaggcggataggccgggcacagtggctcacgcctgtaatcccagcactttgggaggccgaggcaggcagatcacgaggtcaggagatcaagaccatcctggttaacacggtgaaaccccgtctctactaaaaatacaaaaaattagctgggcatggtggcgggtgcctgtagtcccagctactcaggaggctgaggcaggaaaatggcgtgaacccaggaggcggggtttgcagtgagctaagattggccactgcactccagcctgagcgacggagcgagacttcgtctcaaaaaaaaaaaaaaaggcagataaatgaaacaagattggcaaaatgatgaacattgatgaagctgggtgactggtattatactattctccctatctctgtatgtttgaacttttccataataaaataatgaatattaatatactttataaaagtatatacaatgtacgtactttagagatcaattgttaaagataggtttaataatatatttaacttcaagttggcttatgttaagcaaataaatcaaaatatagaaaattcatattctccaaagcaaataaaatggggcttgttaggcatcttgccaaatagttccgaaatttattttttttaagtgctgagactttctttaaaagaaaactccataaggcacttcaaactaaatttttatgttaaaagatttattttacatattaaagtacagcatacaggtattttgttcattatacagacttttagattatgaagactttatatgtaatagcatattatcccaatttttaaaagctcaattttctagatgtcttttttgataacaatgcatgtgatttaccataacatgtgtataaaatctagccaaaccacaccattcttcctccacaacccttaaagaagatcctatagactcaacaactgtgccacctaaggctatgtaaactttggtcaaacaactctgttgtatacacaaatatagctatatctacaggtatagatagagagatataatatatattatttatacataatgattaagaattaagaattaggtcaaaaatcacaacaagaaaaaaaaaagtagtatctgattcaggtattcagtctgtgtagagtggtactatttttgccaatcctcaaatgtttacttcaagtctgctatgatgagaaaacccagaaggcctaaatatataacacaaacatgtttcccatctttgtatccttctatgtttgaagatctttccgaatgttaaggtctcatccatttaaggtgatttgatccagaacattggggaatactattattcagaaaatgattcttcttaaagggacttgattatttcaatgatcatagagctgctctaagggatttctatagccaagtcattattatatccaggtacttttcatataaataagggttcaagcatctgaaacaaaaaagaaggaaatgaagtgttctaaggacaaagacaaatggtgtgagttaggagctggtctaacagcatataaagcctgaattttccaaagtattttacctgactctctggactaccccccaaataaacaaacaaacaaaccaataaaatccaaatatgtataaaacatatgcatgttgagcctagtcctataggaaacatgacaggtttgagaagaatttgatgcaaaataaaatgggatgagatgtgataacgatcaggaaaattaggatctagtactagatgtgcactaactaagctctatgaccctgggcacttcacatcttggctctcagtttgtctctctgtaagatggaggtcccttacagctattatattccaagattaagaatcaagtatgatactttcaatattaataagtaaccataaaaattttaagcaattggattaataccatcttgaattgaaataaaacaataaaaaatttaaaatttttttctaaaagttgaaaataaatgttttttattatatgagtttaggtttccaaatatgtttttctcccatactacattttcctatagctttgtgaaataatatgagattaatcttatgccaggcagtccagtgggtgctctgcaaacttggctctagaggaacttgataattcagatataagccatgcaattttatatttcaaatcaaaactatctaatgtataattaagttaaaattcaacagttacagtctagaatagccatcaattcagttttaaacacagtgtataaaattttaagtcctgcattttaggtacttgtgggctattcagcagggaaactactttaggctagtgagataaatataaaatttcatgttgtaatataattttgaggcagcattaaatgggtaaaattcaggtagtaagcctaaaaatccaagataactatagagataaataattatttttgtaaattataataattcccatatctgtgataataatagcaactacagatttgtataaggctttaatttatacaaataaatctgtttcaattattacaaatgtaatacaagatacatataatatgtatcgtgtttacattcttacggtatattttgaatgtgttacatcatttaagtaataacataatttaggcattattatctttattcattattatcatctccattttatggatatggaaattgatcaaataaaactttaaagagcaaacaggctgcctgaactggatggagagatcatggtgctaaccacatcaaggttagttgttaagtttctcatcctagtggagtctcagtcagataatcataatagaaatggaaaatgtatttaggccacaaacagattttcagcatctattgatttactaatatagctttttgttccttaatttattgatgcagtgaattactttgattgagttgctgctgtttaaccacctttctattcctggagtagattctactaggttatagatattatccacttattaaattgctgtactctcttataaaaatatctagacatacattgacatatgagatgattgatttttttaaaaaattggtattatcttaattggatttagggatcagcattatattagcttcaaaaaatgaatgttttatctttttctattgccaggaataatttagaatttatagtgatactcacacaccatgatcactttcttttctctctttattgtatgtatctgaaaaatcctaaccatggctaaatctaattccctgcctattcagagcagcttaacatggttgggggaaaattaagtttcctactctttatgatgactatttcagaccttctttcttctccagcacacaatgccccacatcactctcaatcaataatcattattatttcactgaaaaaataaaatagaaaaaaaatcctcactcttccagcagtaaatcagaaaatctacttgtatcaggatgtatatactctcatttcactccttggcaataaatgaactgtccatgttcctctagtgaagtcaatacgtccacctattcactgggtctaaactttgccttatcaggacttcgctactcaaaaaaaaaattttttttaatttctcttttttatcatttttttcacttgctacttgtaagagatattccagtctgcctttcagatttctcctcaagatagtcactaatttcccccaaatgccagaagtgttgcctacagaggtttacaggaattgccttgaccaacatgacaccacacatccagtgttttgtcagtgggtttattcaattccatggcctcagttgagttttctcttaagggtcatctcagtttcagaggtacataaagaatccaatgaaatctctgttacagttacatcacagttcaacttcttttgttccaccttattcctttcactcctttactgtattgttcccgagagcacttcccaataaatcacctacacgtaaatcttagttgtagagtcttttttttctgggaaacctaagctacaaaagttgttgccagggaattggataaaatcttcaatagtaagacattcagtagagaggataaattagtcctacacaacaggctgctatggaatcatcttagcaaagctaaaaagccattgttatacagataccaaaatcagacagactttaatgaaaacaacaggccaatatctttcatgaatatatacacaaaaatcctaaacaaatattagcaaataaagctcagcaatatgaaaggaggataatgcattatgaccaagtgaggtttatccctgggaatgcaaggttgagttaacatttgaaatcaatcaatgaagttcctcgtattaaaaaaaaaagaaaccctataatcatcttcatagatgtggaaaaggcatttgacaaaatttaatatatattcatgatgaaaaactctcagcatctgaggaaaagggaaactttctcaacctgataaagggcatctatggaaaccttacaattaacaggacaatgatgaaaagctgaatgttttcctcctaagattgagaaaaagcaagaatgcctactttcaaaattccatttaccatcgtgccagaggttctagccagtacagtgaggcaaactaaacagataagaagtatacacatcagaaagaaagcaataaaattatctttattgacagacattattatcacctacatacgaaatactacagaactttaaaagctactaaaactaataagtgattataccaaatttgcaacatacaaggtcaatatatatcagtaaaccattggacagatcctccaaagtcttaaaggcagccagagagaagaggcatgtcaaatgcaagggaactccatcaggctaacagtggtcattttagcagaaaccttacaagtcagagaggttggggacctatagtcagcatccttaaagaaaagcaattccaaccaagaatttcgtatccatacaaactaaacttcatacgtgaaggagaaatatgatcctttccagacaagcaaatgataagggaattcttaccaccacgcctgccttacaaaatgtccttaagggagtgctaaacatggacatgaaaaagcagtactgtattagtctgttttcacactgctaataaagacatacccaagactgggtaatttataaaggaaagaggtttaattgactcatggatccacatggctggggaggcctcacaattatggtggaagaacaagggatgtcttatatggcagcaggcaagagaaaataagagccaagtgaaaggggaaaccccttatcaaatcatcagatctcgtgagacttattcactaccacgagaacagtatggggaaaaacacccccatgattcagttatctcccactgggtccctcccacaacacatgggaattatgggagctacagttcaagatgagatttgggtggggacacccaaaccatatcaagtactttccaccaaaaaaatacactcaagtacaaggccactgaaactataaagcaactatataataaagtctacataacaaccaggtaaaaacacaatgacaggatcaaacacacacacatcaatactaaccttgaatgcaaacaggctaaatgccccaattcaaaggcacacagtgacaagttgggtaaataagtaagacccagctatgtgttgttaagagacccatctcacatgcaatgacaccgataggctcaaaataaagggacggagaaatatctatcaagcaaacagaaaacacaaaagggcagaggttgctattcttatttgagacaaaacagattttaaaccaacaatgatcaaaagggacaaagaatggcattacataatgagaaagggttcaattcaacaagaatacttaactgtcctagatatataggcacccaacaccagagaacccagacttataaaacaaattattacagacctacaatgatacttagataaccacacaataatagtggaagacttcaacaccccactagatcattgagacaaaaaattaacaagatattcaggacctcaactcaacacttgaccaaatggacctaacagacatctctagaatacttcacccaacaacacaagaatatacattcttctcatctacacagcacatactctaagatcaaacacacacttggctgtaaagcaattctcagcaaattcaaagaaaccaaaatcataccaatcacactcttggaccacagcacagtaaaaatagaaatcaataacaagaagatctctcaagaccacacaattacatggaaattaaacaagctgcttctgaatgacttttgagtaaaagacaaaattaaggcagaaatttaaaaattctttgaaactaatgaaaacaaagatacagcatgccagaatctctgagacacagctaaagtagttttaagaggacaggtttttctttttttcaagttttattttagatttagtggatacatgtgtgtgcttgttacctaggtatattgggtgatgctgaggtttggagtataaatgatcccaccatccaggtactgagcatagtacccaatacttagtttttcaactctcactcccctcactatctcttccatctagtagaccctagtgtctactgttgacataagatgaaagtttatagcactagaaacctacattaagaagttaaaaatgtctcaaattaacaaccaaacattgcacctagaggaactaaaaaaataaaagtaatacatgcaggaattttgtagaggggagtttaaaaaagcagcagaaaataattaccctgaatctcaagacctagaaatactgatattgttttgatatatttccatccagtctttctctgagttttttttacccagttaagattatactgtgtacatgcaattttctgtcctgctatttcacttaacaaatgtcttaaacatttctccttgtcattaaaaactctctgttcacatcaaataaataaataaataaataaataaataaataaataaataaaagcaaaccaaccccgatgctagcagaagaaaaaaaataaacaacatgacagctgaactaaacaaaactgagatgtaaaaatccatactaaagatcaacaagaccaaaactttgttgaaaaaataaataagatcaatagactgctggatagattaattaaaaaagagagagaagatccaaataaaaacaatcagaaatgacaaaagggatattaccaccagccccacataaatacaaaaaaaccctcagagacaattataaacacttctatgcacagaaactagaagaaatgtataaattcctggaaacatacaacctcccaagactgaaccaggaggaaactgaaacactgaacacatctataaggagttccaaaactgaatctgtaataataaaaataataaaccctaccaacagaaaaagccctggaccagatggatccaccgctgaattctactgcatgtataaaaagctggaaaccattactattaaaattattcaaaaagaattaaggaggagggactccttcctatctcatcctataaggccagcaccattttgaaaccaaaacctgacagagacgcaagagaaaactacaggccaatatctctgatgaacatagatgtaaaagtcccaaactaaatattagcaaaccaaatccagctgtgatcaaaaagttaattcaccccaatcaagtaggcttcattcctgggatgcaaggttagttcaatatgcacaaatcaataaatgtgattcaccacaaacagaagtaaaaataaaaccatatgattttgtcaatagacatggaaaaagtctttgataaaatccaacatcccttcatgataaaaaccctcaacaaattagatatcaaatgaacatacctcaaaacaacaagagtcatctatgacaaacccacagccaacatcatgtcaaatgggcaaaagctggaagcattccccatgagaaatgactgcacacccactaaccactcctatttataacagcactaaaggtcctagccagagcaatcaggcaagagaaagaaataaaagacatccaaataaaaggagaggaagtcaaactatttgtctttgcagattatgattctacacttagaaaaccccacagtctctgcccaaaagctcctagaataaacaacttcagcaaagtttcagaatacaaaatttattacaaaaatgaatagcatttctatacaccaataatccaagctgagagacaaatcaagaatgcaatcccaatcacaacagccacaaaaagaataaaatgcctaggaatacaggtaaccagggaggtgaaagatcactacaattagaattacaaacactgctgaaagaaatgagagacaacataaacatatggaaaaacattccatgctcatggataggaagaatcaatatcattaaaatggccatgctgcccatagcaatttacagattcagtgatattcctgtgaaactaccaacatcatttttcacaaaattagaaaaaaatgattctaagatttatctggaaccaaaaatgaagtcaaatagccaaaacaatcctaaacaaaaagaacaatgccagtgacatacattacctgactttaaactatactacaagtctagagtaaccaaaacagcatggtactggttcaaaaacatatacacagaccaacggaacagattaaaaaacccagaaataaagctgcacacctaaaaccaactgatcttcaaaaaagttgacaataacaagcaatggggaaaggacaccctattctataaattgtgctggaatagctgactacccatatgcagaagattgaaactggatcccttcctttcactatatacaaaagtcaactcgagttggattaaacacttaaatataagacttaaaatgtttaaaactttagaagaaaacctgggacgtatcattttggacataggtctgggcaaagacttcacgatgaagtctccaaaagcaatggaaacaaaaacaatcaaagataagtgggatctaattaaactaaagagcttctacacagccaaagacactattcaacagagtacacagacaatctacagaatgggagaaaatatttgcaaactatgcatccatcaaaggcctaatagctagaatctataagaaacataacaaaatcaacaacaaaaacaaataaccccattaaaaagtgggtaaaggacatgaacagacacttccaaaaaggagacatacatgtagccaacaatcacatgaaagaatgcttagcaacactaatcatcagagaaatgcaaatcaaaaccacactgaaatacaacctcatatcagtcagaatgactattattaaaaaggcaaaaaatgacagatgcttgcaaagttacagagaaaagggaatgctcatactttattggttggcatgtaaattagtccacccatagcagaaagcagtctggaaatttctcaaagaatttaagtcagaactaccattcaatccagcaatcctattactggatatatactgaaaggaaaataaatcgttccaccaaaaaaaaatgtacactcatatgttcattgcagcactattcacaacagcaaagacatgaaatcaacctaaatgcccatcaatggaggactggataaagaaaatgtggtatacacaccattgaatactatgcagccataaaaaggaatgaaattatgtcctttgcatcaacatggatgcagctagaaaccattattctaagcaaattaacataggaacagaaaaccaaataccacatattgtcacttataagtgacagctaaacactgagtacacatagacacaaagcagggaacaaacactggggcctacttgagggtagagggttggaggactgtgagggttgaaaaattacctaccaggtactatgctcactacctgggtgacaaaatcatttgtacaccaaacaccagcaacacacaatttacccatgtaacaaacctgcacatgcacccctgaacctaaaagttgaaagagaaaaaaaattaaaaattaaaattaataaaatcatttataatatgttcaaaaatatgacctattagggataaatataatgacagaacattgctcaaagaaatttgaaactggagaacattatgttatgtgaaataagccaggcatagaaagacaaatattgcatgtatttactcatatgttggagctaataaaaatgatctcataggggtagaatggtggctaccagaggttgggaagggtagcgaagcgggggatggtgaagagaaattggttaatgggtaaaaaaatatggttagacctaaggaataagttctattgttcaatagcacagtaggatcactatagttaatgataatttattgtatatttcaaaatagctagaagatttaaaatgttcccaatacatagaaatgatcaatatttgaggtaatgaatatcccagttaactggatttgataattacctggtgtttgcatgtaccaatgtgccacatgtaccccacaaatatgtacaatcattatgtgccaatttaaataaaaatcaagtcctaaattaaggtagctatgcatgatgttcatggatagaaaattcattatttataagatgccaattctttccaaattgacctatatattcagtgcaatcacagtaaataccccaggatttctataatttctatatattatagaaattgatgggctgattctaagataaataaggaaacgcaaagtacctagaacaaccagaacaatttgacaaagaacaatattgggaaattaacactatttgatttcaagacttaatacaaaagtagagtgatcaaaactgcatgggttttgacataagaataggcacagagatcagtggaataaaataagagtgtccagaaataaactcaccagatgtgaccatttgattttctacagtgacaccaaggtaattaaataggaaaataatgaaattttcaacaaatggcacagaaacatttggatatccaaatacaaaggaaatgaacctcaaaccttacaccatatataaaaaagtaacttaaaatgtaaaatagacttaaatgtaggccctaaactaaaatttctaaagaaaaatatagggtaaaatctttgtaactttggcttgggtacagatgtctctgaatacttaaagcacaaatcataaaataaaagactgataatttgaaaatcaccaaaataaaacatcatttcttcaaaacacactgttaagaaaatgaaaagtcggccgggcgcggtggctcacgcctgtaatcccagcactttgggaggccgaggcgggtggatcatgaggtcaggagatcgagaccatcctggctaacaaggtgaaaccccgtctctactaaaaatacaaaaaaattagccgggcgcggtggcgggcgcctgtagtcccagctactcgggaggctgaggcaggagaatggcgtcaacccgggaagcggagcttgcagtgagccgagattgcgccactgcagtccgcagtccagcctgggcgacagagcgagactccgtctcaaaaaaaaaaaaaaaaaagaaaaaagaaaatgaaaagtcaagccataaacttggattaaacatacatctgataaaacacttgtatcaaaacacataaagaattcttacaactcaataataagactaactggtttttgtttaatcattgaaagatataaagatactttataaaagaatatatatgaatggcaaataataagcacaaaaaagatgcttaacatcattgatcattagggaaatgcaaataacataccagaacatactctttagaatggccaataataagaatatgaacaataccaagtgatggaaattattgaatcaaccagaactctcagacattcctgatgggaatgcaaaatggcttagccattttggaaaacaattcagcagtttcttttaaacatatatttaccataagactatgtaatcccacatctaggtattttttaaaaaaaaaagacagagatgaaaacatttgtccacacaaagacttgtacttgaatgttcaaagcaacttttttcataatagccaaaaaacaatcaaatgttcatcgactgatcaatctaaaaacaaactgttcaatatccataaaaaataatgctactcagcaatgaaagggacagacaactaatatgtggatgaacctgaaaacattatgctatgtgaatgaattcaggacacaaaagaatgcatagtatctggttctattagtatgtaaatgaagacaacgcaatactatgtgatctgtgaaagcaaacagatcaaagattgcttaagtcaagataatgaggggattgattgcaaaggtaaataagggaatgtttttaagatgacaggaatgctctaaatcttaaggcaaatctttgacagttatcaaacctcatcaaattgtataactacaattcatgaatttcattgtatgtaaatgacatgtcaataaaaaaaatcaaaagtatcagacaccaaaataaatattcaaaatttatttttggaaaagtgttgatggctatattttacaaaatatttcaccctctattttcctgaaatacctgtccccctttggtgtacttatattatttgatttacatgaagctttgtaggaacacctctaaatctagatatgagaaatgcttattgtaccactatctaaaattgtgttttgtcacaaaccaagtgctttaagatctaaagatggtgaaggatacaacacatacagtctaccctggaagactatgtcattggtttttttgttgcacatacagtacactctattgctttgggatcaccaaaattaatcacttcaactaaaggtacatgttggtttttctccattccaagagagtaacaacacaactgattattcttagtgtgtgagctgagtaatgaaaaacctacagaaacatgaatataaatggaagtatataaactgtcatttcttaaaagtaggtcttcaggatagaatggggaaggaagaattacaataattaattgtaaacatttaagattctcagtgtgctaggtactgtgcataatgcagtggctataaattaatgaatggtactgatttgaaccacattatacctatttttctttatatttccaacaaatgactaacactattttatgatcagttctttttccactggaattactccattaataaatgactttttagatcaaatggctgtgaagtaagttaaaaaatatgaaaatcatatataagcaaagataaattcagggtgcttcttttttttcaattaatgccaaattatttttcaggatatgcagcattttataaaattcctaggcaagttaaagcacagatcaacaaatatttatgaaactcccatattctacaacactatattccatatggtaggataagcaacagaaacagtgtgggatccaaaggactttaattttaattgaggaactaaaacacaggtacatagattcgcatatatgttattaatgccatttcttcacagcaatactggcacatgcctgctcccttaaattactttgcctattcaaaattacctgtcaatgttagagttggcctcttgaggcccatttttctgaaaaaatgaagtgtatcattctgctcttaaacagagactctagagcccctttttcctttttcacaacagggttcattttagaaaatgtgtagctgccagatatgacaatgtaaaaaggtaggcagagaaggagataaacacagaaagaacagaaaggtgaattaggcatttaacaatttattcagaaaaatgtgccagcacctcaattttataaagtcatgggcaaaagcttatgaaaattgatttagcaaaacaaagcccagggaaatacaataatgcatttccaacttcacatggcttttatgtgaaattcttctatattaaaacatactataggccaggcaccatggctcacatctgtaattccaggactttgtgaagccgaggagggaggactgcttgagcccaggagtttgagatgagcctggtcaacatggtgaaactccgtctcaatgaaaaatacaaaaattagtgggtgtgatgctgcatgcctgtagtcccaactactgggaggctgagttaaaggattgtttgagcccaggagaccgaggctgcagcgagctgtgactgcatcactgtactccagcctgggtgacacagcaagatcctgttttgagagagaaatatatatatatatctgttctcacgctgctaattaagatatacccatttataaaggaaagaggtctaattgactcacagttccacaggggtgtggaggtctcacaatcatggcagaaggtgaatgaggagcaaagtcacatcttatgtggcagcaggcaacagaacatgagcaggggaactgccctttataaaaccaacagatcgcgtgagacttattcactatcatgagaatggcacaggaaaaacctgctcccatgattcaattaccttccactgggtccctcccatgacacatggggattatgggagctacaattcaagatgagatttgggtgaggactcagccaaactacatcatccaaactatatcatccccccggcccctcccaaatctcatgttctcgcatttcaaaacacagtcatgcctttccaacagtgcctcaatatcttaactcattccagcattaactcaaaagtccacagtccaaagtctcatctgagaaaaggcaagtcctttctgcctataatcctgtaaaatcaaaagtaagttagttacttcctagatacaatggaggtccaggcattgggtaaatacacccattccaaatgggagaaattggccaaaatgaagggactacgggccccaggcaagtccaaaatccagcagggcagtaaaattttaaagctccaaaatgatctcctttgacgccatgtctcacatccagggtacactgatgtaagaggcaggctcccatggccttggacagctccgcccctgtggttttgcagggtacagcccccctcccggctactttcacaggccagcattgagtatctgtgacttttccaggcacacagtgcaacctgtcagtggctctaccttctggggtctggagaacggtggccctcttcttacagctccactaggcagtgccccagtgcggactctgtgtgggagctccaaccccacatttcccctccacactgccctagcagaggttctctttgagagccttgtgcctgcagcaaacttctgcctggacatccagaagtttccatacatcctccaaaatctatgtgaaagttcccaaacctcaattcttgtcttgtgtacactgacaggaccaacaccacgtggaagttgccaatgcttggggcttgcatcctctgaagccatggcccaggctgtaccttggctccttttagccatggctggagcagaaatgcagggcaccaagtccctaggctgcacagagcagggaggccctgggcccagctcatgaaatcattttttcctcctgtctctgggcctggatgaggggggctgccacagaggtctctgacatgccctggagacattttccccattgtcttgatgattaacatttgacttctcattatttacccaaatttctgcagctggcttcaatttctcctcagaaaatgaatttttcccttctattgcatcatcaggctgcaaattttctgaacttttatggtctgctccccttttaaactaagttgcaattccaaaccatgtctctgtgaatatataaaactgaatgcttttatcagcatccaagtcacctcttgaacagtttgctgcttagaaatttcttccaccagataccctaaatcatctctctcaagttccaagctccacagatctctagggcaggggcaaaatgccaccagtctccttgcatagcaagagtgacctttactccagttcccaacaagttcttcatctccatctgagaccacctcagcctggaccttattgtccatatcattatcagcattttggtcagagccattcaacaagtctctagaaagttccaagctttcccacatcttcctgtcctctgagccctcccagtctctaggaagttccaaactttcccacattttcctgtcttcttctgagccctccaaactgttccaacctctgcctgtaagttacttccacatttttgagtatctttacggcagcatctcactctactggtaccaatttactgtattagtctgttctcatgctgctaataaaggcatactcgaggctgggtaacttacaaaggaaagaggtttaactgactcacagttccacatggctggggaggcctcacaattatggcggaaggtgaatgaggggcaaagtcatgtcttacgtggttgcaggcaaagagtatgtgcgggggaactcccctttataaaaccatcagatctcctgagacttattaactatcatgagaactgctcaggaaaaacctgcccccatgattcaataacctcccattgggtaccttccacaacatgtaagaattataagagctacaattcaagatgagatttgggtggggacagaaccaaaccatacacaaaacatatatatatatatttgctactaagaggattttgattgattgtactctattattggtaataattagacaaagtgggagctaggaacaggaaaacaaaaagaagataaagcaaatggcagagcagggtaaagaagctttttcatcaatattagatcttactactttttgtctaataagaagaaaggttcctgccacatacatgaagtatgcttccaacatatcttaacatcatttcactaggattaccctgacactgaggtggtggaagagtggaagtcagtaatcacaggtcctaacattgaaatttgacacaggaccttatgaaaaagccctcttggtatgaatataagctgcaaaaaagtaaaatagatgtatagcaatgaaactgaggaaaatagaaagcctaagaagtttctaatgatcaagtgattgccaaggaatgattttacaatgctcattattgttcactaagatgtgtaatatgtcatctctaacctctgtatagaatgttcagttttaattgctctatcttagcgaatcaaacttctatatttgataaggtcttttctaaatttacttgtgacttcagtaaagagaaaatgggtcctaaattagggtagtagcaatgaaaatagcagatcacataaaatgctgtgttctcacttcataagggtagatggtactgcctcaatacaatttaggggcgaatataaaaagtttcacatttgtacatgttgccatatgacacactttcagtggattcagaccaagatttttataccataagtagttttacatgggatctttagcacaaaaaaaatgacctaggtaaaaaatagttaaatccatgagatagaattggggtgaatatcaacatggagggattgaaaggataaggaggagtatccaatagagcagttaagagaagaaacacaagaaaaaagtgttacagaagacaaaggagaaacaggggtggttagaattgttcttcagcctagatgtacgagttacattgagtcagatattatgacatattacatagcctttctatagtggagaaagtcttgtaatattaaagggaaatataatgaaacagtgcaaagttaatacagaagaacaaatatctgaaggttttagctctggaaacagaaaaaaaaaacagtaaaatgctacaccactggttcaagacaaattacagtgcacataaaaatgctttgagctaaacactcttagaattaataaactgtctggttattcaatataaattcacttgatttataccaaagattcatctgcattctacagagggaaaaaatccattttctcttctctttctaaaggatttctggactctgaaagaaagtctatgatgattaataaaagtctgttagaaatttgtgttcagagaaaaaatgtaatcttttttttttgtcttttttttgagacagagtctcgctctgtcacccaggctggagtgcagtggtgccatctcggctcactgcaacttccacctcccgggttcatgctattctcctgcctcagcctcctgagtatctgggactacaggcacccgccactacgcccggctaattgaaaaaatgtaatattttgtacataaagatgatattacttccaggccaactatcagccaaaatggttttgaatttttttttattctatggaaggtacaatttatactgaattttctagaactttcctatgtgaagcatatcatacactaattaaatggttagctggagatagggacatggtgtatggcctgctccaggctttctccactttcatcttatcttaagtttagtgccatgataactgccacatccaaaaataatttaacagagatcatattttagaaatattaaactgatatatttttccatttcccctaaattatagtgacttgcatttccctacctattttattaaataacctatcagataaaattaagacaatctctggacagtgaggcttgttactcattttccctggcacacactacaaacacttcaaactctcctcaaagtagtgctgtgtctaccactttatggtactgcccaggcagtgggatcgaaatggtttagagagtcatctgagtagagaagacctgaaatggtctctctcaaatctcccacagtcatagagatggggtgaagaaccagaaatgtatatggatttccaaggccttttcaaaggtgaatggaacatggttgaaaattaacagtgagctcaagtgcttaaggtcaccacgttactactttgagtcaagatatgtttgactgtagagacaggtttatctctcttttcctcagaagcctataataatttccaactacctatttttataaactaaaattatttcatctgaagttccccttccccaggattttcaatcccttgattccacaacatacacatgtacttctgatctccttaatcgtctctacttctcatttaggttcccttgctcctgccaggctcctttccattaggtcatctatattgccagtttcaaaacctggtaaaattacctaaattatgtcttaatgaagtataacttaactttctggaaaacaacttggcaatctatacaaaagccttaaaaaagatactaacctctgtccaatgattccatttttctgagcaaatataataaaagatacagagcttaatgcataaagatatccatcagaacataattcagaagaggaaactaatggaaaccacctaaatgaatgtatggtacaatagggcgactatagttaacaataatttatagcatatttcaagataataaaaagagtgaaattagaatgctcctaacacaaaaaaatgataaatgcttgaggtgatagacaccccaattaccctgatttgactatgacacactatatctttgtattaaaatatcacttgtaccccataaatatgtgcaactattatgtatccacataactaaaaataaaaacattttttaaaaaagaatctcagtagggtggttagtcaacatggtacatttctataatcaaatattatgtaatcattaaaacagttacataggaatatactaaaaatataatgctgaaaaaagtacagtatgtatttattttaaaaattccaattttgagcacatataaacatatatagatatgtgaattaatatgaaaaaattcacaaaaatgttaactcatgtgtttattttcagtgctcattcatttaaaacattcactcacacccacacccacccacacacacacacacacacacacacacacacacgcttatttaccatctaacttctctaaacaaaaaaggcatagtccttactctatggagttgccggtctaatggggaaggtacatttaacaagtaattacaacagattatagtaacacattccctttttcttaattatctgtctctattataactgccaactccatgatggtagagatcctatttctcatgtctgtcccttgcatccacagcatctaccacagcgtacaggatcataaatatttcatgaatgtagaggaggcccagagactaaatgggagcatattagcaggagggcctaaaataactcaggaggtttgaaaacttttttgagggcaagtgccatttaaaataaactctaaagaaagaggaagaactagccaggtgaaggaggttgaaaacactgctcaaggtagaaaatggctacaggtaaaagaagtggtgttcactgaattcatagactcaaacagtggttatttccgaataagggtttgtaggcaatttctttttcaaatttacttcagtgaaggcgtatttttgtgtccatcagagaaacaatagtctaaactaaacagattttaaaatctctgacttctcagagatcaccctgattttacatgtttattttcttactttgaactgtctctatacatacaatatggaacaaattattgcaaattcagtgtcctactttagaactatcttatacttcctcctatattttaagttctttcgggtaaagaatattttttttttcctttcctttatttggtatcttccatagcactggtattgtgctgtgtacccagtatgctgtattttaaagttaaataattatagtcgagaatactgatcttattatctggtggctagtttttgttccaatgactttacagagttagtcccagagaaaccaatgagaattatgaaattttcttttatataactttaaaaaatttatctcgttcgataaaaatacttcataccgaattagaataaaaattaatattatttattatcctaaaatctcagagacagatgtttttatttttttccaggataaagagcaaagaaaaatattctgatggtcaaagtaaccatgactacggttttcagacttataacaagtgttattttcatacactctatattggtaaaaataatatattcttataaaatatatttgtggtgaagcttacttttatactgcaacaaaattcttaaaattattcattaattctaccatcagtagcttctagggtaactatttttccagtaaataccatagtgtggactcttgagagaccagaagcggtccctgcccccgaaaatatgtaaaattgccactctggttactactaagaccataaatccattttaccattgttacctcgattctcaagggtaaggaataattctcagcttccccattccaggcccatatctaaagggtagcacaagtttgataggggctctcttcgagaaagaggaacagtgtggcattagctatgttactagaaagacccaatccctagtcaaagccattgagtcttgcccctctacataaatggatatagaccctcacatctagagctgcattctaggctattaaacaatctttttcaattgctgttgctggtatctaaaatttcaaattatctttagacaatgtttcagcttctatgataacatttcagaaacagagcaaataatgtgtatggtttatttaaactatactcaaatgtactgaaaattggttcacatttccaaagaaactctgtgaataagtacagcatgctattatactttaagactgtcattctgttcatactaatataatggtgactttattactagaaacaagattttctctatctgggtaattttagttctgttcattttagcaaaattgtaatgactagaaccatcttggtggttgatctaaagcacacgaaatgctctttattttgccagctacaaacatgttaatatgaaatgcattcacagaacggaaggacagttcctttctaaagtactacggtttgaagtgaatagtcctatcatggcaaagcacaagtggaaggaaactgaccattaggtcactattggatggtaagggtatttcattccactatccaccccacaactcaaaagaggaatctgacctagtggcttactagagattggaaatgaaaaaaaaaaaaggtgaaaagaatttatttttatttatatacttggccagaaattagagagaagcttttataatacagatatcaaagggttctgaagaaaaagacatggagaaggactgaagagaagagaaagaagatgaagacaataacgagaaaagaaaaagaatgttagactatgaaagttttttcaatgaaaagagtcaaactctgtcaaatatttgaagagatttattctgagccaaatacgagtgagcaatggcccatgacacagctctcaggagatcctgagaacatgtgcccaaggtgctcagggaacagcctagttttatacattttagggagacaaaaaacacatcagtcacatacctgaaagatatacattggttcagcccaaaaaggtgggacaactcaagggaaatggggggtgttccaagctataggttgattaagaaattttctgatcagtaattggttgaaacagttattatcaatagaaatgaatgtctaggttatgataagggtttatggagaccaaagttttattatgcagatgaagcctccaggtagcaggcttcagagagaacagattgtaagtgtttcttatcagatttaaagagtctgttctatcagtagttcaaaaatagaggagagtataatgaggcacgtccatccctcaacccccatcatggccagaaccagcttttcaggttaaatttggagtgccctggccaagaggagaggtccattcagatggttggggttgggggggtcttataattttatttttggtttacagtcctcatgaagtacagtgatataataatcaaagaaaacattaattttggtagtcagagaccaaatacagatgactgcagtcagaatcttgtgattctgaattttagtttcctattgaaaaaagtttgaaattcagaagcacaataatataatttataaagaatacctaaacttacttcattaaggaaatgggtaggcatcaaggaatgaacattctctgcaacaaataatacactatggcaaataatttaatgttaaggtacataagaattcttctcatccgaatactggatatcaataaaagaaaacattgattgatttcaacaaatgatccttaattaaaacaatcgaagcgataaagaaggaattatcaaacataaattgctaaactagtagcagacagcttttacatttagcttcatttgttaaatgaagtaaaatgcctatcttacttcaaagaatgttttaaaaattatatcagtaggattaggttgtgacaatagcatttaaattccatgagaacttattataaggaaactgcctaccctgacatttcctccatggtaaaagaaaagcattcttatttataataaataaattttctttagtctttttcagtttacaaagtgcctgtatacacattatcatttatgctgacaagcagctggtgcagtgggtgtttttttttaatctccgtcttgacagagagcagcaaagcacacagtcttagatgctagaatccatgatctatcactgaatagtttgtgacttcaggcaagttatttaaactctctaaatctcattctccccctatctaaaatgggggtatttatctgcctcatagggttgttataaagactaaattaaccaataactgtgaagtgcttaaactgtcaagtgctggagttagctgttattactacagataaaactgaagtggtcctgaggatgaggagaaattggaaacttcgtgtactgttgtaagaatgcaaatttatgcagtcattatgaaaaacagtatgaaatttcctcaaaaaactaaaaatagaaccaccatataatttagcaatcccacttttgagtatttatctaaaggaaataaaatcagggtcctggaggcacttgcacaatcatgttcatcgcaacattattcattaacagccaagatgtagaaacaacctaaatgtctatcaacagatgaatattttcatcagaaaaggtgatacacagacacacactcatacggtggaatattattcagcctttaaaaagaagtaaatcctgcaatatgtgacatggatgaatcttcaggacattatgcttagcaaaatacaccagtcacagaaggacaaatactacatcattccacttaaatgtgaaatctaaaatgatcaaactcacagaggcatagagtagaatcgtggttggtacgggctggggagaggaagaaatggggagttgctattcaatggatataaagtttcagttatgcaagatgaataagctctagaaatctgcagtacaaataccatgtttatagtcaacaacactgtactgtacacaaaatttgttaagaaggtaaatctgatgttaagtgttcttactataataaaaaaaaattatggttcatagaactggcctaaaactacagagtaaataatcagaagagtcaggattcaaattctaatcttttacataaggtcaagtgactttaagtaaaccttaaaatctaatccacattagttaaagcaatatgttattcctgaaagagcatagactttggtgcagacttaggcacaaataatagtttaactcatcagtgaaatagagacataaatacctaacttgtatagtcatataagaattaaatgagaacagaaactccatgagaccaaaatgtaagaactttataaatttaaaattgatgtcttgcaatatgtggcctcactgaaaatattttaagaggtccctaaacctataatgttatggttaccagccacaaaagacatatgagttagtaagatcttacaagattgtttccttaatgcaatagatgctaatatttggacaagcttcaatgagaatttactctcgtgttattagaaaattgtgtgaaaatagtatgaattgttccaattgcctgtatattttatatattctttttctagtaaaaaatgaaaagtaataagatgaatattttattttaaatgctgaaatgtacaaaacacatttttcagaaaagaggaaatcttattagtattagtatgtatcaactcattttagaaaatataaaactaattatgtccaactgaacaaattaacaccatcatagtctagctaagcattccaaggtcgttcctttaattttatgatctcgcacattaactcatattaaagaaaagaagattcaagtaaatctacttgggttaaaacatgcccctgtataatacctcttaacacctttaaataaatgattcaaaacaaaatacatatgctttgtgcatagtacatagcatacatcttttattgtactaaaatatgcaactaatccttcaattcaaccactacattattcctggggaattttctcaccaacttttgaaattacaacctaagtttttgtaagtatccaaaaatcaacacagtttggttcattggcaaatgtttgtgatatcaatttaaatagatgcatggcatctgtgaaatatgagatgctgggctccacagctagctatgaaataattttaaagccagaaactaccttgccaaaacaaattagttggtagactcttcgatctgaataacaatgtatatttttattttcaataaatagaaatatattaaatttctagcactgccacaacaaactaccataaattgagtggcttaaaaaaaacaaaaatttcctatctcagttttggaagctaaaagtataaatcaagatgtgagtagaaccatgttccctctaaaggctccagagaaggatctttccttgcttctttcaatcttctcatggtatcatcaatccttggtgttccttggcttgaaggtgcattaccccaatctctgcctatatactcatataaacctttttcctgtgtgtcctgtgtgtgcctctgtgtcctctcctcttgttataaggataaaaaatcatattggatttagaacccatcctactctagtatgtccgcatcttaactaattatacctgcaaagcccctacttgcaaatatggtcatattttgaggttatgatgaacatgaattttgacctagtatgggggtaggtttatgcttatttcatgcaattttaatctttaaagtatgtttaagctgtaaaattctgtgattccataattgtgagaccaaaaaataaactttgtctagcacaaaaatgcacaagttgttttctcaaaattagtgattttctcataattaaaatgtttattaccaaatcagttaatcctatatgtaaacattacagtacttcctcatgtttctggactttactcatgtaggtctttaatttcactacgctacttttacctcaggatagggcaaaaaagagaagtaaggaagcatctatattgttaggatcagagtgcaggaccgaggagaccaggagaggatactgatgagcaaaaaatgaattcattccttttgagtagattcctaggagtggaattgctgagtcatatggtaaatttatgttttactttttaagaaaacacaaactattttattgaaatgactatgcaattttatatttctaccaacaatgcataaaattctagtttctccacatcctaaccaacactaatattgtccatctttattattacagtcattaaaattacattataattgtaatctgtattgctctaatgactagtgatgtgccaggaagtcttcttagtggtcgttataaaaggtgaataatacataatacttgcctttacaacatttaatgtctgagggagagagagagagagagacagagagaagcaaaaattacaacacactacattaaatgtacacacactgttataccttttactaaatagttttgtgaaatttggacattttcccttatgaatgaagaattttgtggaaattcaactaagattaaacaaagcccaacattatatacaagccatcaacctgtgaagtatttcctccatgtacttctgatctttaaagcaatcatgtaagacgttctctcaactaagtacttcattttctttaaaggacatttgcaatagaataaagtacaaagtaatgctgcatttaagtgtcctcagggaaaagaaatgaacattattattttagcagaatgtccaaaaggtgattttaatgacaatagacttttctgatgatgatttttactgattttctcatagataaaatgtttattatcaaatcagttaatcctatatcaaatggtttctataataaaaataccaaaaatatcaaatggactttcaaaaacatcgaatggcgcctataaaatggagatcaaggcacatgaaaggatctctagcactcagcaatcctaacacttctattaaatatggaataattctatacctcttgacctctatgattgcaaagccatgtaaatgagctgtatacatagtcattttccttaaaccaagtgttaaattattttttaagtctctcagatggcctacctctgaacccagtaaaaactgaaataggggtgagaaaatgctgacctcttgaattatatacaaagttgaaaatattcttaaggccctaccaagaagtagagaattaccatctgagtcttgtatccatcagaactccagtctggagatgagagctaatacattgccacattagataaaacatatagataaaaatatgatgtaacatttttttgaaggatgaatgaacacaggaataggcattgtgggagctccaggtaagggaatagtgacttaatagtagccaggcactgggtattacaagaattcctccttccttcaaagagctcattgtccagtgaagagacagtcataaatacaatgaaaatacagtaccgtaaaagcagctaacatttattgaacacattctatttgcaagctatcatttttacttagattatctctttcaatcctcacaacaaaactacaagatagataccgttactatcctcattctacagatatggaaacaggcttagagacacaacttgcacaaggctacttgacccacctctaaccgattcaagtggcccatattcataaccactgaggcagctttactgccacttataccactactataaacatacagatgttaaaataaacatagcaggcacaatgggacagagggccgacttgccagagagagtcagaaaaagtttcacagagtgtgctctgaaaattaacaagaattttccagacagagaaacagaggagaagcattccagattgggggcaaaaatatatgtgataaaaagaagcatacacggaaataacagaaacaactgttgtattagtttcctatggctgctgtaacaaaataccataaacttgttacttaaaacaacagaagctattgcagttcatagtttgggatgccagagtctgaaatcaatatcgctgggccaaaatcaaggtgttgggtgggccacgctccctccagaggctctaggggaaatttcattccttgccttttttcagcttctggtgactgccagcatcccctggcttgtaatcatattgcacaatttttaagtctagcatcttgaaatttctccatgtctgtaaagatctccctctgtctccttcttataaggatacatgtgattgcacttagggcccacctagataatccaggacaatctcccatctcaagatccttaacttaatatctgcaaagaccctttttccaagtaaggtaacatttactggtaccaagaattacatctgatttctttgggggcatttttcagtctatcacaacagtgataggggagtccatgttggtagaattggaaaatacacaaaggagtaaaggtcatgagaaatgtggcaggtgggaggggtaaaatagaagaaactaaaagaggctagcaggtcagcagggaccagatgatgatgactagattggctacagacatgtttaaattgtattctgtaggtgacaggtaaaattgacatgttttgatttgcagcattatattgtgatatttgcctgttagaaaaaaatcactacagagttaatagtgaagagagatcagtagaaggcaagagattattgaaacccttaataattattcaggaataaaaagaagagatggataagatataaatttggccattatggatgaaatatagagaaaagaacaaggagaaatttaggataactcctaaatttacagttttgggcaactgggtggatagtggggataactgtgaataggaaataccataggaggtactaaaggcaaggatgaacctggctttggacatgcaaatctagaggtgtctgcatggcatccaaattgagattctggtagataaattgatatgaaagtctggagtacaaaaggatttagaacttaaatgtatacatctaaatttgaaaatttagagatctagatttaggaatcactggccatgagtatagttgaaagtatcaaataagtcagtgttagtagaaactgcttttattgctggtcccagtgagttccaaggcagtctcttcagaatttttatgctgccatgaatgtttcaatttgttcattggtgaattttagccacctagactgtatctaattatctcattttctttagacactgcctgtaccattttggaaaattatcttattaaagtcagctcagaaaaaaaaatagagcatttagtgttctatttacatgtgattatacatactcagggtcctggtgctagggacctcataaatgctgaaaagaactgttaatcttaaaaggctttgggaaaaaattattactaatattaaccctctagggaactaatgatgaaaaattaccctaccccagtggtccttaaaactttttcatcccgtgactactcaagctctacatcatttcttctacaataccacatcacataactgcaggacttttatgccgctgcgaagggaagaaagagattatcatcttcatgagaccacagggtacactaaataaatgttgaaaacagagcaccaggcagtgactgagaaaagctacaggaagactgcagagcctgaggctttgacaagcaggtgcttccgtggtcatcaaatcactattcatagacatgtcgttccaggccagagaatccagctctgagaaacaatgcctcagccattagctcccaaaagacatcaatcacgcctgccaagacacacagttagctcaggagggatttcaaaacttaactgggtcaaaaattgcttctaagcaggttttcttaatctaatctaaactgcaacttgagaaaatagaaggaattctacctccttctaaactgtggttcctacctacatctccaacactatttttatctcttttgttttccaagtacaaaatgttttgatccaatgtaaatgagctatgtattgctttctataagacctacaaattccttcctaccttctcacatcacttattctacccagaaagtcttccctttcctccttctactttcaaaatacaaatttcatagaaatttgctgggaccatgccagatagtagtcataatgcatcttcaatatttctgccataattgtaaaatttggaactcagtaaatgctgtcttgcatatatttgctttctgtatatgttatatgcctctaacaagattttaagttctgtggatggagtcagcatttaatatcttactgggataccggtgtccagtaggtctcaatagatgaggatgacaaagactccaaaatatacatctgccttttatttctgcctacgaagattttaacaaatttttaacctgtgtaaatttttctaactaaaattttcacctctttcttaccaatatagttttgttttcatatatgagatttccttactatctttgctttaataactattttatctcaaattttaacattgcctggaaaaaaacagatgacattgtagctttagattaattttcaaagtatctgattattttaatgtatcaagagaaagcaggaagagtaagagattgccttttgtgctattttgcatatataattggctttacacaaaaaataatgcatcctgtaaggacagaaaaggtgtaaaatctttcttcactcatcataaggatcacggtcaacactcttataataaaagacaagataacaagagaaaagcataacaggtttatttaatcaaagttttgcatgacacaatacccttcagaaatgaagattcagagacccaagggacaactgtcaatttttatacttagattcgatgaagaatggacagttgtgtagaaatgagattggacagaaagggtatgacctaatggtagactgagtgaggaaacctagtaagacctcctgttcttattcttcttgaactctctgtatagcagttcttggtcctaggtataggtccggaccccttctgaaatgagtcttgtgacctactataagacaaggtagaccagagtatttctttgtggccagctcttatacaaaaagctgggagaaagttagggtaatatttctaggttttatgtctggctttaggggagagggtttctagtttctatggcctgccttgggagagaaaggggagcaggcataaaaagggcaggagaaggtcagaaagatcttgcttctgtgacctttttctttagttcaacttattcagcatgctaaagtgccatactttgtggtaccattttctgagcccaacattcccccatctgaaacttccccagaaagtttaacagtaaaaaaattgggttgttggattgtctcataagccatcaaatcagtctttcagtcctgaaaatatgtctgtccaattagacaaataatggttgtgtctaatttgaggaggtggtattgcaggtaggcctccaccaaacttagtcctccatatggtgtgagtaatcagatatttaacaatagtcatttctataaaaacaaaagaaaacaaaaggtaatgtttgaagtaatccataaactcattcctgagtccagagggtatccaattgagacaatttctagatttggcctcaaagtatcttcaggtgaagacagtgcaggcagtggcaatctaacagctttttcttgcttttagttttcaagtgagctttctgagtaatctatacagcaacaggcatgaaggttgttcatacaaaagctgctgtggtgatttccctgaagtctacatcaagtcatcaagctttggctaattttagggcttcaggaaaagaacagttttaatttcaatgatatcaagccagaagggtgggagaaaaattaaaaatattattttggagagttgtggccagatattagaggaaactagaagaatttcagaatacagcccagatttcaggtagatatggaccctcaaaaacaattagttagaatctaataacaagtgcactatagttttcatctgacacataatttttctctctatacgcactttcatttctagtaaagatactcaaagtagactgatttgtttgcaaaataagtttagtctccttaaacttctcctgattatttacataaatccagcaaaaatatttattgaccattttctttgagatgagtcttgctctgtcgccaggctggagtgcagtggtgtgatctcagcttactgcaacctccacctcctgggttcaagcgattcccctgcctcagtctcctaagtagctgggattacaggcatgtgcatattggctctttttaagtttgttttgctgaaattttcaattaggaatctcagattagacttttaaaagcttcttgaggctaggaatccaagccaaggactcactgtcaaatttcccatagtatctatatagtttggtgaattcctctctgctcaaggggtccaaaatatcctgaggtttcagggctgtcagaaagtgacattctttagccatctataaggcaaccatgtgaactttgttcaagaaaccatgccagttattgcaaagcgggctttattggctccataatgtcaaccttagttcctcgatgttgtctgaaaatatgacattccagtcaaagccttgataacatagccagtgtttccaattgtgtcatgttacaaggagaacaaattcttactgaagttacacaaataataatattgccataaaataagaatccttacaaatagtttctgaattctggagggatacagtagaaaaaaaaagtaaatgttttaattctgtttacaaagttatactttaccaaattgttataagctatagatgccttcagagaaaaaaaatctttaaatatagaaaataaacatttaaaataagaaccagaaaactttcaaataaaaagtcatgaaaacatttcctcatcagttgattcagtcctgtgtaattaattcttattatgtttgatcttggttagcagtctcattaagtcatctgtttattcattagagttgtggaaattcttacctagtccaatgatatgatcccaaagttatcagaaacctgtacttgtcagagttatttccatcctttccctgaactttcttgaagacacaacactttacaattctagttgcttgcaaaaacttttcagaaagatcatcagaataaagcaattaactatagacaagacttaaaatgatcatggttagaaatctgttaagagttcattataaccagcaaatgacaaggaaatttggtgatttctgtggcatacaacattttaacataataaccaaaaattgtgaataatagcatatcagacttctaggaatctcataatttttaaacactcatatgaataacatccatagatataacttacaggtttagcatcccttattacttgacaatgcttcccatataatttagcatatcaaataagccaactggcttatttgaggccaactggaaaatctcaaagttaatttgggtcaaaaagacttaatttagaatttaattttgagaactttgtcaaaaatgtcaaaagctttaaaacacttggttaaatattatcttggatatttattaatcaaaatgacaataaaaaatgtttaagaggctgggtggagtgcctaacgcctgtaatgccagcactttgggaggccaaggcaggtagatcacctgaggtcaggggtttgaagccagcctgaccaacatggtgaaaccctgtctctactaaaaatacaaaaattagctgggcatggtggcaggcatctgtaatcccagctacttgggagactgaagcaggagaattgtttgaacccgggaggtggaggttgcagtgagctgagatcacaccattgcactccagcctgggcgacaagggcaaaactctatctcaaaaaaaaaaaaaaaaagaaaagaaaagaaaaaattgtttaagacaaatagagaaggttacatacttgtgaacaaaaactgagctcttttaatagaaaactcagttttcttaagtaatcaaagactaatatgtgaccacatgaaataaactacattaataaaacacaaaattgtttcctaggccaattacataaaaggaataaaaactgtcacattctcagaccaaaatactccaagaaacttttgtcattttaacagggaagaccaaattgtacttttgcttcagtgtactcttaacactaaaggtaattttaaataaattttaaataaatatatacaatctcagtcagctttgaccacacaacattttcataaacattttttaaacttttaaaaattgatacagaattatgcatacttatggagtgtacattgcatatatacaatgcaacataatcaaattaggataattagcatatacattatcctcagatacttatcatttgtttgcagtgaaaacattaaaaatcctctcttctagctattttcaaatatataatacattattgttaactacaatcattctactgtgcaatggaatactggaaattattcatcctatctagttgtaactttgaacccactgaccaacctctcctcattttcctctcccctctacccttcccaacctctggtaacaactattccactctctagttctatgagatcaacttttttagctcccacatatgagtgagaatatgtagcatttgtctttctgtgtctggcttatttcacataacataatgttttccagcctcatccatgttgctagaaatgacaggattgtattcttttttatagttgaacagaattaattgtgtaaatatgccaaatattttctaaatccattcatccattgattgacatttcagttgattcaatgtcttggcttttgtgaatactgctataataagcacaagtgtgcagttatttttttgacacactgacttcatttaatctgaatatataccctgtagtaagattcctgaataatatggtagctctatttttaattttttgatggaattccatgccaatttccctagtggttgtgctattttacattcccatcaacagtgtataagagttcccctttcttcatgtcctcaccagcatttgttatttttgtctttttgataataaccattctaattactgtgatgtgatatttcatcgtggtttctatttacatttctctggtaattagtgatgttgagcatttttccatatacttcttggccatttgtatgtcttcctttgagaaatgtctattcagatctttcacccattttttttagtgaaattatatgcttttttcctattgagttgtctggtttccttatatattctcattattaaccccttgtcagatgcatagtttacaaatgttttttggtataacataagcatttttcctattttttaacaaaaatgtgttctttattcattatgaaacattttacttcctcacaaagagttgtttcctttataatttctagtattttaattacatgtattaactataatttataacttttagtaacttaatttctagttaaaagtagcaaactttgtgaactgtctcatattagtacaaatgatttcattatttctagagacatgcatttcctcaattttttacatttattaatagatccaaatatatttagcttctctatatcttataaaaagaagacgccaaagtacataaacttatgaataatcatatatgttttcatattttaacttacttagaaataactcagacaattaatgagtatctctattacttaatttcactataaggtttcaagttaccaaaaagaatttttaaactatgacaagttcatttataaacatttatctcattcacatttacctaactgtattcattcttaacagttatgtttaaattgatcatgggaaacaggctattcatcatcttatctttttgttcttttaaaaaacaaaaccaaactaaccctacatttgccagccttgtcctaaccaaagcctctgaaacactggacacagataccctccccattgttcaccccagccatcctgggtcctaaacatccactcagcacccagaaggctacaaaaggcaaggtccatatggatggtacagagctcaggacagaggacaggaaacagacagctgtgaagacaatgcctggagtacttgactgctcccaggatggccaagaagcagagttaggccagggaggatggggccatactgggcttggccctcccctgtggttgactggcagcctaggcgctgcagaaacacacatgtcctagacttcaccatagcctccttcccagaccccagaatccagaggctcaaaactaaatacataggctcacaagatgtacacaaggctttatgggagcctagcagtcattccccctagctttgacctaccaataagtcaggcaagtatcaaaaatatcaaagaagctaaaagttaaaagttaaatgtagtttttcctttttttttttcccccatgactcatatacattttagcaatccatatttactgtgcattctactctgaggttggatttaaagtattatgaccttaaacacctagcagaggtaacatacctgtttgatcagcaaacacaggcaaaaatgtctatattatatttaatgacataatcatacagaaagaagcagatcctacagctttaactttaagccacatgccaggtccaataattcaagactcactagctggatttggcgggacacgttacctgctccagatggctagagctttttaccaatttgtatggagaaggcttctgagacttttcatgggaccagtttctaaacatttttttctttctgatgacagtcatctccctgaattttgtatttccagaagataaatatcaagttctagagaagtcaggataggaaatttacatctcaaaagcacagagaaagaatgcaagttttttcatgtagtttgaggaatgttcacctattaacagagatcagtcttataaaggatgtggactagattttaggctggtaactgaggatctagtgtatgaatgtcttcaaagccccctatgagtggtacaaaaagtacataaatgagcctaggcaaaaattcaggagtccattcaaaataaccagctgatcccattattacattgggttttgggtctcttagagctgaggtaaaagcctaagaggacaacatcccatagttgggtcatacaacattttcacaatgtaccttgttgcatgggcattttcttgaggctagtgtgtaacctaatgtcaattagcccattttgtgtcccgcttatcctaactcaggagtctctgtctttgtgtgcatgggtgtggtaagcactctagtagctttcaagtgcgcaaaccatgcacaccatcaaattgtggctttggctccgaaattcctttgaccaacttagccaatgattttcccattctgtctgacccagtcaaacacctgaggcttctcttatgtgagggcacaagaaacaaagaggatggaaacaagatataatacctgtgaatttggaaaactggagttcacatcccctatagcaaaaaccacttacaaaccacttacagcaaccgctgtctgttgtattgaaaactgcagctctacccagtaactggtcaaccaccatgaatccaaaagtcaaatgccttctcacagcacaaactaacccttggtaccccaaatgccaaagatatcagggagctcaatgccaaagagaacagaggtccagatgtgagaaggactaactcatgactcttagggaagacacaggaccaaatgaggaagacagaggaccacaaaaaggaggtcaggggcacctttcctgtgtttttcaaggggtctcagagtctttagaggtctccttccggtccctatgtatgattaccagaatgctgatgttttctcttagtaattttttatctgctgaccaacaaatggaggagggaaggagttgaaggcccactcaaggaaactgaatggaagatagacggtggcacaaggaggatacaggagcagaagaaatggaaagaagaggtttagaggagtcaatctggggagatcttaagttcaccaaaaaggccaataaagttccacattgtcctcaacaaaaatcacactaacaaggaaggaagtaaacagaaaaacagaatatgtagttagcaggagtttgagaaaaggagtttcagttgactgtgaagttcccatgggagaagcaggatccaacagagaaactcagacaccttagaaaaagcctgaatatcagcttccacttaaattgacttttcaccatacagccttttaaaaaaatcctttcaaatgtcttattatcagatttcagccaggacaaacaacaaataattctgatttttttccttttccttttaaaccaaaggaaggtatccatcaagtaactcagaaccaaaaccagtaagtcttttacgacttaaccagtgatgagagagacgtcctcaagagggtgcgaaaaggtacagtcctccaaagactcagaaccactcccaaaagaaaagtcaaaagaacgaaagacctttgctaccacaggaccaagcaatgatggtggagatgacaaaagcccctttgaattgggactttttataagaaaaaaaaaaaaatcccctgagagctggcacgataaaacagagagcattcagggacctcatccactggctgcctgacacaagccaacacttgtgctctctggctgacagagatcaggggggatattctcacaagtcttaaggccgaactctcaggatgtaaaaacgagacaaacaggaaagacaaagacaactgtccctgagagggaaaggatccataacaaatgggtaccccaaggctaaatttacacaacagtcacaatccaaacaaatgattttctcctgctaacctgaatttggaaaggaacaaatacagataaaattttaccatctattctcaaccaggcattatagacagagaccagggaagagctgatgttagtaaataattctccctttgccggcttttggtcagttgtcctaggatctcacctgcaggcactggagtgagtcagttgcctcagccgctccacattgaacaccagagttacaagcgcagaaaaggtatgacacctttcctacctatcaaaagggtcacaaccaacactcctacaagaaaaggttaacaagaaaagcataacagatttatttaatcaaagttttatgtgacacaatagccttcagaaatgaaggcccacagacccaagaggaaaactgtccatttttatgcttagatttgatgaagaatagacagttatacagaagtgtgattgggcaaaaaggatatgacctaatggtaatagactgagtagggaaatgcagtaaggcctgtcctcattcttcctgacctctctgtgtagcattctttcctcatgggtatagggcaagaccccttctgaaatgagggtcttgtgacctaccattagacaaagtaggtcacagaatttctttacagccagcctctacacagaaaggtggggaaaggtcagaataatatttccaggttttatatctggcttttggggatagaagttctaatttctatgaaccaccttggtgaagaggaattctagtttctatggcctgccttaggggaaaatgggaagcaggagaaagaagggtaggagaatgtcagaaagatcttgcatctgagttcaaagtattcgcttcagtccaaagtactgagaatgccaaagtaccatactttaagaaataattttctgagccccaacaatcctaatttgaaaagttaatttataggattcaaccttttttatatcagagatgctagctgggtagaggtgtacaacaatgaatgaaaacagaaatttttgttactgtagaactctttttgaggaagtcaagaatatttatgagtatgccttttcttcacagcttaactaaaggtctgttaacaaatgtaatagagttaggcagtatctttgagataaggtacctcaaaagtccccaaaggttcttccaaaaacactgtcactgccaaaaaaggttctataatcacataagtttaggaaattctccctgttctcttcccactttggagacacatatcatgacatctagtccacaaagtccagcaggagagacctcttcaatttcataaacatatttaactacaaacactttatatcaatagtgcctaataatagtctagaaatcagaactcgtaatcgtaatactatttaggcaatgttgatctggtataaaacccttattttacagatatttttaaaagtaagagtcacagaagttaaatagctatctagttcagatactctagacagagccaaatgaacccaatctcccaattccacgtttcttccatgactcattctttacatgccaggcatttaacctaatcatcactttgtaatttaaaatttccccatccagcctcaaatacatgtttgtttgtttgtttgtttaagcacacaataatatacattttgagcatatccaaagcttatctatcaccctggataactttctgtaagtgcctccctgtttataaaattaaaaacactgaatctgatagcaaataacctgaggcctctgtgataaatgagacagggcttcggggcgtttcagccagcctcccctgagactaggtttaagacatctccatcttatgtgaagacttaaattgtgttgtagcagcttcagtgaaattatttttaatgcccatttgagattttttagaaataatagagcttttatgcaggcattcgaggcagaatccttaatgaggtaaggcatgaggaatgaattcagaaggaagattttcatgattggaggagctatgcgtcatacctaatgtacattccaggaatattttatttaaagcaaaattagtgaaatatcaatctgtggaattctacaagaaattcattttataactcctccattattcctgtcatcagtaacttcatttttcacatatgagaagttctcacgtaaatgtcctgaatatctaaaccaatgtattcagtgcccagaatatattatacatccaggattcacaatattcacttaaatatgatgattagagcaaaattgtcagttaaaaaatagcagcagtatttagctgcatttgagggaatgtgatctgaagtaccacagcaacctttcttaagccccaagcaatgcaaagtcatgacatgtacgggttcagagacacagagctgattgagcaaaatacatatcccaaagattaatggtcatctgaaagaagataaaagatttattgtaagtttttatttgacatagtgtcacacaaaagtgatctatgatgtcttcaataacaaccaccaccacaaaataatggctaacacatctaatgctcactgtgtaccaggcacagttctaagcactttctatataatcactcatttcattatcataacatctccatgaaatagtactactattatctccacttaacatctattgaaactgagatgcagagagtttaagtaacttgccaaaggtcacacagctagtaagaaacaacacataggttggattcgaatcctcaaagtccagctccaaaatccgcaatgtctgagccttactaaatgccaagcaccatgagaggttctttcttgcattacctcatttcattatgcttatttaactttatttttaggataaaatcaactgtaaaatgtttttctctttcatttacaagtttgcatggcttgtggctacatccttgaatttatcagtaaatctccaatataataaaaaccagctgtgttccacctgaaacattaaaacattattctttgcattgcgtaagttaaaaaaactgtttagtttctacttctctagcctttcttgagtaagcagctatgggtagtaaagcatacaggacaaagagatatctcaggatccagctcacccaatgagggagctacaaaagacagcaaggaaggccttcaagtaatgagttagcaagctgtctagtgataaccctgagccaatgggaatgcccttgggatgtgtcctatgcttaattcaaatatctgtggcacagcatagcatccttgaactgggagaaacctctttgtagcattaccaccaatctttcctaagtaaagttagccatttccacctcagtgaggctaatcttcaagtaatttctattgttgagtaaagaaggcattttcgactattattcaaaagtcaaaaaaataacagacgctggcaaggttgtggagaaaaagaaatgcttataccaacgctgttagtagcagtgtaaattagttcagccattgtggaagacagtgtgatgatttctcaaagacctaaagtcagaaatatcattcaacccagcaatcccattgctgggtatatatccaaagaatataaattgttccattataaaatacatgcacacatatgttcactgcagcactattcataatagcaaaaacttggaatcaacccaaatgcccatcaatgatacaatggataaagaaaatgtggtacatatacaacacagaataccatgcagccataaaaaaagaatgagatcatgtccttttcagggacatggatggaggtggaggccattatccttagaaaatggatgcaggaacagaaaactaagtattgtctgttctcacttataagtggcagctaaatgatgagaatacatggacacatagaggagaacaacgcacactggggcttatcagggggtagagggtaggaggagggagaggatcagaaaataactaatggatactaggcttaatactttggtgatgaaataatctgtacaacaaactcccatgacacacgtttacttatgtaacaaacctgcacatcctgtacatgcacccctaaacttaaaaataaagtcaaaatatatgcatggaaaaaaaaaagtcctgccaatgcctgaaactcaacatactccaaattaaatttaccctatcctattccaaaaagtcaactttattttcaaagttttctaaatatcccagatttaaatgattctttgattcctaattttttttttcaccttgcatattaaccagtcactggaacccaacattcattcatttatttttcttcacaacgtctctcagattatctttcctttctgctttcgaggcaaaacagcatacttgaaaatccatagaggctgggcatggtggctcacaactgtaatcccagcactttgggagtccaaggtgggcagatcacctgaggctgagagttcgagaccagcctggccaatatggcaaaaccccgtctctaccaaaaatacaaaaattagcctggcgtggtggtgcatgcctgtagtcccagctacttaggagactgagacatgagaatcacttgaatgcaggaggcggaggttgcagtgagttgagatcacaccactgcaatccagcctgggtgacagagtgagactctgtgtcaaaaagaaaagaaaaggaagggaagaggaggggaggggagggaaggggaggggaggggagggaaaatcaagcccacacataggagttaatgtaggtcctggattttccatgtactaacagcaaagaaaaaaaaaaagaattctcagtagaggatttccacttcctttctactttcacatgactgttcctatacaaatgcaccaacaattttattgaaaatggttttttttacatgtagtatatttatgtgatctctactgttggatctctctattgtgtatgtttatactgaaccaaatctttcagtgactctgttcatgcttttcactcatttcatccatttctcattatttcattattcttcccatctcaaatcagtagtaatatttctaggattttcataattcaaagagagtgaaaatattcctttcggttctcttaattaattcttcctcaggaaaaaaaaaaagttgctttagtttaaggtttttccagtctagaatgaaatgaatctcaagaaatctcaaggatctccaatgaaaggggagaacttgcacccccaccttgaaaattacttcttacgcaatgattccatccattactgatatattgtatcatgaaaatagtgtttataaaaactatgggaaattttgaaaaatgcttgttaactgcaaaagcagaattccaaagtgtttacacagatgacattaggtaggtaggtaggtaggcagatagattacacagacagacagacagacagacagacagacagatacacacacataaactcatgcatagaaaaaaatcaagaaaaaatcatcaacataattttgttgggataatatgacttgttgtcctttcttatatttctcctcatttttcaacttctttgaataatcacatggcacattcaatagttaaaaaaaatgaacatttactttgcagaatacttacacatcaggcaacaaaatatcactttcttccaaagtactgaaatttctctgaatctagccctgtagctaaacaaacctccctgacaatgtaatgttctggtttgggagtctgtctttacaaatccatcacataaacagaaccaatgacaaaaaccacatgattatctcaatagatgcagaaaaggacttcaataaaattcaacaccccttcatgctaaaaactcccagtaaactaagtattgatgtaacatatctcaaaataataagagctatttatgacaaacccatagccaatatcatactgaataggcaaaagctggaagcattccctttgaaaaccagcataagataaggattccctttctcaccactcctatgcaacacagtattggaagttctggccagggcaatcaggcaagagaaagaaataaagggtattcaaataggaagacaggaagtcaaattgtctccgtttgcagatgacatgattctatatttagaaaaccctatcatctcagcccaaaaacttaagctgataagcaacttcagcaaagtctcagggtacaaaatcaatgtgcaaaaatcacaagcattcctatacaccaataatagacaagcagagagccaaatcatgagtgaactccgattcacaactgccacaaagagaataaaatgtctaggaatacaacttacaagggatgtgaaggaccttttcaaggagaactaaaaaccactgctaaaggaaatcagagaggacacaaacaaatggaaaaacgttccatgctcatggataggaagaatcaatatcgtgaaaatagccatactgcccaaagtaatttatagagtcaatgctattcccatcaagctaccattgaatttcttcacagaattagaaaaaactactttaaatttcatatggaaccacaaaagagcctgcgtagccaggacaatcctaagcaaaaagaacaaagctggaggcatcacgctacctgacttcaaactatactacaaggctacagtaaccaaaacagcagggtactcgtaccaaaccagatatacagaccaatggaacagaacagaggcctcagaaataacgccacacatctacaaccacctgatcttcaacaagcctgaaaaaaacaagcaatggggaaaggattttctattcaataaatggtgctgggaaaactggctagccataggcagaaaactgaaactgaacccctttcttacatcttatacaaaaattaactcaagatggattaaagacttaaatgtaaaacctaaaaccataaaaaccctagaagaaaacttagtcaataccattcaggacatagacatgggcaaagacttcatgactaaaacaccagaaccaatggcaacaaaagccaaaattgacaaataggatctaattaaactaaagagcttctgcacagcaaaagaagctatcatcggagtgaacaggcaacctacagaatgagagaaaatttttgcaatctatccatctgacaagggctaatatccagaatctacaagaacttaaacaaatttacaagaaaaaaaaacaaacaaccccatcaaaaagtgggtaaaggataggaaaagatacttctcaaaagaagacatttatgtggccaaaaaacacatgagagaaagctcatcatcactggtcattagagaaatgcaaatcaaaactacaatgagataccacctcatgacagttagaatggcaatcattaaaaagtcaggaaataacagatatgggtgaggatgtggagaaataggtacacttttacaccattggtgggagtgtaaattagttcaaccattgtggaagacagtgcagcaattcctcaatgatataaaaccagaaataccatttgagccagcaatcccattaccaggcatatacctaaagtattataaatcattccactatgacgacacacatggatgtttattgtagcactatttacaatagcaaagacttggaaccaacccaaatgcccatcaatgatagactggataaagaaaatgtggcacatatacaccatggaatactatgcagccataaaaaaatgagttcttgtcctttgcagggacatggatgaagctggaaaccatcattctcagcaaactaacacaggaacagaaaaccaaacaccacacatgttctcactcataaatgggagttgaacaatgagaacacatggacctggggaggggaacatcacacactggggcctttcaggggttgggggaaaaagggagggagagcatgaggacaaatacctaatgcatgcagggcttaaaacctagatgatgggttgataggtgcagcaaaccaccatggcacatgtctacctatgaaacaaacctgcactttctgcacatgtatcccagaacttaaagtaagatttaaaaaaaaaaacaaaacaaagcaaaacaaatatacataaacatagatacacacttaatacaatcaggtaggcatatactgagtgatttttaatgtaaattaaatcacatcaatatttgtttaaaatcctccaatagcctctcttttgaattgaaataagtcagaactctttacctagatgtacaaagtccaatacaatttagctcctaaccacctctttgacctcaatccctaatgctttccataactcactctagggcagctcctttggcttcatttgtgcttctttctgcctaatagagattttctgatggctgaccccttcctgtcattaggtatcaactcaaacatcaccttcccagggaggcctccatttactacacagtctagtctgtcatccatttcttttccccagcactgtttccatcacctttaaaagcttttgtatgtataaggacaaaacactgctgaaagaaattatagatgacataaccaaatggaaaaccattccatgttcatggattgaaagaatcaacatcttaaaatctctatactgcgttttttccccaacagggttgattagaggcttttagcacgcctcagtaacttggaagtagcataaaaatagtgcataaaaatcaactctggggactttaattcaagaaggaaaatgggaatcctcagcattcgtgaaggacacccaagatccctgggaggagaatgctggccaacagcttccatgacagcatctggctgacaaaaatgagtgaagccccagtatgtgagagaggcagagaacttcccactgtaactcatctttccactgaggattggagcaaccccaactgagaaagagcactttgtttctcccaagccttggaaataacttgggaaggggcttagagacattgtgagcgcaagacaccaggaaatactgcagacattttcccagacccaggactgagagcaggattctgtttttaattcgagtgcatactaagtcaagcttttctttgtgactcagcagcatagccatgcaggcattttagtctcaggccggagattggaatggctgctctggaacaggctaggaatctccataaccagagctgtgaaaagcacctcagtagtcggcactggaattgtactctaccctgtcacaaccctgtggtagaaggagagctgctacagctgcagtttctcctgggtgatgatacttgcagacagggctggcttggtgacctgctgtgtgtgtgccattgttgggtgctccagcctgctcccctgagttcatggtgcagcaggaccctctctgcctcatacccaggcagaaattcaggcattcagagcacaccctcacatggacccacagcctgagccaccccacccttcatgagtatagatcatgatgcatcaggaccctctccacaccatgcccaggcagatttccaggtattcagagcaccccctcactcacctgaatcagcagcctgagccaccctacccttcctgtgcatagacttagatacagtggggccctctctattcctaatgtggccagacctccaggcatttagagcaccgattcacatgaaacagcagcctgagacaccctagtcttcctgcgcatagatctgggtacaggaggctctctctgcttcacacccaggcagatctccaggcattcacctggttcagcagcctgaaccttcccacccttcctgggcatagattgtggtgcagcacggctctctctactcacgtccaggcaggtctccagacataaaggatacctgctcaccgagatcagcagactgacatgttctgtgcttcctgtgcacagatcctggtgcaggaggccctctgcttcatgcccaggcagatttctaggcattctgagaacctattctcctagattaggagtttaggctgccctcatccccctgcagagaacttggggctgaggaggtttcccaactccacacctaggcccatttctgggtgcttggaggccacccactggattcttgcttggcactggtacctgtgcctgccattggaggacctgttggcagacctgcctgttccagtaccatctatcttacccctctagagctgaggagggagctcagaccactgtgcactccacacattcacccattgcctaagacaaaagagagcttctcccagtaaacagggatcaagtatacacccagctacggtggcctcagctggctgttacctataagcgccatctactggcttgtaggttgaactgcacagcccaatataaaccctgccaacagaagagcacagggctgtagaagcaaagccaaaacaccctacccagtattctctacagtcacaccccttagggagatgggaaagggaaaaggacattttgaaaataatattacagagaaaaaaagaagagaaaatcctagatgcatgagaataattacaaaaatttgaagtgccagcatctccagatgagaaagattctggcaccatgaaaaatctgaatgtagtgacaccaccaaaggatcacactagctctccagcaatggtccctagccaaaatggaaactcaaaagtgacagataaagaatttaaagcattgattgcaaagaagctcaacaaaatccaaaacaaagttgaaaatcaacacaaataaacttctaaagcaatccaaaaaatggaggaatagataaacatctttaaaagaaatcaatcagagcatttggaattgagaaatttgaaattgaaaggaattgaaatactttcaagagaaaatttcaaaatacaattgaaagcttcaccaattgactcgaccaagctgaagaaagaatttcagagcctgaagactggtcttttgcactaacccagttagacaaaaacaaagaaaagagaattttaaaaaatgaacaaagtcttcaagaaagataagattatgtaaagtgaccaaacccatgaattattggcattgatgagagagaaagagaaaaagtaaacaatgtgaaaacatatttaagggaataactcaagaaaattaccctaatcttgctagagaggtagacatctggatagaagaaacccagagaacacctgcaagatactatacaaaatgaacatcatcaaggcatatagtcaccagcctgtccaaagtcaacactaaagaaaaaatcttaaaggcaaatagtcagatcacatacaaagggaaccccatcaagctaacatagacatttcagttgaaaccttacaagccagtagagatacaggcctattttcaacattcttaaagaaaagaaattccaaccaagaatttaatatcctgccatactaagcttcataagcaaaaaagaaataaaacctcttccagacaagcaagcactaatggaatttattaccactagaccaaccttacaagacatccttaaggaagttctaaacatggaaatgaaagaacaatacctgctaccacaaaagcacactaaggtacatagcctttagaccctaaaaagcaagcacacaatagaaactacaaagcaaccagctaattatttcacaataagatccaaacctcacataccaatattagtattgaatatatattgtctaaataccccccacttaaaatcacagagaggcaaattggaaaaaaaaaaaaaaaacaagacccatctgtctgctatcttcaagagagacatcttacacataacaccacccataagctcaaggtaaagggttagagaaagatctaccatgcaaacagaaaatgaaaaagagcaagggtcactgtctttatatcaaataaaaaagactttaaaccaacaacagtagaaaaggagaaagaagggcattacatagtgataaagggttcaattcatgagaagacttaactatcctagatatatacacacccaacattgaagcatctggattcataaaacaagtatttctagagctacaaaaagacttagacagccacacaatgaaaatagtggaggacttcaatatcccactgacagcattagacagatcattgaggcagaaaacaaagaaattctggacttcaatttgacacttgactaattggatctaatatgcttctaaagaatactccacccatgaaccacagaatatacattctacctgtctacacatggaacttactccaagatcaaccacatgcttgaccagaaggcaaatatcaataaaaacaaaaatttgaaatcataccaaccatacccatggaccagagtggaacaaaaataaaaattattataatgatctcttaaaaccacacaattacatgaaaattaaataactttctgctgaattacttttgggtaaataacaaaaagcagaaatcaaaaaattttcctgaaataaaaacagacacaacataccaaaatctctgggatgcagcaaaagcactgttagtaggaaagtttatagcactaattgcctacttcaaaaagttaaaaagatctcaaattaacaatgtaatatcacaccaagaggaactacaaaacaagaacaagctaacctcaaaggtagcagaaaacaagaaataactaaaatcagaacagaatgaaataaaagtgagaccccaaaagtcataaaaataatcaatgaaaccaaaaattgtttttgtaaaggataaaggataaaaaaatcaatatactgctaaacagattaacaaaaacaaagagaagaacacaatgagaaatgacaaaggtgacatacaactgatcccacagaaatacaaaagatcctcagagactgttatgaacagttatgtgcatacaggtgtatgcacataaactagaaaatctagaggaaactgacaaattcctagaaacacacaacctcccaaaattgaatcaggaagaaactgaaaccctaaacagaacaatatgaagttccaaaactgaatcagtaagaaaaaacttacccaccaaaaaagccctggaccaggtggattcacacctaaattctaccagacatgcaaggaagagccagtaccaattctactgaaactattccaaaaactcaaaaaggaacactgctgcctatctctttctatgaaaccagtatcaccatgataccaaaacctgtcaaagacacaacaataacataaaagtaaaaactacaggccaatatccttgccaaacatagatgtaaaaatgctcaacaaaatactagcaaactgaattcacctgcacatcaaaaagcattttaccatgatcacacagacttcattcctgggatgcaaagttggctcaatatatataaatcaataattgtaattcaccacacaaacagaattaaagacaaaaaccatatggtcatctcaatagatgcagaaaaagcattcaataaaatctaacatctcttcatgattaaaaaaaaatccatcaaaaaactaggcatcaaaggaagctaccttaaaataatgagtcatctataacaaacccacagctaacatcattctgaacagggaaaaaattgaagcattttccttgagaactggaatcatacaataatggtcactctcaccacccctattcaacatagtactggatgacctagccagagaaatcaggcaagagaaagatacaaagggcacccaaataggaaaagaagtcaaactctcttcttactgacgatatgatcctatacctagaataccctaaagactctgccaataggctcatggaactgataaacggctgacaaagtttcagaatatgaaattaacatataaaacttactagcatttctataaaccaataacatttggctcttatctgagagccatatcaagaatgaaaccccttttacaatggtcaccaaaaaataaaatacctaggaatacatctaaccaaggaggtgaaagatctctattaggaaaactataaaacactgcctaaagaaatcatagatgacacaaacaaatggaaaaacattccacgctcatggattggaagaatcaatatcattaaaatgtccatactgcccaaagcaatctacattttcaacgtgatttctaccaaactaccaacattatttttcacagaactagaaaaaaactactctaaaattcacatggaaccaaaaatgaggctgaatagccaaagcaatcctaagaaaaaagaacaaagttggatacatcttattacccaacgttgaactatgctataaggctatagtaaccaaaacagcatggtactcttacaaaaatagacatataaaccaagggaacagaatacagaaccctgaaataaagccacacatctacagtcatctgattcttgacaaatcaacaaaaataagcaagggtgaaagctcctcttattcaataaatggtgctggaaaaattggctagccatgtgcaaaagattaaaactggaaccctacttttcaccataaaacaaattaacccaaaatggattaaagacttaaacgtaagacctctaattgtcaaaatcctagaagaaaagctgggaaactactttttagacatcagccttgacaaagagtttatggcaatatcctcaaaagcaattgcaacaaaaacaaaagttgacaattgagacctaattaaagagcttctgcagggcaaaagaaaactatcaacagagcgaacagacaacctacaaaatgggagaaaatattcacaaactatgcctctgacaaaggactaatatctagaatctataaggaacttaaatcaacaagcaaaaagcaaataaccccattaaaaagtgggcaaaggagatgaaaagacacttctcaaaggaatgcatacaagtagccaacaaacatgaaaacaaaaatgctcaacatcactaatcatcagagaaatgcaaatcaaaaccacaataaaatactaactcataccagtcagaatggctattgttagaaagtcaaaaaatagcagaagttgatgaggctgaggaataaagggaatgcttatacactgtatgaatgtaaactacttctgccactgtgggaaacagttgggagagttctcaaagaactaaaaatagagctaccattcaacccagcaatcccattattgggtatataccaaaaggaaaataaattgctcgaccaaaaagaaacctgcgctcatatgtttatcacagcactattcacaacactgaaaacatggaatcaacccaggtgcctatcaatggtaaatttgataaataaaatgtgatacatatataccatgggatactatgcagccataaaaaaaagaataaaatcatgtcctttgcagaaacatggatgcagctggaagtcattattctaagcaaattaatgcagaaacagaaaaccaaatgtcacctcttctcataaagcgggagttaaatcttgggtacacatgaacaaaaacatgggaacagcagacactggggagggaaggagagaggtgggtaaaggctgaaaaacttcctactggttgctatgtttactatatgggtgataggatcaatcatatcccaaacctcaatttcacacaatatattcttgtagcaaatctgcacatgtaccccgactctaaaataaaaatagaaattttaaaaaaactgtacatagcacctatcattatcaagtctccttgcttatttctttacttgccattgtttgtctccactcctagaatgcaaaatttatatcactgcatccttcttacttaaaacagtgtctgatacatagcaagagaacaataaataaacattaaaggaatagcaactgaagaaagacagtgataagaatagtagttgtccatgatacaaatgttggttttaggattctctttaaaaacatacatagctgatttccagtcttaccaacttcatgataacaatgcagctggtgtaacttaatatatgcaaataaatataaatacttctggaaaaagtcaagaagtaaagaaaacgttcacaggagaggatgagaatatagaggttttgcttatcacagagagtagtaagaaaagaaatggaaattgagtccaatgagagtaataaaagggtaatgatagtagagaattggtttctagtggtggctgaggtataataggattagtccagaaagtctccttgtggaacatgggcacttggttctatgctttggtctgccacacatcaggcatcttcttagatagccccccaaggaatggctgaaactagggcatctgtgatcatcaactaaaagatacctaaatctttctatgaggtgtatgagactgctatattgactatatggtgatctgttttcttctatatcaaaatgaaatgctctaacctgagaaaaacaggttacatgaagaactaaaacatatagtttttagttttctgggctaaatatatgttgcaaaaatacaaaaccatttaagagcaaattacaaatttaattatcacaaaacaaccagcccctaaaatatcaccttttcaatatattttaagtagccagcggtccaccattgccatgaaaaatggtacatcaaaggtatttaacatgctgtaatttattctccacttccaggtgacaatgacaaattgctcaagttccctccttgttctttgcatcatcactacatgtttgaaaaatcgatatatcacttgcaaccaaggattacaaatgcagcccacatcctttcactttcttttttctttccccatctatcagagcatttccctctaatcattgcttacctgttctttcctctccatctttacttgttctctccctgagaccatattccatcttcttcatgaccaccccaatcttttacctcacactcaacaaagcaattctttacccacctttataataggtcaagctgctagccatgaggaggccacagggcctgactggcatacattggggcgaatggaaaaccatcctgggaatctagggtttggtaaggagcaagatatcaggaaagaggcatatgagaaagaagaccatggacagggcctgagcagcactagaccgcagggtcaatcagagaggtcaggtgtattatgatccgaaggcacataaacacaccagaaataaagaacaaggttggtgatgtctttcatctttctatgattgtttctcccttctattataaaatatgcactggccattcaaaggatataataaaataatagacaccactttcccttttctctcacaaattcccttataatccctgataattttacatgctttcagaatgttagcgcctgataagtaaaacaaaatttcagtttggccacagactcaaagcaagaaataggactccttgaagttgatttgaaataaatatagctatatttttgctgctatagcaactataaaatagaactatttattgacatatgcagaaaacaacataacattttattaatacacaattgagatgttctttacctttttatgtttacttattaatgggttattagtcattattagaacatttacatgatagagtagtaattaaaacaaaaagagaaattgaatgcatcctttagctataataaaggctaatgtttattatgtgccaggttttctgttaggcacttgacaattatcagttcatttaatcctcacaaagcaatgtagtattggaattatcctcattttacagatggggaaatggagggcgattcagagaaattgagcatattgttaataagtgatacagtcagaattagtacccagactgccaaacaactcacatttgccaaaaagcaaagatgctttttacactattccagcatatctccctacaatgacaccaaaggaaacttcagaattcaacaaacatagcctgagggcctgcggcatgcaatgcacacagcagagtgtgctggagatcataaacatttgtcagaaacaaatgttatcatctaaaagaagagataaaacatgtatataaacagctataataaaaggcagaaagccacagttatcaaaaagaaattctttgcatgttaagagaaagggggttatttctggtggagaggattaaataagactttaggaaggaaatggaccttaaagtttataaaattaatagttttgcaccaactacttgctcactgacattaggaagaagtacccatctcgcattccacaaagaacgtacagtcatgtatcatttaaggatgaggatacattttgagaaatgtggcattaggtgatttcatcgttgtatcagcatcactgagtacacttacacaaacctaaatggtacagcctactacacacctaggttatggtatggcctattgctcctaggctacaaacctgcacagaatgttactacactgaatactgtagacgattgtctacagtattaaccatttgcatgtctaaacaggggaaaggtgcagtaaaaatacatcattataatcttatgagcccaccatcatatacacagcacttcattgactgaaaggtaattaggcagttcctgaccacgtctcatttagaaattagtttctaaaaatccagagtggttctacaccaatcctaatctggtttctgtttctaagaaatgtgtttaagttaaacatctaaaaaaaatttctgtgaaattttgagctttgagcttaaaagtctgaaaacttacactctggattctggttacatgtgaaaaatactttttaaattattgtccacagcattgttgccttttttctaagctttcgtttttctgtacaggataaaacattttctcatctgaaaatatttccaaatagacccttattgccttaatctgttttgtgttgctattagtataacagaatacttcagactgggtaatttattcaaaaattagagatttatttggctcacagttctggaggatgggacatccaaagtcaaggggtcccaatcttgtgagggccttcttgctgtgttatcccatggtggaaagcatcacaatggtgagagagcaagagcagagggagccaaacttactttgtatcaggaatccattcctgcaataatagcattaatccattcatgagggcagagcccttgtaacctaatcacctcttaatggtcccacctcttaatacttaatgggtaggacattcaaatattagtacatattaatgtggatcttattatcagtattaggattctaatttatttattttgtagacctgaggtcagccaacttcaacaaaaatccatcctaccacttgcttttatgagatcttattgaaacacagctatgtccgttcattttcatattatctatggctcatgatacaatagcagaactaagcaatgtgacagaggccatatagcactcaaaacccaaaatagttaccatctaaccttttacagagttgcagacctttgccatagaccatccattcactcagcaagtatttattaagagcttataagggcaggtggctggtaggtagctagcataggttgttggctgaaaaactgtagcctcattaaactaagttaaaagttaattcatactgaattgtattcttcaatataattatcttcacatacgagaaaaaaacttgaacaacttttcctgtggaaaaaaatgtactaagtgacttggaatgtaatattactaggaggtactctactattactacttacactattgagtaacacttattgagcatttactgtgtgctcaacactattataaacacttaatataaatagtatatgtcattattcctcactacacctctaggatgtaagtgctgttactatcctcactttacaaatggtgaaattaagactcaaaccaattaatttctgaggtcacacagcttatatttgttaaagctgggactttatagaagatgctttcattcttggagatattaaaataagagagtggataacttattaaaaaggtaaaatggtgtacctttttaaggggagcaaaatataaataactaccatttactgagagcctactatagttctgtcattatgctatgtgctttaaaaacattctctaatttttatatcaacccttcaaggtaggtataagttccctcttttacaagcaatgaaaaaataataggttatatgactgacaaaaggtacataccttgtaagttgcaaaactaaggttaaaatttagatctacctgtcttgttctagaatacatgctaaattctattttttaaaaaatcctaggtgtatttttctaattcttgaaactgaactgcacttacaaatgaaagcaacagatgttcagcagctgaacaatgaaatatcagataggacaaataatgaaaatataacctacacaactaaaatagcagagaaaaatatagaaatatgaagcatatttctatatgtaaatacagaatttgttcctaatggtagccaggattcaaatcagaataagctacaatagaaatttctgaaggcactaaaataatctgaaatctcattaattcattctctaataaagcactgatgcattgacacttagcagatatctctgttgtaatcagttatccccgtttccatgggagaaggggactggtcaacccatttccatatttttgctgaagaaacatctaaagatgtgaacaatacccttctcttagatatgattgaataataaagaaaaaaaaagaggggactctgggctttaggaccaaagagaaataagttggtatattcacctctgctgcttcataactgtgtcaccacaacaagctaattgacttctctgtaactgagttttctcatttaaaaggatgtttatgagagatgctgtagaaaagcatcaggcatgccctcttaaaacacatctaagggaattattattctttcagttgtaatcacttttctcaaggaagatctttaagagaaaatattttctcacttattccctttcctagtggggagtaacaggagcaagactcactgtgtgatgccccgcgttgccttgggactctacagcacgtccttaccagcaagaaggctctcaccagctctggccccttgacctttgatatgtttggctgtctctccacccaaatctcatcttgaattgtagttcctacaattcccatgtgtcatgggagggacccagtgggaggtaattgaatcatgggagcgggtctttcccatgcttttctcatgatagtgaataagtctcaagagagctgatggctttataaaggggagttctcctgtacatgctctcttgcctcatgtctcatgtaagacatgactttgctcctcattcgccctccaccttgattgtgaggcctccccagccatgtggaactatgagtcaattaaacctctctcctttataaattacccagtctcgggtatgtctttattagcagtgagggaacaaacttatccaatcttggacttctcagcctccagaaccataaaatacaaatttattttctttataaattccccagtttcaggtattctgttataagtaacagaaaatgaattaatacagaaaattgttaccgagaagtggagtgttgctgataatgaataactaaaattgtggaagcagctttggaactagataatgggcagaagctggaagaatttggaggagcaggctagaaaaagcctagattctggtgagggtttagaagacaagacaactagggaaagtttggaagtccttagagattggttaagtagtcatgaccagagtgctgatagaaatatgcacagtaaaggccatttcgatgaggtttcaaatgtaactgaggaacaagggagtggaaaccagagcaaaggtcattcttgtcataaatgggcaaagaacttggctgaactatgttaatgctgagggctttggggaaggcaaaaatcaacagtgatgaactagagtatgtggcagaagaaatttctaagtaaaacataaaagttgctgcatggttacttttggctgcttacactgagaattgaaagcaaataataacttaaagaaagaatttataatcaagagagaaggagaattgaaagatttggaaaatgctcagcctaaccacataaagaatgaaaaaatgtgttcaggagaggaaaccaagggtgtagcccagtgaccacttgcaaaagagattactacacacaaaagggagccaggtgctattcctcaagaaaatggaagaaagacccagaaagcatttcagaaatcttcaaggctctcccatcacaggctcaaaggctgaggagagtagagtggtttcacgggacaggcctggggtgctcattgcccaggtccaacttgtgactttgctccccacacccttgcatggtgctccatggttgccccagccatggcttaagtggtcccaggtgcagatcatgccacagttcctgatggtacaagtcataaactatagcaacatccatataatgttaattctgtaggcttgcagaaaacaagagctgtggaggcttggcagcctccacccagatttcaaagaatgtcatcaaaagcctggggtctcaggcacagacttgttacaggaaaggagtgaccacagacagcccctgctagagcaagaaaaagtggaaatgtggggttggagctgctgcagagaatcctcactgcatagggcagtacctagtggagccataggagcaaaaccaccaccaaaatgccagaactatacagctgccagcatgcaatcctagtcgaggagagctgaagcatgagctaagcccaggaaagccacaaaggcagggtttttcaaggccttggggacttaacccccacatcagtttgtgcagaatgctagtcatggagtcaaaggagattattcctcacccttagatttaatgtctgccctcttgggtttcagacttgtttggggcctgttactcctttcttttggcctgtgtcttccttttctttctatatatatatatatatatatatatatatatatatatatattttaattatactttaagttctagggtacatgtgcacaatgtgcaggtttgttacatatgtatacatgtgccatgttggtgtcctgcacccagtaactcgtcatttacatcaggtatatctcctaatgctatccctcccccctccccccaccccaccacaggccccagtgtgtgatgttccccttcctgtgtccaagtgttctcattgttcaacttccacctatgagtgagaacatgccatgtttggtttttgtccttgcaatagtttgctgagaatgatggtttccagcttcatccatgtccctacaaaggacatgaactcatcattttttatgtctgcatagtattccatggtgtatatgtgccacattttcttaatccagtctatcattgttggacatttgggttggttccaagtctttgctattgtgaatagtgccgcaataaacatacgtgtgcatgtgtctgtactacaaggctacagtaactaaaacagcatggtactggtaccaaaacagagatacagaccaacggaacagaacagagccctcagaaataataccacacatctacaactatctgatctttgacaagcctgacaaaaacaagaaatggggaaaggattccctatttaataaatggtgctgggaaaactggctagccatatatagaaagctgaaactggatcccttccttacaccttatacaaaaattaattcgagatggattaaagacttaaatgttagacctaaaaccataaaaatcctagaagaaaacctaggcaataccattcaggacataggcatgggcaaggacttcatgtctaaaacaccaaaagcaatggcaataaaagccaaaattgacaaatgggatctaattaaactaaagagcttctgcacagcaaaagaaactaccatcagagtgaacaggcaacctaaagaatgggagaaaaattttgcaatctactcatctgacaaagggctaatatctagaatctacaaagaactcaaacaaatttacaagaaaaaaacaaccccatcaacaagtgggcgaaggatatgaacagacacttctcaaaagaagacatttatgaagccaacagacactgtgtcttccttttctaatggaaatgtctaccatatgcctgtataacaccactgtatcttgaatgtaggtagcttgttttgatatcatgagactatgaattttggacatttgggttggtgctggaacaagttaagaatttggggctatgatgtggaagaaatggatttttatgtgagaaggacatcagttttggagggccagaagcaatatactatggtttgaatattttcccatttcaaaactcatgttgaaatttaatctccaatgtggcagtattgagagaagaggcatttaagaggtgttgggtcatgagaacagagccctcatgaatggattaatacattcatcaattaatagatgaatgagttaatggattaatgggctatcatgggagtgggactggtggctttataagaagaggaagagagacctgagagagcacattcagccccctcaccatgtgaggccctgcaccaccttgggtctctacagagttctcagaaggctctcaccagatgtagccccttgaccttggacttctcaacctcagaactataaaaaatatattacttttctttataaattacccagtttcaagtgttctgatataaacaacagaaaataggctaatatatctatttaatgcataaaaagagacttgaaaacagaaatttataccatgtccctgagtaaaatattaaatgttgtaaaatgctaattttatcctaaataatctctaaatttgctattcttccaatcaaaatctcaacaggtaaaatctaaaactgtaaaactcttagaagaaagcagaaaagctttatgacattggatttggcaatgattgctgggttataataacactaaaagcacaagcaacaaaagtaaaaattagataaattggactacatcaacctttaaaactgtgcgtcaaggggacacaatcaacagagtaaaaaggcaatctatgaaatgggagaaaatactcttaaatcacgtatataaagtgattaatatccagaatatataagaaactcctacaactcaacaaaataacccagttaaaaaatagaaaaaagacttgaatagacacttttccagagaagatatacaaatggtcaacaagcacatgaaaagatgcccaacatcactaatcattagggaaatgcaaatcaaaaccacaaagagatgttacttcacaaccatcaggatggctactatcaaaaaagctaagtaagtgttggctaggatgtgaagaaattggaatccttgtgtatcattggtggaaatttaaaatgatgcagccactatggaaaacagcactgcagttcctcttaaaattagaaatagaattaccataagatccagcaactttactgcttggtatgcatccaaaagaattaaaaacagaatcaaagagatatttccaaacccatattatagaagcatttttcacaacagccaaaaggtggaggcaacctaagtgttcactgacaaatgaatggatcaacaaaatatggtatatacacacaatggaatattattcagccttaaaaagaaaaatcgtgtcatatgccacaacatagatgaatcttgagaacattatgctaagtgaaataagccagtcacaaaaagataaatattgtatgattccacttagttgaggtatctagagtagtcaaattcctagaaataaaaagtagaatggtggttgccattgacagatagggggaggaataaatagaaagttttgtttaatgggtacagagtttcagatttccataataaaaaaactttggagactgattagacaataacatgaatacaattaccactattgaactgtacactttaaaaatagttaatatggaaaattctatgttacgtgtatcttcacaattttttttaaagttcagtagggtaattatgcaaatgtaacatttaaaatcaatagaggaagctggattattcgataaatgatgctaggacaactgatcattaatttgggggtaggaaggaaccatagataaattataaatctgaaaataaataaaactatacgaagaaaataaggtaaaatattttataattgtggggctggtcaaggtcagcctaagcaagatacaaaatccagaagctttaagtaaatacacagatagaacacttcataaaaattaaaacttttacaccacaaaaaaaagataaataccaagaaacaggctggaaaaatacttttaaaatatttttaacagacaaagtctgttaaatatatttgatctagaatatacagtctagaatatagaattctgtttggtctagaatatacagtcaattcttgctttcacagtaattttattcaataaagccaccatgaacaccaagttagtaaatactaaatcattgctcctaagagaatgcaggtttagattcctggagcctctggtcacaatatttttatcaactgatcaatacaaaatcttgttttgtatatgcttctgtttaaagacaacttatttaacatatattgttgatttattaacattgaactcacagccatgagttccacaatataactcatacctcagtgaagcttatctgacacatagattttctccataagctacatcactagtgtttcttatgcctctagaaacactagaaagtacttcagcactacactggaggccattttaaacagtgaaatgcccaaggaaaaccagaaaattttttttaaaaaactggcactaaatagaatatgaaaaggacacttgtttcttgtttacagtatgagaactgaaacaagaaggcagagtgttgtcttgttcaacctcaactgggactcaactgggaacatgtgcaattttccactgctctgtgcacgtccatgaatgagaagaaccatgaaaacaaagaaccatttatgattacaaattttagcaaataagtgaatttccaaatatggcatccactagtaataagaatttaatgttttaaaatacacttcaaaatcaattctttgaaaaatataagaagtaaaaataatttgattcacatgagaaaaaatacaattgcctcaaaaatctaaagggaaacaaaagttccttctcactaataatcaggaaaatgtgacttcagtcaacagtgatgatgatggccgggtgtggtggctcacacctgtaatccttgcactttgggaggccaaggtgggtggatcatttgaggtcaggagttcaagatcagcctgaccaacatagtgaaaccctgtctctactaaaaatacaaaaaagaaaattagctgggcatgttggcacatgcctgtagtcccagctactcaggaggctgaggcaggagaatcactttaacctgggaggcggagtttgccaagatcgtgccactgcactccagcttgggcagcaaagtgagactccatctcagaaaatagtaataataataattgatacctctgatatggtttggctgtgtccccacccaaatctcatattggattatagttcccataatccccatgtgtgatggttaatactgaatgtcaactcgattggattgaaggatgcaaagtattgatcctgggtgtgtctgtgagggtgttgccaaaggagattaacatttgagtcagtgagctgggaaaggcagacccacccttaatctgggcaggcgcaatctaatcagctgccagtgcagctaggataaaagcaggcagaagaacgtgaaaagaatatgctggcttagcctcccagcctacatttttctttcatgctggatgcttcctgccctcaaacatcagacttcaagttcttcagctttgggattcagactggattccttgctcctcagcttgcagcctattgtggggccttgtgatcatgtgagtttaacactccttaataaactcccctttctatatatatataatatatatataatatatatatacacacacatacacatacacggagagagagagagagacataaagagagaaaaaaagagagagagatcctgttagttctgtccctctagacaaccctaatacaccatgtgtcatgggagggacctggtgggaggtaattaaatcacggggatggttacccccatcctgcttttctctgacagtgagtgagttctcatgagatctgatggtttataagggtatttttccccctttgcttggcacttctttctcctgctgccatgtgaagaagaacatatttgtttccctttctgccacgaactaatatagtaaattggtaacacagagagtgggggactgctataaagacacacgaaaatgtgaaagcgactttggaactgggtaaccggcagaggttggaacagtttcgagggcccagaagacaggaaaatgtgggaaagtctgcaacttcctagagacttgagggctcagaagacaggaagatatggggaagtttggagcttcctagagacttgctgaatggctttggtcaaaatgttgatagtgatggacaatgaagtccaggctgaggtgtctcagatggagatgaggaacttgttgggaactgcaataaaggtgattcttgctatgctttagcaaagagactggtagcattttgctcctgtcctagagatttgtagaactttgaatgtgagagagatgatttagggtatctggtggaagaaatttctaagcagcaaagcattcaagaggaaagagagcataaaagtttagaatatttgcagcctgacaatgtggtagaagagaaaaacccattttctggggagaaatcaagtgactgcagaaattcacataagtcacaaggaaccaaatgttaatcaccaagacaatggggaaaatgtcttcagggcatgtcagagacattcacagcagcccctccaatcacaggtcctgagacctaggagggaaaatacggtttcctgagctgggtccagggtcccccgtgctgcctcacaacttggcgccctgcatcccagccactccagccctggtctaaaaggtgccaaggtacagctcgggccatatcttcagagggtgcaagccccaagccttggtggcttccatgtggtgttggtcctgcaggtccaacagaagacaagaattgaggtttgggaacctttgcctagatttcagaggatgcatggaaatgcctggatgtccaggcagaagtttgctctaggggcagagtcctcatggagaacctctgatagggcagtgtgaaagggaaatgtggggttggagcccccaaacagagtccccactgggggactacctagtagagattgttttagaacttaaaggtttaatgactaccctattggatttcagacttgcacggggcctgtagcccctttgttttggccaatttctcccttttgaaacaggtgtatttacccagtatctgtatccccattgtatacaggaagtaactaacttgcttttgattttacaggctcataagcagaagaaacttgccttgtctcaggtaagactttggactgtggacttttgagtaaatgctgaaatgagttaagactttgggggactgctggaaaggcataattgatttgaaatgtgagaacatgatatttgggaggtaccaggggtggaatgatatggtttgcttgtgtccccaccaaaatctcatcgtggattttagttcccacaacccccacgtcatgggagggacccagttggaggcaattggatcagggacagttacccccatcctgctgttctcataatagtgaatgagttctcacgagatctgatggttttaaaaggggcatttccccctttgctcggcacttctttctcctgccgccatatgaaggatgtgtttgcttcccttcaatcttgattgtaagtttcctgaggcatccccagcccagcagagctgtgagtcaattgaacctctttcctttataaattacccagtcttgggcagttcttcatagcagagtgataacttactagaacaacctcttaacaaaaatggtcagataggctgggcatggtggctcacatctgtaatcccagcactttggtaggccaaggtgggcggactacctgaggtcagcagttcaagaccagcctggccaacacagtgaaaccccatctctactgaaaatacaaaaattagccaggagtggtggtgagcacctatcatcccagctacttgggaggccgaggcaggcgaattacttgaacccgggaggcagaggttgcagtgagccaagattgtgccactgcactccagcctgggtgagagagcaaaactccatctcaaaataaataaataacttaattaattaaaataaaataaaattagacaaaaacgatcatacaaacaattcatcccacactgtcttcagctgtccgtacttcatcctccttgtagagcaattttgatgattcaagacaagtgaatcaaaaatacctaaaatgatgttgctatggtttgagtgtccccccacaaaactcattttgaaatttaactgctattttaataatattaaaaggtgagactattaaaagataattagaccatgaggactttgccctcatgaatggataaatgtcattattcttggagtgtgtttgctatgaaaggatgagttcaaccgtctctcattctcttgacctctcttaccctctcaccttctgccttgggatgatgtaggaagaaagcccttgacagatgccagcaccctgatattagacttcccagccttcgaaactgtgagaagtaaatttcttttctttataaattatccagtcggtggtattctgttacagcagcacaaaatggactaagacaggtatggattgaaatgaaaaatgaacggatgagtgggtaggtagatggatggatgaatggatcaatggataaattggttgaatgagtaatgaatggacagatgcaagcaataacttgcaaactattctacaggaactcatggtgccataaggagtcattacgactttttacaacttatggcatttattttttcagaaaatataaaatctttattagaaaaattagatctgcttgtcataaataattcaaacaatgtttaagtatataaagcaggaagttaaagtctcccttgaatcttaagccttagaaataaccactatagctgtatactatacatacttccagattttctgagcacatacaaattaacattgcacatattagaatgcacttattatatgaagttgttttatactatacatactgccaatcctaccaaaactgacagagtgatgtctctgaaggccacaaacaaaacaatttttaaaaatgtgcgtttgtattgtaaataatttatagagaatcttgcatttatattgaaagagcttcataacaatcctacaaacaaacaggaactagcgtcctcattttaaagaagcagcagcagagggtgagttacttgcccaagattttatggccaacaaataatagtcaggccaattactttaactaaattataaagtttctcagagcagaaaccacacataattccagttttgtatcatttacagtacctggcacaaaattataaacaggtatgaggagggtatgatgtttatattgcttactgctctatgccacacatataacaaatggtcaataaacatctgtgaaacaaatggatggaaagatgtataaaagaagaggaaatgggaagagattctaaatgaactaagatacttatcaaaccatcattttttcaatttggacaataataaatacgtttagcagctcatccactccgtaagcataatacaacatgataaccaatatcattgatatcaatatcaaaatgatatcaattgaatatactctagataagagtgacatcaacaattactgatttcctctttaacagtgaaatgccatagtaaaaaatattgaacagtagacactatacacccttattgttgctaaaagaagctattccgtctatttttttaattttatatcaaatattcacatggaatttggctcaaacacaatagatatgcaaactataaaagtataaatagtccatagggactatgggaaagtataaatagtccatagaattactgtgaaatataagtgagacaaggaacgttaagtgcttatcactgcacttggaatgtggtaggtactcaataagtgttagatatcattattaacatcactattaacatcatcatcataaggctttcctaaaatgattaaaaaattgaggctttccaaaggcaaaattatagttcatttattttaaaagttataaaaataactgcacaaaacaataaaaatctagatcacacaaatgcttgacaggaaagctgaaatgcatttttctgtaaaataaatatatgtcccatcttctgcctagatgcagactacaggcatattctccttgagtgcatctatgagagatgaaatgtctactgacctaatttctgtagctattgtatctgtttcttacagccactgtaacaaaccgccacaaacttagtattatagcttaaaataacaaaatatgttttctgacagttattgggatcaaaagtttaaaagacatttcacagggctaaaattaaggtgttagcagggctggttacttctggaggctctaaaagagaatctagggggcatggtggcttatgtctgtaattccagcactttgggaggccgaggcaggtgaatcacctgaggtcaggagttcaagacaagacaggccaacatggtgaaaccccatctctactaaaaatacaaaaaattagctgggcgtggtgatgcatgcctgtaatcccagctactcaggaggctgaggcaggagaactgcttgaacccaggaggcagaggttgcagtgagccaggatggcaacagagcaagacaacatctcaaataagtaaatttataaataaataaaaataaaagagaatctgttccctgcctttttcaacttcaaggggccacctgtattccttggctcatagcctcttcctccatcttcaaagctagcaatgtaacatcttcaaatctctgctttcctcatcatatcacactataagtaccttcataattacattgggcacacattgataatccaggataatccccccccatcataagatcctttagttaacaatatatgtcccttttgtcatatacagtaacatattcataggctctacatactagaatttagacatttggggaggagcattatgctgtctttatcacagtacatcctctggacaccaaataatcacattcttccacatataaaatccattcatgccatctcaacgtcccataaatcttaacccattacacaacatcaacttaaactcaaaatctcaaaaactcaaaagtcccaaatttcctcatataaatcaagcatgagtcagacgcatctgtgaatctgtgaaactggaataaaaagttattcgctcctaaaattcaatgatatgacaagtgtagcgaaacaattatagatatccccaaccaaagagagagaaatgaaaaataaaaagtgagtcaacagtccgaagcaattcagaactgcaactgggcaaactccattaggtttcaagccctgggaataatcctttggagttctcagctctaccctctcgggcctcagtcccatcctctgagtcctcctttctattccataaaggttaacttatgtttgcaaactcagtagtttcataagcctatttcctgcctgcagaatttcaggaatccaacagccttctttcattttatcctctgtccctttaagtccaagctaccaaagtctccgctaataaaccattcatgaaaacactgtgggtctcccaggtatgtcacaagaatttcctggataatcccaactctgaatcccatctcagcgtaattcatctcatcataattcagatctgctcaatctcttcaaagagccctctgtgtggttgaataatctcagtttttgatcctcctgaggcactagaaacaagttatctagccatgctttcagctttctctctaagtacacttcttgacagtgaatctaaaaatttcagtgttttttgcaatctggatagattgagaatgttccaaccatcaagtcctggtttctttgagtttaaatgttcttctcacaatttatctctttcctcctcccacatttcagtataggcaacaagaggaaaccaggccatacctccaacactttatctagaaatctactcagcaaaatatccaagttcatcacctactagatctgctttgcacataaccatagaatataattcctctagactatctgctattatatagcaagtatctcctttcctccagttttcaataacatgtttcctatttatttctgagtccttatcagaagcacctttaacattcatatgtttattaacattctctctacaatgatttaggtattctctaagatcatacaagttctctctaccatttcccccgctttcttctgaaccctcacagtagtgactttaacatcctcgtttgtataaacattatgtttatgacaattaggtaatctctaagaaaatacaggttttctctaccatatcacttctttctgagcccttattagcggcatctttaatgtccatatttctgttcaaggcaatctaagctctttacatcatgctcctcaaaattcttctagcttctacccagtgcccaattccaaagccatttctatatttttatgcacctgttacagcagcactccacttccaggtaccaaaatgtggaatagtttcctagggctaccattacaaattaccacaaacttagttgcttataacaacacaaatttattctctcatagttctcaaggtcaaagtctaaaatgattctctctgggctaaagttaaggtattggcagggctatctccttctggaggctcacagggagaatccacttcctgttttttcagcttccagaggcctcttgcattcctttggtccatggctgcaccactctgacctctacttccatcatcacatatcttctgactctgaccctgctgcctttctcttacaaagaccactgtgattacaccggacccccaacgtaatccagataacacccccaattcagatcctaaactgaatcacatctgcaaagttcctctgccacataaggtaatatattcacaggttgtgaagattataatgtaaatatcttttgggggaattattctgtaaaccacagccatgttcattattaactgatttctgtttaaaatacttaacccatattttcaattacatagttttaagcactaacaccgctgattgcctatcttactgaactaatatcttgccatttcctcatttcaaacgttggttcttttaaaagttttgggaagacgaaatttagcaagagaataaaatcatatattgaattaaacaattcccagagcagttatacgaataatatctcgattcattgttatggttcagagtatctccaaagtatgtagtagttttgttgttgggagagagggggaaagctaaagccctatcacaaaaccgtaactattctggagttgaaagatagctcaggggtcatctccatttcaaggctgagaaaaataaggcccagagaggttaaattattaacccaatgacataaactccaacagagaggagagagtatataaatttattttaatatatctagtgactaactatatagaaatctgatttaacagcaaccacacagaaagctgctgcattttcataaaaggaatttcttaatctcaagttcaggtagttttttatttagctatctgagcttctcaagtcttgaggcaaatgctaaaaaggtagttttctaaacagctagaggaatttcagacaaaccccatcaaattcataaaaataggtatttgccagaatgctacataggatggttatcaagccaaatgaaagaggttccaccgttgtcagtctactgactggtgtggaaaatccaaacatctataggctctataagtaatgtagtttctggcttccttggagaccagcgctctaatggaactctaagacaaatatcttgtcatatatgtgtatagcaaaaaagtacttttaagaaaatcagtaaaaaaaaaaaaaaaaggcacttaaattaaattttgctgtgtccaatactaccaatcctgttatcccttatgaaaaacatcagaaccacttggacacttttaaaacgttattttactaaatgtgtatttggtttcttggttttgccaattacaagataagtaacatagacttgaagtggaagttaagatataaagactttaggaagggcagtaaaaagtgctattgatatgtgaataggcatctcaataaataaaataaaaatactccaagtatccaaaataatcaaacatttcaatatgaaaggaagaaattatgtttgcattgacttatgcaactaaagactcaagtgggctgggcacggtggctcacacctgtaatcccagcacttggggggccaaggcgggcgaatcacgaggtcaggagttcgagaccagcctgagcaatatggtgaaaccccatctctactaaaaatacaaattagccgggcgtggtggcacacgcctgtagtcccagctactaggaaagctgatgcaggagaatcacttgaacccaggaggcggaggttgcagtgagccaagatcacgccactgattccagcccgggtgacagagtgagactccatctcaaaaaaaaaaaaaaaaaaaaaaaaaaagactcaactatggctatggctctgtgtgtgtgtgtgtgtttgtgttcacatgggttatcatgtgtactgtcatttcaataaagatattataatcttattgaattgaaaatatttgcaatacctagcaaaattctttacagcttttttttttctcaatacaatctgatggtaaagaatagagcataaatgtgatgtttaaggctcttttcattccatagccagggtatgaatgtctaggtaaaactcaaaaattgcatcaacagtttgagggtgagtcaaaacataaaatttatcatggctatagaaacagaaaaaaaaaaatacattgccaataaaatagttatttcccctggtaacagaaataaatttcctaataaaaatagaagttaaaaagaaaatgaaaattatacctaagcactttaaacatttcactgaacataattccatatccacaaacacatacacgtggtcttacataaattgaatctcacctatactatgagtttgaaatcagtttttctcttattctttaagaaaaaaaaaggtcagggatatcttttcatgtcaataaataggaaaactacgtaatcatttttagggctgcagactgtcccgtcacagaagctccataatttatttaagcaatcccctattgtaagacactaatgctgtttataattttttactctacaacaaacattgataaacatcctgtaccaatctgtttaccaatttatccaattctctctttaaaataaatgtctacaactagaggagctggataaatgagtatacagagaatgtatattaaactcttgccttgcacagaaaatttacctctaacccttttgaaagcaatttgccagaatgcattaaggtccctagatggtaggttggtggcggggtagtggtctgctgagctgtggagggcggtggggctgagggtggggtggagagggcggtgcccctgctctgaggcagggactactgggtgacagagacaaaggggtgtgtgatggggcaggtcacaatgggtaggggaggataaaagtggtcctgcggggtggtttagcagcagtggatggttcaggttgggaagaagagcagtgggattgccagttaaggttgtggaatcaaagagcaaaggctgttgtgaagtggaatatcaggctcaaatggaggtccctcccgaatgagcactgacacctgtgtgcccggacatccacgagggccccaacacctgtgctcctgacagctccatgcactaagcagggcacagtctggatccaggggactgactgtctctggcattgagcggttggtaatcaataccccaccctccctgttctcagtcacttggggacaaaaaagaaagcctgcagaacacgactgctggcccacctgccagagtagccaaggaaacaggatgcccgctaaagcatgttaaggaaggtgtggagcagctgctgggaactgtcttgatttaaaggaagacatggaggactgctgtatgctaccgtattacacggcccaaagcagccccgcaatgggcatgtttaacacctccatggggaagctgcagcggcaactgtacaaaggcgagtatactatattcaggtatgcacccatgtttgagagcgactttatccagatcagcaaaagaggagaagtgattgacgtgcacaaccgtgcccgaatggtaacaatgggcatcgttcgcaccagcccctgcctcacactacctgatgtcatgctgctggcccgaccagctgctgtctgtgacaatgccaggtgtggtcctgccacccagaaaagagaaagtccgcctgcagagatcttagaactaaccaggctgcttcccttgatgtttgtgaaaataaccatccacaacagcgtaaaaaaacagctccacctgaagcttgccacgggccgctctttttatcttcagctgtgtcctccatcggatgcaagtgaagacctttttgttcactgggaaaaccttgtttacatcctgagaccaccagtggaggcttacagtgataccagggctatcctagctgggaacacattggactcatctgtgttggaggaagtgcagaggagcccagtggtgagtctatgcagagactagatggggcctggatgctttgggggagagcaggtacaggtcctgtaaagcctttggtgctgcagctcacctgggaaatgcattgcatttggaaggtctgaaggccaaatgagcttccatttggaggccatggtacattgaggaggttcctagtgcttctccagggttctccaagcctgaatttcagagatttcttagctgtcagcaactcttcattttatatccacagctgttcattttatatcaatgttgtaatgctgtccaaagcatcctgaccagtctattctgaaacacatactatgacctaggcaggctgatatgttgtaggacgtgtctccctgcaattgccacttatatacattggtggcaacacaacatgtttgtgtacttgtgcaataatttctttttgttgtttacctataggaagagaaaggagatcttgctggtctcactgtctttgcttatttgttctctccctagggatatgccatgaagttttgtgaagagaaggagcaattcagaatcagtagacttcacatgaatgctgaaatgtttgggtccacctattgtgattatacaatagagatatgaatccaacatacctcccacatatactacgttcaagagttcacacacccctgcagtcataaaacctatagtgcctgatgaaggggcagggtagcaacagcagtagtgatgacagtaagcaccaccacaggtaccatggatgtggctgcaaccaagtctgcagactcaggagagaaacacagcactggcaaaagcagccttcagaggtccaggaggaagtatagccagcatggctattagtgggtgcttccatgtcttaatcttgttatagcaagggctgcatgcacattcttgtcctaaaagggtacttcaagcatatcagtaagtgctactggcctctccctagagagcagtatgaatgtggtggctacaggagcagagagatactgagaaggctgttgcattgacagtatctctctgctactcaaaggctgactctctgctactcagcattgggagtcagttatctcaactctgcaggatgaggccacatgcgtgaatgggatggaagccagagggtctctacctagctggattgactctgcagtaataacctcaaagcccagtactacacatggtgcagaggtggacatctcacctaagactgtggaggggaacaatgtgattcaccataataaaatccatcaactcaaattatctgctctaataacatatgctctattgacaggaagggtagcaataaaactaatggcaatttatgatcaggctctgaaaactatctttaactttcccttaactttatattttttaaataaattaatagatgacagaataaaatgttgaagattactctcagatatgatcctacattaggagaattattctaaaactgttttccaaaatataaaatgagaacccaggaatacacacacacagactctctctctctctcctctctctctccaggtttgaatcacagcattgccacacattaactgtgagtttcagtagattgtttctttaaatggtcaccttgagaccatacatgtataatatctggaacatagtaggcactgtgtaaatggtagtgttgagaaacaaattctgagtttaatcatactttccagaaagggcttaattttcccagtctcttcattcttgatttcctttcttaaatcttaattaactgctttgcaattgtcccataaaagctctatttacagtaaatcttctcagtatcttccaagaattttaatcccctgacgctatttagaattctaaattttcatgaatttgtagaaatttcaatctagttacaatggaaagataattgcaaagcactcatcttttacctggttctctccaattttagtattcttggagatagaaaaataaaatgtaatataggatcaattcataatctggacaaaaactggaaattagatcattttagaattgtaagatccacatccatgggattagccaatattctaattttgcaagtaaaaagtctgctcgagtctaaagtaatacatcacatggtttgagaaccagaatgtataggtaacctggcccccaattatgtctgtattgtttccataacactcatgattctgacaagcactgtgctttgaatataaaagatatttgatacatgtttgctggatccaattaagggctataaatgtgaaatataatttattccaatcaaacaaatctggggatataaaattttacatagtactgtactaattgtacagatcccaaaggcccctgtatatattgtaaggaagcagtttaccagtagaccctcacagcgcttacgacttaatgatttttaatggcctccaaaagtgcttcagacctgaaaaaaatggtttcaaaatatgaaaaacatttcacaggttagatgttctagctttgcgaatttcaaggttacattactgagaaatcacatctaaccataaatcacttttcagcaaataatttcaaatgaaaaaatttaaaaataaaacaatttttgtttttcatgtggtacgtagcccagtatcatatgatactggagaccccctaagaagctttaaaatgaccatattgcaaactcttaacagagaccaactttatctttatattcaaggactgtcagcatgcttaccacattgtagtcccttgataatcatagaagggatcattgttaaaagcactgcacattttgtattttttctctaaatcttaatctgactcaatctctttttaaattgtatattcctttggtaaatatttcaatctgcttctgattacaaatcctgatgcttattactatcagatcctgttcctaggtcacagttttcttaaaattctaaaacaatacatatcctgttacctcatctcttgtaatcaaagtttaagagataatttagataatagatactgataataacagaaaaagatttaaaaattaccatttgtgaatggttgagaatggttgaatcctaggtaataaactaaaaaaccagatgaattaaaaaatgttgcaaattgtgtatgtgtgtatgtgtatatactatatatatgtacaaatatactatatatacacaaaaatatgctatacatattatatttttaattgcaaaacttcaaaaattctttaatatattttgcaatgaaaatgtatatatataaacatgttatatatacataaaacatgtttacatgtgtatatatatatatacacacacatatacacacacaaatataaatgctaaaggatagcccttaaacaataatattcacagacacacacacacacacattcttaagaatttatagtgagaggctgggtgcagtggctcacgcctgtaataccagcactttgggaagccgaggcgggcagatcacttgaggccaggagtttgagatgagattggccaatattgtgaaatgccgtctctactaaaaacacaaaaattagccaagcatagtggcgcacccctgtaatcccagctactcaggaagctgaggcaggagaatcgcttgaaccagggaggcagaggttgcagtgatccaagatcgtaccactgcactccagcctgggaaacagagcgagactccatctgaaaaaaaaagaaaaatttatagtgagagaaacattagtaaaatagtcttattgctggtttgttagattaaattcagttaaaaaaaaacacccaaaacctgtatctcaagtacatttatagatttaatgcagtaaaaattaaaatcccaatagagatactttttaaactcaacatagtacttacaaaatacagattttataaagcaagcaatcaagtcagctgctagttttaatttaataatggataataccaacactgagtcatgtggtttaaaaaataggaaggcagaaataaacaagccttcagaagtaaaaccaaaacaaaaggataaaaacgagaggaatatgagttattgttcaatggaaagtcataggaaaactagatatcaacaagcaaaaaataatatagagccataattgaaatttatgttaaaaggagttctaaataagatgaattaaatgaaaaataggattgagaagcttaatcaactggatagtttttttaaattacatgatgcacttgtacacatacaaattaagacaaaaagaaaagctgcagactgggaaagattttgtggtaaatgtaactagaacatctgaggaattaataaacttattgaacaataccagtcttcaccaaggaaatggccaaaggtaaagcaaacctaatattaaaaattgtagaccaaaagcaaggtactaccaagcctaaaaaataataaaatcaaatttagaaaaaagcaaatgttagtaaggtggtagaaaatcagatacaatcatattactgacagctttttgatttgcagtcatctggctaatatagtaaataccctgattattttatttcagtaattatttttaagatataaggcaaagtaatgattaggaaatgtatttttacaaatgcagttttatgaggggaaaataggttaaaacatttaattattgataaactgctaagcagttaagggtaagctaataaaatacaacttatgcttgttaattttctttccctttacccatgtagatatgaggtaaaaaactatatgtaaaaactttaagtgaagacatgacaccctagaatatacacatttgttcactgagattcattcaactattacttcattccaattatttttttttgttttacatccatcagattttgcttgataaagaagacatttttttctcttcctttctttctttctttttttttttttttttttgagacagagtctcactctatcataacccaggctggaatgcagtggtatgatcacagctcaatgcagcctcaacctcccatctcagcctcctgagtagctagggctatgggtgtgtactaccacacctggcttatttttgtattttttgtagagacaaggtctcactatgttgcccaggctggtcttgaacttctgggctcaagcaatccaccctcctcggcctcccacagtgctgagattacaggtgtgagataccacatcgaacccattcttctgatttgccaggaactacgcgttagactgcagatgctgagcatcaaaaggttgaatctctacctttatggagctcacagtttagtatgtatttacaacaattctgtaaaggttacagtaaactgtcttaaagtcctatgaagagattttttaagtactatatactgatttgaatatcctacttagctttctacaacaaattaatattgaaatttgaggggctatgatcaaattatgatacagacatgtggaagacgtgatggtttcttagacataattgtttcgtatttgtcgtgacagaagggaaaatatctttgagatgtaacacttttctggataagtactgtgatttatcttctgtcctggactgctttttccacccacgttctatgtaattaacctcttaacattataccctttcatattaagttctttgcttattgtgcagagatattttcaccatggcttcaaatttcctatctctggaatattttagtcatttctgaaactcctctaagagtgtatggttcacaacccacaacaggaacctgaaggtgatactacagatttaaagtagtcttaatgatagtgaaatgacttgaaactaatagtcaatattttagtgttctggtttcatttttggattttattccaaaacctccagaagtacacattcccattattctacaatgctccattgtgatgtgaaaaatataatcactggctatgcttttaaacagccataatatgtttccttatatctgtagacaacttttactttttaaaaatagcattctttaaactgatatatttctggattcaaaatattaaaacctcataaacaagataacttttctgcattataaccaaactaaataatactaattttttacataaattatgtcttcgcatatgtacacatatgcacaccaagttatatgcacattttacttgacactttgagaaaaaccacaagatccaaaatcacaaagtgaacaagatcctaatttgattttcgaaggggagggagattttatcttaaaaacataggcaaccatttttgttttattgtaccttaataaaagcaaacttttacctgggcaagcatggggaagccaaggttcctacatccattacacggagttaatgcttcccaaagtcctgatggcccacacgtattttcatcatcatcctcttcttccacttctcctggtgacaaattgattgtagatgaggttctctgaaattaaatttatatcataccaatatattatatcaatgatatttagatatcttaacatcaattaaattctataaatgacagtggtatatctcggcaaacaagtcagctcacttttagccacagttacatggctgtgccctgtgcctgagataaaaatatgtatagtccaacttaagttaaaagtgaaaaaaactaggtgtgaaagacttataaaataatatatgaagttcataatgaagaatagaacatgataatggcctaataaaatatttgaatagcaacaaatgagaaaaatcttatggtttatcaagaatttaggtttaggcataaaattaaggaaaaatgcagttagggcactaacaggaaaatattttattgaaatgggaactcctgataaaccagtttgttcagaatgccactgaaataaaactttataaactttcatatcatacatataacaggagtaacagttttaaaattcataatgagacttccatatttagcacatatattttccttcgttatctcccaaatctcactaaaatgatggtagaacatttataaaaatgtttacaccataaaaataaggatgacaggagagatgaacagacaatattaagaaaacttctggataatgttgagtaacttttggataacagatgggtattacctgacttagcaaacatgagaacactgaaagcaaagaaccttcatgtggaaagaattggagggactggctacctgtgaaggtgtaagtgtaggtggggcagaaacagactgaaactcagtatcagaaagaattatacccctagacccatctccttttcacccagccaggaaactaaatctttaccactggcaagaaattagaggtttaatttttgaagaagttgaagcaaaaggattatgaattctaagactacagatatactgagtctccaaaaacaagagaattaatatctatatagtaatgaagattcataacctaccccgtgccttaccatatttgcattagacaacatggcagcacggtttatattcccagataaacaactagaatactcctccctgtagaaacagacctcctaagaaaaaaggtctataaataagcaggaaaatggtgggatctatgtatcaatctctactgtgaagccaacctctcaacaagttccactcacaagaatcatatatttgagaaaaacctcttaacagacaccaaaataaatatagagaaaaaagttataaatagtatcctcagagagaagatatttatagccatgaaacaagaacagaaagttacaaaatacataaaatccaatacaagagtaagaaaaatctgagaaaatttcccaaaagatgaacagaatttaaaagtggagaaaactaggggtcaaaccaagacctctaacatctgaacaaaaggagctccaaaaattaagagtagagatgggagggtcaaagaaataaagcatgaaaatttgcagaaactgaggaaaaacttcactctaagagcctgctgaatacttagcagactcaatttaaaaaaaaagatgtatatgcataaataaaaagaaatacactaaattgtctaaaggtcctctgaatgtagcgttcagcacaacattgatagatcatgattactaaagcaagtaaatatattctacatattggattgtaaatagcatcctccccccaaaattgttccttttaaaaatagaatataagattttatttttcctcctatttaaaagaatttgttttctgcattcacattttaacttccccttgatcacttgtcagtaactaagaagcaatgaaattaagttgtcccccaatcagttgctgtctataaaatacaataataataacaactgttagactgagaacttactatgtgacttggagtatcactggcctattgtctgttaactattttaattcacacaacagccatttgaggcaaatatttttcctctcactttataaatgaggaaactaagggacagagaggccaagtaaaacccaaggtcacgaagctggcaagtggcagaaaaaggattctaacccagactagggggctgcaaaacctactctcccctcaccactacattctgtgaccactcctttggtacaataacctgtggaagacaatatactgaaaaaccacactgatgtaaataattgcagtttaaataaaagaggtatatttggtgaatacgtttctgttacacgagtaaagtcctgagagcattttgccttctgtgacagggagtgaaaatttctgcaatttgatacatagcagcccatgctttcataaatacacacttctcaaatcaataatagaaggtgattatcacagggatttttgaccctacagatcctttgagtaaaataaaaaatcttgggaaatttaaaatcttaatctgaaagagtatatatatatatatgataaagttgttcacaggaataaataaaatgatcaaaaaggtatctcctttaccagctcatgatcagctaacagtttgaccatcaacattgatgcggcacatactataaaccacctcatagttggccaagaattatcaacattttagattaatccattcttttctattttgttaatggtgctacaatgatttaatccaatcacacagggaacttcctctatctctttctcctccctcaaaaaaaaaaaaaaaaaaaaaaaaagcttatctctcttccctgctcataaagctccaattacttcccatttcacagcaaatgatatccaaattccttaatctggcttcagagttctatagtcaaatgattttttagcccttttactttttcactatactcacctcagattataaccaggtggaattgtttacccttgcctaatcatgctctatgcttttattctttctttcaccttacttgtctgcacagcgtattgtagtggttaagggcttgggctctaaaattagacagtcctgaattcaagttccaaatacccgcctcactagccgtatgattttcagcagataagaccattgtcagcctctcttgccttatctatgcaatggaaaacaatacagtggaacctctctcagggctttttcctgatgactaaatgaggtaataaatataaagtgcctgacacatacagcttcaataagtattaactatcatgtttattattttcttataatcccactgattcaaaatagagttcagatttcatcccttacctaaaattttccagatttcccacaagcatgcatgatatcatgttcttctgcttgtctctctttgtgcaaatgtttgcatttggtatttcacattcaccttgagttgatagatgctatagtggcaaagagcattggcttttaactcaaacagatatatgtttaaatcctagctctaccacttccaagctttgtgattttgagcaaatcacataatcttattaatccttagtttccctatctgaaaaaatagtgtaatcatttccacttgcagggctgtatgaagatcaaattaattgcttgacagagactggcacataaaaaatcaataagtactgctattttattttttaccataaaagagttgtgtacacacacacagtgtgcttgtgcaaatatactacacagacacaagtgtggcttatttacccttgtgaagtaagttatttgaaagaaaacattgccttattcacattgtatctcctacaatgtgttgtgcataatgaaacaataaatatttattgaatgaatcactgaataaatgagcttcaaattattattttcatttgactacctagaaaattttactaatattaaggggtgtgtataattgtatcacaaatatcaagattgccattttagctttattttatattaactattacaagtagctttgcagaaatgaagaaacttatcagtggtttagcactgccccctaaagacagcatataaattggctgtgtaaaaccataatttttaacttcatttctttacagttaaagatttgaaggaaaatattttatcaagctacatataatcttcaattatatatgggaagaagccagcggaacacacttaacctcagatggtttcatttattccaaatgctgttcaaactttttactggagaacaaactctgttcctgaagttccagaaagatgtgaaaattctactataaaaaaaaatagacctaaatctatacagtttgaacccattagctttcttggttattacacggtaataaagaaagactggaccaattctatgttgttgcaaattgaaaaacagtcacaataatatactgtagggagacaaacttgagctcaatcaaagaaaaacacttttgagaataattatattagtctaacattgaagaaatgggatttccctgtgaggcagtgtgtgttcgtgtgtgtttgtgtgtctgtgtgtgtgcatgtgtgtatgtgtaaattatatgacaactatatataacggtgcttcataatttataaaatgctttcagatagagaatagcccaataaaatagagtaagaattatccctattttacaagtgaaaaaaactgatgctcaaaatgttactcgatttgcaagatcatactacaaatcagtccagattataatccaagccctctaaatctaggtcctattgtctttctaccacaccatggaagccacctccttaattactagaactcttcaaggggacaacaaatgttcaagattgtcaatgcaaagggaccaggccaaaaggcagaatccaggaaagaggcaatatcagagatggcaatcaaagcaaaaggcaacaatctggaatgagttagcaatctagactactttatagcattgccacacgcctttttgcctttgtttagttctaaagtaaaattgctttatagatttttcaatgaaatttaaagtaatacatgcttattgtaaaacaaatcattcataatgaaaaattatacatgaaagagtgaagctttcctagcctcggtcccacattcagtgggtgtacttccagactttgtaatacttactctacttgcctgatgactttctcacgataaattcataaatgagaaattgtatacaccaaagagtatgcctacctttatctttctttttctttttcttttttttttttttttttgaggtggagtctcactctgttgtccaggctgcagtgcagtggcacaatctctgctcactgcagcctccacctcccaggttcaagtgattctcctgcctcagcctcccaagtagctgggattagaggtgcccaccatcacacctaattttttgtatttttttagtagagatggggtttcaccatgttggccaagctggtcttgaactcctgacttcaggtgatccacctgccttggcctcccaatgtgctgagattacaagcatgggccaccgtgcctggcctaaactttctaagtattgccaatgttgtctttaacctgttcacagtgatcagagaaatgttttttcatatgagaatgtgatcatgttttcctcttccttaaaaccttcaatagcttttcatgttcttctgataaagttcaaaattcttaatatgatccaaaaggctatgcatgatctgcccctacctccctctgtatcccaccactaatctggcaggccaggtctcactaacagctgaacaggaaggcctccatgacaactgtttcagcactgactgagtggttaaattaaatatttaaagctgatagagccagtgcccttatacgaaggctggaatgtaacgaaagcccaccaagagttttgcctaggcctttccagggccttgaagcatgatgaaataacaaaggaattcttaacagaacccgtttagtattaaacaggttttactgggggtctgaaggaactccccagacctccacaaacaagttttattgaggtctaaaggaactcccaaatcttcatgatttagcaggagacaagataagcgtaatcacccctggcacctggatccatctagattgagtaaatttactgaagctccagaggaaggtcttcaggactcagaccttaggtatagatgagaagaagttaatcacttatgtctttagatgaatgcacacttacatgtagacatacagcttagaaggtatataagctctggaaaactttgtaattttgagttggtctggcaatattttccctggccttctccctgtacccgtttacagaagtaaattctcttctttcccagttggtctgcatcttgttattggaccatgagaataagcaacccgacccttggtttggtccaggaacactaacactattcctctcctttgcccataatgtttaaacacactgagcttccctctttccctcaagtataccaaacttcctcttgcctcgtaccttaccttagcacatgtggttttctctggcaaagactattagtcatctcccaatatacagtcccccctcctccttttgtctttagtaacaccttcttttattcttgtatggtactaatactccaacttttagctgggcacatgtattctttgaataaataccacattgtccagtgtctgttgcagctaggtgtgaccacatggctaagtcataaccatgggatataagaagtgctcttgaagtgaataggtgtgcccttcttcctccccttcctcttcctgctgattgaatgctaatgaaatagctggagctggagcatttgtcctgggccatgaagtatccttggaactagaggacctgcacaatggaacaacaaaatagaagaatcctgggttcctcatagaggtgatccctaccagccttggactgcctagctctaagctttagaagtgggagtaaaacaaactctttctctttaagccattattattattttagatgtttttgttatttgctattgtgtcaaaccctaacaaataaattcctttgcttgtcttcatcaggattaatcttattggtgctttaggtataaatataattcacttcctttggaaggccttcttgatgctctcatcaagattaatttcctttcttatatgccttcacagtatcctgcttttctaatagcaattatcacaatgataattttatagttactgtgtgactttggttcagtatctcctatccttagtccataaaagctgcatgattgcagagatgcctgttgggttagctaccaaagcctgatacttggctagtacattgaataacagtttatcacatatgtgttgaaaatgaatgaagagtaaatgaatgaatgaatgccagcttgccctcatagatgttttattagtgtgaacattttcactagttctaagaggaaccaatgtaactataacccagattttaatgtcctttgttctctaactccatttgctcccactgtcttccttccatattcaaaataatgtagaaaacagcatctatttgatttcatgaaagaatacatttatgacaaccattggtgcacaatttacattttaccacaaactctatagcggaggtgaatgggctttaaattgcacagcttaactcctccccctcccctatcaatatttttctccttatagtaataattgggtagaagggtgcttttcatctccccttccaccaagaagaatagaattcttggtgtctatttttgcctgcagactgttttcattagctctttaaattcttctcctctttattatgcaagcaatttcacactaggatacatcttatctgcaaatttgcatagccaatctcattacacaagagatcttacatgagaactattattttgtcaatttaaaaggcaacaactatgtaatagcatgatatatcatattttcctttttacaatcttttaaaaccggggatctaagggcttaatggggcactaagaagaaaacgtgaggtgttaagctggtttacttattccaaagctatgatagtattaatgatcagatagatgataggtcagtgatcatattactcacaaaggaacagactcaaccatcttaaatttagtcctgggagagatatcacatgccacagttgaatatattagcaatgatcagaaaacctactgttaaagccacagttgaacatattagctatgatcagaaaccctactgttaaatacgtttctataagcttagtaacactaaacatctgttcaaaattttctgaaaattaccttgcaaggctaccctacactacctttcaccacaaccatttgttccatgttagtaaaattcacaaaagctgcaacatttaagtctgctgaaaaataaaatttctctaagattaatttggagttagctgtgaatcctgtactgcatttatatctgcaaggaaaagaaaggaagaagaaaaacaagtcttgatgccaatgagtacactgagtacatctcctagtatctgcactctgaaatgacgttactatgtatggtgatattttaaacttgaggatttgccagtgccaaatgtatttcacatttattgaaggacagaattgctattaaagcaattgttttagttgcaagaaatattgaacaagaaagtaaggatagtctttctctttttaatagtacatgagacattacaattcctctgaaacgcttagttccaacacattatgttcctgcctgctgtttacatatttgacatcctttgcataacatcaggaaacttcaaagaacatattttgtttgctattctacttatatacaatcaatttgaacgtttttattatctctcaaaacttttgttcatttatctgacccttacctagtaattaatactgtttattatttcaatattagaaagagctaagtctaaactgatgccaattttatgcacaatacgcagaagctaatttcaaaaaaaaatgttaaagtcaccttagaaagtttaaactttttttttttcaacaagacagtacagaaggcaaaatgtataactttgggaaaactaaattatcctccatgacagatcattttatatgaacaaataacatttttctaaaagtttacttctttgttttaaaataaaattcattaaagtcttatttatatacctaacatgaacccattttatatatttattttttgtattggtacaaatctttaatagaatttttatttaaataggggattcttatgttactttaatgcaaaatagaaagaaaacaaatgaaattttatataaaaattaaaaacctaagagtaaaaaggtagatgtatgtagaatcctccacagtcagcgtacagtatggcattttcaaaaagctgagggaaaaggagcaagaaactgagaaggaagcaaaggagaagaaaggggagagtaaagaaagaaagaaaagatgacatgcacccattttaaatgtacatacctgtgcattcaccaccacaatcaagatacagaacatttccatcaccgcaaaaggttaccttgaatccctttcctatcaatatttccctactggtagccccagaaatcttttttctgccacaatatagtagcatatacactttatgtttggcataagttttctgtaaagcttattaacactaaacatctgtttaaaattttctgaaaattaccttgcaaggctaccctgcactatcttttcaccacaaccatttgttccacgttagtaaaattcactcagcctaatgtttttgagattcattcctacttttgcatatcagtagtttattcctttttaatccaaagtaatattccattgtatggctataccaaagttttgtttatacattcatctatttatgggcatttggttgttttcagcttgcggccattacgaataaagtcgccattaacattcacattaaaatctgtgagtgcccataagtttttgtttctcttgggtaaatatcgaaaatgctaggtcacacggtaaatgcatcaaactttttaagaaactgctaaagtgttttccaaagtgtttgtaccattttacattcccattcattgtgtcggagagtttcggtagctccacattcttggcaacacttaattttagttattctaatgggtatgcatgtagagttatcgcaatagtatgtagttatcaaatggtatgtagaattatcacaataatagtacttttaatatacatttctgccagtgctactaatgtgctaaatatcttctcctgtgcttagaggccatttaccttcttctttggtgaagtacctttacacatttttattaggttgttcgacttctttttttttttttagacggagtatcactctgttgcccaggctggatggagtgcagtggcaccatctcggctcactgcaagctctgcctcccaggctcacgccattctcctgcctcagcctcccaagtagctgggactacaggcgcccaccaccacgcccggctaattttttgtatttttagtagagacggggtttcaccgtgttaaccaggatggtctcgatctcctgaccttgtgatccgcccgcctcagcctcccaaagtgctgcgattacaaccttagcgtgagccaagtttctttgacttcttattgctgtgttgtaagagtattctttttaaatattctatattctagacatacctcctttgtactgttggtgaatatataagaaatctttgcctaacacaaagttaagatattttcctatattttcttccataagtttaagatttttgcttttacattttgatctttgttctatattgagttaattttcatgtacagcatgaggtaaaggttgagatttaagaaacctatttttttaatatataagtagaagtagtcagccccattacttgaaaagattatcctttccccattgaagtgccctgcagtttttttgaaaatcaattgaccatacgtgtatgggtttatttctgaattctactttgttctattgacctgtaaatctcttcttatgtgaataccacattgatagacgtttataagcctggaatcagagaaacctccaaatttgttcttctttgaaattattttggctattctatgttctctgcctttgcatataaattttagagtaagctgtcaatagctgaaaaattagcctgcttggattctgcttgggattgtagtccatagtacaatttggggagaacaaatatctaaaccacattgtccttcatttcatgaacatgatggtatatccccgtaggtattaggttttctttaatttccatcaacaatatttttatagtcttcagtgtacaggtcttgcccatatcctgttaaatttgtaggggtaaatttgtaggggtggtatatctttgcacgtattaggttttctttaatttccatcaacaatatttttatagtcttcagtgtacaggtcttgcacatatcttgttaaatatgaaggggtaaacacacgtttcgtgtttctggaaaatctttcaaatggtattattaggttaatttaattttcttttccctctagcactattggggcataattgacaaacaaaactgtacatatttaaggtgtatggcatattattttgctatatgtataattgtgaattaccacaatcaagccaattaacatctccatcacgtcatatagttactatggggtgtgtgtgtgtgtgtgtgtgtgtgtgtgtgtgtgtgtggtgaggacacttagaatcaactctcttagcaaatttcaagtatacaatgtgatgttattaactatagttaccatgctatgcatttgatctccagaatttattcatcttataactgaaaatttgtaaccaaacttcaaatttgtaccaaattttaaaattgaattttcagctgagtgcagtggttcatgcctagaatcccagcactttgggaggtcaaggcagatggatcacttgaggtaaggagttcgagacaagcctggccaacatgatgaaactctgtctctactaaaaatacaaaaaagtttagccaggtgtggtggcacgcacctgtagttccagctactcgggaggctgaggcaggagaatcacttgagcccgggaggcggaggttgcagtgagccgagatcatgccaccacactccagtctgggtgacagagcgagactctgtctcaaaaaaaaagaaaagaaaagaaaagaaaagaaaaccctgaattttcagttactgatagttcctcatgtaaaaaaaaaatttgatttttatgtttatttactttgcatcttgcacacattttaggtctagttgctttcctatagatattttaggattttctatgtaaatgatcatatcacctgtgaataaagagttttacttttctctttaaaatctttatgcctttattttctagcccttgtcttactgcactggccagaattgccagtacaatgttgaatacaaatcttaagtgaaaagcattcagcctttcaacattatgaagtataatgttagttagctgtggcatttttgtaaaggctttttattataaggttgagcaaattattcctattctcagtttactaaaagtttgtatcatgaatagatgcttttctacaatgactgatatgatcataaggttttcttcctttattctgttaatgtggtaaaatatattaattgattttatctgttaaaataaccttgcctttctggcatatatcccacttggttgtaatgcaaaatttttaagtgtatgccggacttgatttgttactattttattgaggattttgttactgtgtttatgagtgatattgatctatagttttccatttgtgaaatgtctttgttatcacagtaatgctgacttcatataataaattgggaacaacccttatcttttattttctaaaaggatttcaccagtaaaccacctctatgtaaagtttccttgtggggaagaatttcattatgatttaagcttccttaacataggattatttagattttatatttcttcttgagttacttttcctaatttaggtctttcaaataattcttccatttcatctaggttgtcagttattgctacaaagttattcatattgttcctttattattctattcattctcctggatctttattcatatcccctcccttttatttctattggctgtttatattctattttactgatattgattttaatcattctcactttgggtttaatttcctcttttatctcattttttttaaatgtggaagcttaggtctttcatttaagacctttctccttttcctatataagaactgaattctatgagactcctaagcactgcactagctttacctacaaagtttaatattcttggttcttatttgcatttagttaaaaatattttctaagtttctttgtgactttagcaactagattatgatgtatctttgtctagttttctttgtttttgtcatgctttgcatttgttgagcttcttgggttggtgttttcattcaagttagaaatttttcagccattgtttttgttatttttttttgttattctttcattcctaacccctcctctccttctgaatctccaattacacatatgtttcattgcatgatattttttcacaggctctgttatttattttagtcatttttttctctgtattttattttggctactttcatttgcaatattttccatttcaccaatcgttccttctgcaatgacagtctgctgtttattgcatctactttatttttcatttcagatactgtctttttcatctctagatgtttcctttgaactcttttatatctacatttctctattcatgtcacctcttcctttaaacctttgagtatatcaagcatatttatagcaaatattttattctctcatatacaaattctatcaaatctgtaattccaggcctatttttattgactaattttttgcatgttcatgactttcattttccttattttcatgtgtagtaatttttttaagagaaggcttctcactctgtcacctaggctggagtgcagtcatacaatcatagctcactgcagccttgacttcttgcactcaaatgatcttcttgcctcagcctcctgagtagctgggactacaggaatgtcccaccacacttggctctgagtgtagttgtatttctttaaaaattactggacatcgttgtggcatagagtaaagttatctggagatcagtttaattcattcaaggcttgcttttactttttttttttaggtgggtctacagtaacctttactctggagctaacttaaccccactgttaagacttacgttccctctggaatgtctagtgaatgtgccatgtattaagcatgatccctctacttgggctggtagttacttgaatgattgttggccttgtgtgagctccagggatttttctgtttatgtatctccagtattgttctttctttggaggtttttctttttctgtcttcatgaagtttcactcttgtgcagattgatattcaactgaagatacaaagataactttaggttgttttctggacctcttttttggtatagtaccctcttttctgttcctctgcctgaaaattctagctgactcagccttccccaactctagtttctgtactttcaactcagaggattacttgaccctgtttctgtttttctacctggcaccatatttaggaattggattcaggcaaaaagctgggtgatggtagggtttgcctcctttgtatcttttctattagggatcacagtcctgtcttttatccaggtctgatcatgaatgtttgacatatttttgtccagtattcagcagttttcagaaggagccactccataccctattacctcatggaagtttgacaaaacctttaaaggtttgacaaaaacactttttaaaagaagacgtgtattattcatatctgtttctccattttagacctttcttcacttcttaccggctaaataatcccatttcctctattttgtacaaatccctcaaacatattaatattctcttcctccacactgttaactgcacatttatcacataaagttagtcttttctttccatcatcatgcttgtcttgccaatttcctaattcataataaatagatggtcctaggaaaacaatctcacctgtaatatgagagttattcaattaattttttgcatcagtgaatacacataccttttacaaccaacctgaacttcctgtgtgcataatttcattgctacttaacttaattaaaaaattattgtttatgcccaatatttcaaataaatttatttaaatttattaaatatttattgattaaaaactactgtctacaaggctgaactctaggatgagggaagaaaaatataagtatgtcataaactctgaactcaaggtgtaaagacacatatctatacataactagacagtaaaactagaccaaaattataagcattacagagatactaaaacaaggtattagaaaacataaagaggaagcaaccagggcaagtagaggagagaattcacagagtgtttgcatttgagcaaaagcacctcatgagataagaattctgacagagaaaaggggagatgggaatgaggcacagagtttgcatgattaaggcagtatgaatgtgcttgctgtgtctggcaaatgagctattaggaaaggcatggtggggagatggtacatgaaaaataaatcagggctctattatgtaaaactgatagtttaaaacaagttcaacattagtcaaggcacaattttctacttcttattctactgagatcaaaaaatagaaagcttctacgtattagatacaaaaggattcagagactgtttctcttctctaaattcccataattcagatgtttggacaactcaatctattgttttgaactattttctggagattgcatgaagtatatcttatctctgtaattgcaagaacaatattttctattatttgtgtatcctgcaagatgactagcacagttcagggcacatcatgtgtatatacgttttgattagacaactcttgctctttcacatgttctattttgtccttagatgactataaaatagaaatgctttcagtgctgatgtttacgtaaatatgtacttgtatgcatgtgtgtgtgtatattggactgaaacagaaattaataggcatgtttgatcaaaaaaatgtgaagaagtctctcaacagccccgcaatcaaaagataaacacccccattattaaatagcaatattttatccttttcaatatacaacatatattccctgtcttttctcatctttatattgtatacatattatttctatcatattttaagccattttctgggaaagcagttgttcagttacatgaaagtaaaatttgggagaaaaagtatataattaaaatgtatattaactaagtcatgataaatcatcaaaacttaggactgaagcattttatattgaaaataaaatgaatataaattagacattaagtctgttagatcagaagtctgttagaactgactaactctagttcacgacactaaatcaaggtagcagaaataaagtagtatgtggtactactccagatattgccaaatttaaaatgcttcttttgtatgctcaatagcattcagtaaattttttttggttgaaaaatttattaattaacgctagccaaagaaaataaaacctgatgttttctcccccaccccaaataatctttaataaacatattaacaatgctgagtgattttaaaactcttttcttttttgagataaaattttttaagtggaaaagaatttttcagatgtaccaagacaagttcaaaaacatggcaatatccttcaacctatgcaacattctcaccatcttgtcagcatttaattaaatctccctgacccaggttcaaatgccagaattggaatacctgaaccacatcctatctagccaaggcattaaacccatgctggataagtcttctgtctgagataatgaagtaggaggtacccaggacaatcaaagacatcagcaacttctgacttaccaggtttactgttaattcattccccatttcttcactttgatcttcctaatggtgaactaatttcatcttcaagaaaaggaatttttctactcttcatctatggatttccatatctgaaaatccctttcaaatacacgtaactctgaccaaacagaactactccaaacatatctgaccctgtgccactaaatctgtcagttacaacatcaccagggaatgccatcctgtcattgcataaagacaaaacctcttcctgtggcagcctgcagctaataactggttgaagaagtgcagctacctcctccaaactgagaacaattctgaaaggtcaccccagcttctgagttcctgtgatgttggtcaagcagaaacagatcattcagtggacagcacctacagaaaccttctccagtaaggtgtgaatcccaaccttagggagaggtgctctcttccatgattgtccttccttggatactctcccccagccatagaatacctttatagtttgttttacatatttatagttactctcctatcatagtttaataatctttggtgttaaactttcttgggaaacttcaacacagaaatataagcaggaaatgataagaaaagaaaaggctaatgttgagccaaagacacaataaaactggttgaaataagaaaagaatacattatgaaatttaaactattttgtctctaaaagccaaactgattttacataaaatcaaattagtgttttggtggccaaattggagacattcaccaaaatccataccctcaaaaaggtcagaaaacatggtgtatcaaagaaatcaagaacactgatctattctaagaccatataatcttaggtgaaaaagcctgagcagagaatacaaacgaaataatcaaaaatataatagaagaaaactttccagaatcaagaaagatgaggtatacaacaaatgcctggaagaactggaaaataatcatatcaagacatactcaggcaaaatcttttaattccaaggaaaaagaataacctatccaagcttccagaatgaacactcagattgcctactgtactagccaggattcttagaggcaaataatagaaactgactctgttaagtaaatcagatactttgtttttacatcccaaacatccagaaaacaaagaaaatttaaaaatcctgaagtccaccatatctatgccaagaagaaaaaatattatgttgaccttatatttttggaacatatgcaatataaacaatagtataagcattatatgacataaaatgtcaacagactactcaaggtacaaggttataactcaagaattttataccaagaaaagttactggttatgtttaaaagcaagacagataatgcagtcctcatgaataattcttgagataatacatttatcctatttgaaaataaattacaacttgccaagagacaaattaaggaatcaaaaaggtgcaacatgtcatataaagtataattcatgaatattgaaataaattaaatacaaagttttaagcataacaatatttattaatataattatagaatatggttattaatatggtcattattttcagtgaaacaattacatatttatagaactcaagatcagctcaaaattataatttagaagggtaaagtatggcaactagttacaagattaatataaaaatcaacagtctttctatttataagcaaagacttctagaatatacaacaggaaaagaacatgagtcaaaaaatttaaaaatcaaaaattaaaacaactaacaataaccttaaataagaaacgttggtgccctagggaaataaaactaattatgaaataaagaaatacatgtcaagagacaaaggaaaattaatttaaatggagaaaaatgtcataataatgtttgagaaagctgaacttttcaaagatggcaaatcttcctcaaataaaagtgtattggggattataataatttatggatgctttatataagttatacataaagtgagggctgaaactttgtcatattttattatatctaagactagaactgtacataacacacatttgtttaacaataaatactttccaataaatggttaaagtaataaattaatcctagctggacctgcaaggaaagatggcaatatgaatttaaaaaccgctataaaataaaagaaagaagagaagagctaaggaaatgtatgacaaagaatataagtactatgaaaagtaaaacactacaggacttgtgcaagaataatagagtaaatagttctagttcagaactgaatatataatctttattataaaaacacatgaaaaagaagcaccaaagtttataaaaaataagtggattactcaataaactatgatgggaaatgagtttatgtgtctgaaaacaaaacatgcgaattgaagtcttctgtgggaaaaaataggcattttcttttaaaggcatttctactataaatagtagtaaatataatagaagaaatgatttatagacttcatttcattaaaaaaattaacccctgtatttgaacattaatactaaaattctaaaacacgtgaaaactttggaaaattatttacaataaatacaacaaaataataatatccttaatatgcaaagactctatataccagtaagaaaaatagcacggtaaatgaaaagcatacaaaagacttgaaaagatcattttaaaagtagtacaattgaccactgatcatacaaaatatgtttaactactttagtatttatagcaattaaaactcaaatagcaaggagataacatgttttatcaatcaaactggcatgttttcaaaccataatgtttggtgaggggctttgcattgggaatgtaaattaacaaaaatattttgaaggataagttggtagtatgtgtaaagaatctttaaaaagtttcttctctttcagaaattccacttctagttatctatactaagagaataaatgttatatgtatgtgtaatgatattcattattccattgatataaaagcaaataattgaaaacacttaatatttaactgaaaaacactgttaaataaattagagtatatctatgtaagaaaatatttaaagatctttaaaatcatattctcagaaaatatttagtaatatgaaaaattgtcattttattattttaatatgttgcactgttttaaaaagtagtataataaaccctaggaggataaattccagttttaaatgttttttaataaaatttatctttaaatagtgaaataatggcctatttaaattttttaatacttttctgaattttgcaaactttcaatgatcaattcagaatgcttttataatcaaatattactgatgttatatgtgtcaatgaagttatttcacctctaccaatctaacccaaaaaaaggtagatgtgcacaaagattttttactcaaggatatttatcatcatattatatataataaaataaatgtataaacaatctaaatgtttaaccatagaaaataattaaattgtgctacctctgtgtgtatacttttatatattaggatattattactataagtaaaatttcataaaatgttattggcatgggaaaattttcatgaaaattaagaaataaaatgcacagcatgattctgtttcatttttatagtgacttgtgatagggtttggctttgtccccactcaaatctcatcttgaattgtactacctgtaatccccacatgtctttggagggacccagtgggaggtaattgactcatgggggcagataccctcatgcagttttttgtgatagtgagtgagttctgatggtttcataaggggtttttccccctttgcttggcacttctccttcctgctgccatgtgaagaaggacatgtttgcttccccttctgccattgttttaagtttcctgaggcttccccagccctgtggaactgtgagtcaattaaacctcttttcatcataaactacccagtcttgggtatgtcttgatagcattgtgagcatagactaatacactcgcatatataaaaactaagataaaatatattaaaacacatctctgtatgacaggtgaattttcattattcatacatatcctattttccaaattgtctataataagaaaaaacaagctttttaaagaaaaatggaagattattcctccatttagaatcccataatactaagtgatttgttgaaatgttcatcagaatgcagaggcaatcctaagaatttaactgcaaattacagaattttcctatcttcacactttctaattgccaaataatttataaaaataagtaggacttaatttcatgacatgtattaaaataaataaagtaaatggttttcaatttgaaatattccattaagtcttttctaacttgagcttatgaaatgcatgcttgcttcttgtttctttttaggcctttgcttccagaaatgttaaaataacatgattactaaatatatctccaagtttcatacagctactgtgaagtcaaaatctggaaaacaagtagaaaagtggagtacttactgttggcaagaactaccacagatccctaagactattgttctataaatgttaaattataaagtgatacaaataaattagattttaaaagggaggaatggagtaggaagaaggagaatgtgttgtgagacacagtagaacacacaggaagagttgaggtatatatctttattcttactgacatatatcccaaataaatgaaagcaaactcaatatttcatgtattcagattaataacacctatttctaattttaatgtaataggttctttaacaaaaagttttcaaaatatttcaaagggcttataaaagtgaatctttagctttcttctaagtacacttttgcgctcctacatctttcatagcctagacctaatttctagtttctggcctcatctccgtttctaggtcctgctccacagaggtgtgatcaggagggccatgcaccattacaaaattgacatgacttagatcttaaaagcagtaccacttgcccctcctccaaactgtttgtttttttatttttttgttttttttccttaaggctgctcaagaaagtagcaaataatatagcctaaataatatatgatttgttgaggacttttttggaggagaggaaagggatgtgattatttaaaactgcacaagtgggaaacaatttccaaatgcttttcagaaaatatcttgtaattagattctcttttaaaactactaggactttgaagtaaaataatgtctgctgctgagaacactgttgaattgcagttaactcctactagtgatcaaaatgacccagtcaaatctccagctgcttatgtaattctgaataaattctccattttttaagaaggatacaccaaagaaataaagttcagtttgtagtggctcacgcctgtaatcccagcactttgggaggctgaggctggcagatcacgaggtcaggagatcgagaccagcctggctaacaccatgaaaccctgtctctactaaaaatacaaaaaattagccgggcgtggtggcacgcgcctgtagtcccagctactcgggaggctgaggctggagaatctcttgaatgtgggaggtggcggttgcagtgagctgagactgcaccactgcattccagcatggacaacagagcaagactccgtctcaaaaaaaaattttttttcagttaaaagatacccactaaaacaactctgtcttggcaaaaattgcaacacttcaataagggagaatatttggcatgctccattcattactctgttgtggtgtaccttacgagagacaaccaaataagatagaacaaaatctatgttgagaacttactgttctacttaacacaggagtggagtacatactgttaccaagaactgccacagagccctaagactatagttctataaatgttaaattacaaaatgatacaaatcgttttcatgattccaggaagatggcagcctgtgtctgtattctctattccttctccttcctaagtccctggtgtggctacttttcctagaaaataactaagtgtactcttggaggctagaaagaacctggaatcatctgagattttaagtcctaaaaatgaagatataattctggcctaaaacttactggacagtggtcagaaccccttctaggctaacttctcctacataacttggaacaaatgtcacagattcccggataaccacaagcaaggagagaaaattctcctacctgtttactaagagagcccaagtgtccctttacactgtagtgttgggctaagtacaatccatccctgggctaagtacaatccatccctgattgcaccaaacttaaaaaaaaatctctttttctaagcctaaatttcactaaaagcactctggagctaaacactcccatttaattatttattgttgtttaattaccattttcttagagactccaaaacctgagcagtacaggtgttgacagatcccatgtccaataatatgaatgcccattaatatgaacaataaggatcaacaaaccattttatgagacagtggcttaaaagaagaaaacttagatgatcaacaagagtagtagaggtaaaaataacagaggacacacaaaaaaatggggaaaaatgtactataatctcttataaatatgaaattagaatgtgtaaaaacagtgtctagaactaaaagaaagaactcttgaattttaaagttcagttgagaaaatgaaaacgtcactgaagaaaagtaattttgtgttttagaaaatcaagtgaagaaaacagaataaaaatgaaccctgataggtatcaagtacagattaaacatttgtaagttggtgaataatgggataaaaacaaatgaagatgtgatcaaagaaataataaacaaaagctctcctcatctgaagttacactcagattaaaagagctcacttgttaaataatttaaatggcacgtatttaaagataatctgatgatttttgaactctaaagttttgttgttgttttgtttgagacagggtctggctaggtcacccaggctggagtgcagtggcaccatctcgactcactgcaacctccacccccaggctcaagccatcctcccacctcagcctcccaagtacctcggactacaggtatgtaccaacacacccagataatttttttttattttttgtagaaatagggtttcactatgttgcccaggctggtctcaaactcctgacttcaagtgatccgccctcctcggcctcccaaagtgctgggataacaggtgtgggctaccatgactgtccgaactctaacattgaactggaaatattaccagtttcaacaagggaagagaaaagcagatattttcaaataaaaaagaaccaaattattatcaaattcttaactgtaacatcagaagttagaacacaatagaccaaccattgtagattatggaagaaaataactgttaaaaataggcagctggacttgaaatcctgcctaaatatgggaaatggcagacaggagtcaggactaacttgcagcacccactcggatggagagaacagcatgtggagactcacattgtaaacttttgctccaagaactgccataggaacataccagaaaaactgaaagaattcacagatcctttgaaagaagcaccttgttactgcaaactctgtgagacagttgaaaaaatgtcttgaaaagtgtgaaaggggaaaatctgcctccaaacacacatcctccttggggaacctgaaaatccagaccacgggagaaggatttaaacttatctagagctgaaacaaatttagacagccaagcaaaatacaaaagtagaagaagcaggccaggtatggtggcccatgcctgtaatcccagcactttgggagacgaaggtgggtggatcactcgaggccaaaagttcaagaccagcctggccaacatggcaaaaccccgcctctactaaaaatacaaaacctagccagccatggtggcacatgcctataatcccagctggctgggaggctgaggtgcgaggatcacctgagcccaggaggcagaggttgcagtgagccacgatcacgccactgcacaccaggctgtctgttaagactctgtcaaaaaaaaaaaggaagaagaagcagcagcaggaagagccctgtaggcagtctcaggggagccatttctgactttatctcacaggggtctgtgggagggctgcaagtggaactggggaaggaccacagggagaaagaaacttccagctgaacttctgtaataattttgaccaagcatgaattttcctgggcagaatcgggggagggggagaataggaagtgtggacataaacacagaaactgcggcaggcagggaggggtgaagcctgaaatccctgcttgctttctcagctcttagtgggtaggcttgtagcctggtacaagatctcagtactgctcacaggctccctgtatataaactcagtgctattggaggggcgtggtaagagttagactagccttactggctgcatgggagctgagtgaggcccgtcactgccagcttttccccacttccctggtgacctgtataatgtacgagaggcagccataatccccctaagaacataactccattggcctgagaaccacaatcccatcccccacagaagccatagcaagtcctgcccaaggagagtctgagctcagacacacctaacccggcctccacttgatgatttttctccacctgccctggtagccaaagacaaaagacataatctcttgggagctccatggccccactcatcacctgagaatcctgagtacttatccaggcaaccttaaagcaagcttgtatacccctatactatgcagttgatctctcctgaaagtgccacctcctggctagaggccaaccaactcaagccattacagcaactcataaaagaacaaacccactccaaagaagaagaaaacaacagctaattccactgcctgtagcatcctagctaaccagaggtcctgagtctgtccatgtgacaacttcactgctaacacaactagcattgagaaaaccagaacaataaacaaaattacaaccaaggacactcacggagtccacttcacccctctgctacctccactggagtagctgctggtatccacagctgagagaactgaaaatggatcacatcacaggactctttgcagacactccccagtaccagcccagagccaagtagctccactgggtggctagacccagaagagaaataacaatcacagcagtcaggctgtcaggaagccccattcctagaggaaggggaagaacaccacatcaagagagcaccctgtgggacaaaagaatctgaatagcagctctttagccccagatcattcctctgacatattctacccaaatgagaagaaaccaaaaagacaactctgctaatatgacaaaacaaggaccattaacacccccaaagatcacattagctcatcagcaatggatccaaatcaagaagaaatctctcaattgccaggaaaataattcagaaggtcacctaacacataaggactcacataaacttaaggaaaaggggtggaaagagatattccatgcaaacagacaccaaaagcgagcaggagtagctattcttacataaggtaaaacagactttgaagcaacaaaagttttaaaaaacaaagagggacattatgtaatgataaaaggactagtccaacaggaaaatatcacaatccaaaatatatatgcagaagttcccaaatttataaagcaattactactagacctaagaaatgagacagacagcaacacaatattagtggaggacttcaatactccactgacagcactagacaggtcatcaagttagaaagtcaacaaagaaacaatgaacttaaactatatcctataataaatggacttaacagatatttgcagaacattttctatccaacaactgcagaatatacattctatccatcatcacatggaacattttccaagatagaccatatatgataggccacaaaacaaagctcaataaatttaacaaaactgaaattatatcaagtgctctctcataccacagtgcaataaaattggaacaaaaggaaccttcaaaaccatggaaatacatggaaatgaaataatctactcctgaataatcattgggtcaacaatgaaatcaaaatggaaatttaaaaattcttcgaactgaacaataatagtgacacatcctatcaaacctctgggatacagcaaaagtggtgctaaaaggaaagttcatagcattaaatgcctacatcaaagagtctgaaagagcacatatagacaatctaaggtcacacttcaaggaactagagaaagaagaacaagccaaacccaaacccagcagaagaaaagaaataaccaagatcagagtagaactaattgatattgaaacaacaacaacaaaaatacaaaagataaatgacatgaaaagctggttcttggaaaagataaacaaatcaatagatcattagtgagtgtattagtcccttttcatgctgctgataaagacatacccgagaatgggtaatttattaaaaaataaaaaaaaaggtttaattgactcacagtttcatctgactggggaggcctaacaatcatggcagaaggtgacatacacgtcatacatggcagcagacatgagagaaagagaatcaagtgaaaggggtttccccttatgtaaccaccaggtctcgtgagacttatacactaccatgagaacagtatgagagaaactgcccccattattcaattatcacctactgggtccctcccacaacatgtggaaattatggaagctacaattcaagatgagatttgggtggggacacagccaaatcatatcagcgagattaaccaagaaaagagagaatatccaaataagctcaattagaaatgaaatgggagatattacaatagatatcacagaaatagaaaagatcattcaagactacttgaacacctatatgctcacaaagtagaaaaacctagaggagatagataaattcctggaaatatacaaccatcctagattaaaccaggaagcaatagaaactctgagcagatcaataacaagcagtgagattaaaatgataataacaaatcgcaaacaaaagatgttccaggaccagaggaattcaccgctgaattctatcagacattcaaggaaaaactggtaccaatcctattaacattattccaaaagataaacagggaatcctccctaaatcattctatgaagccagtatcaccctaataccaaaaccagaaaagggtatttgaaacaaaagaaaacaaaaaaccaatatcccttatgaacatagatgcaaaaatcctcaacaaaatactagttaactgaatccaaaagcacatcaaaaaggtaatccaccatgatcaagtgggtttcataccagggatgcagggatggttcaacatacacaaataaatgtgatacatcatataaacagaattaaaaacatcatctcaatagacacagaaaaagcatttgacaaaatccagtatccctttatggttaaaatcctcagtaaaattggcatagaagggacatatcttaaggtaataaaatccatctaagacaaacccacagccaatattatactgaatggggaaaaagtgagagcattccccctgagacctgggataacacaaggatgcccactctcaccaattctattcaacatagtactagaaatcctagccagagcaatcagacaaggcacagaaataaagggtatccaactcagtaaagaagaagtcaaactgtcactggtcaccaatgatatgatcatatacctagaaaagtataaagactgatccaaaaagctcctagaactgaaaaaatgaattcagcaaaggatcaagtgacaaaatcaatatatacaaatcagtagcactgctatacaccaacagtgaccaagctgagaatcaaatcaagaactcaactccttttacaacagctgcaaaaaaaaaaaaaaaaagggaaaaagaaatacttaggaatacatctaaccaaagaggtgaaagatctctacaaggaaaactacaaaacactgctgaaagaaatcatagatgacacaaacaactggaaatacatcacatgctcatgaatgggtagtatcaatattgtaaaaatgacaaatctacaaattcaccaaactagaaaaaacaatcctaaaatttatatggagtcaaaaaagagcctgcatagccagagcaagactactccaaaagaataaatctggaagcatcacattacttaacttcaaactatactataaatctgtagtcaccaaaacagcttggtacaggtattaaaaataggcacacaggccaatggaacagagtagagaacccagaaataaagccaaatacatgccggcttgatcttcaacaaagcaaacaaaaatataatgtggggaaaagatatcctattcaacaaatagtgctgggataattggcaagccacatgtagaagaatgaaactggatcctcatctctcaccttatacaaaaatcaacccaagacgaatcaaagacttaaatctaacacctgaaaccatcaaaattctagaagataatactggaaaaacccttccagaaattggcttaggcaaagaattcatgaacaagaacccaaaagcaactgcaacaaaaacagagataaatagataagactcaaactaaaaagtttctgcacagcaaaagaaataatcagcagagtaaacagacaacccacagagtgggagaaaatcatcacaaactatgcatctaactatataaacaaaggactaatatccagaatctacaaggaactcaaacaaatcagcaggaaaaaacaaacagtcccatcaaaaagtgggctaaggacatgaatagacaattctcaaaagaagatacacaaatcaccaacaaacatatgaaaaatgctcaacatcactaatgatcagggaaatataaaccaaaatcacaatgcaatatcaccttactcccagaagaatggccataattaaaaaattaaaacataatagatgttggcatggatgtggtgacaaagggaacacttttacactgctggtggaaactgctagtacagctactatggaaaacagtgtggaaagtccttaaagaactaaaagtagatctaccgtttgatccagcaatcccacttctgggtatctaccccgtgaaaaagaagtcattatatgaaaaagacatttgcacatgcatgtttatagcagcacaactggcaattgcaaaaatatggaaccagcccaaatgcccatcaatcaacaagtggataaagaaaacgtggggtgtgtttatgtgtgtgtgtgtgtatacatatatatatatacacacacacacatatatacacaatggaatactactcagccataaaaaggaatgaaataatggaattcacagcaacctggatggagttggagaccattaccttgagtgaagtaactcagaaatggaaaccaaacattgtatgttctcacttacaaatgggagctaagctatgaagatacaaaggcataagaatgatacaatggactttggggactccagggtaaggggtggggattgaaagataaaagactatgcattgggtacagtgtacactgtttggatgataggtgcaccaaaatctcacaaatcaccactaaagaacttatccatgtaagcaaacacctatttcccaaaaagctattgaaataatacataaaataatagtaattttaaaaataagcagaagaccattagtcagaggctgtctctgcactatgagttgctacatgatgaaccataacctaatttggtatgtaaacaaaccaaaatgtaacttaggagtataacagccaagtttcagctaatcacaagcagccaggtttcagtcaattataggcagccagcttttcacaacatgcccaaataaggcaaaagccttatcacactatgcccaaataatataaatacctcattgtagccaatcagatggtttctcgactttgcttccatgttgaaccaataaaagctcactgctcatgctgctgggcagagctctctgaacctcttctggttctgagtgctgcctgattcctgaattggtctttgttcaattaagctacattaaatttaaattgtcttaagtttttcttgtaataaaactatgaatcaagaatcctattaccaagcaagatatcactcacatgtaagaaaataagtatgacaattatagacatgtaagggttcatttacattatttaaaaattactctaaaaagcattttaagtaactcaaaccacttcacacatactatgaaaaccttagaacagtatactttcatttcctcctatcatttttgtgctgttgttgccatatattttaagtgtacatgttagaaatcacacaatacattttattatttttactgtacacagaagattttaatctcctttaagaagattaaaaacaatgagacaaatttctcttacatttatgcacctatttatcattgtggaacctttcattttttggtagagcaaactttccatctgatatcatttttgccttttgcctggataacttcctttaatctttctatgagaaagatgtgtttacagtgaattctgtctgtgtttgtctgaaaagcttttaccctaccttcacttatgaaatataatttaaatgcaaataaaattataacttgatagttttttcttttagtgttttaaagatatcatttcatcacttcagactcacagagtttataagaaaaagtctggttttattcttttatacatagtactctggtaagtaatataccttttttctctggctgcttttaggattcttctttacatcactgattttcaataattttattttaaatatgactcaatgtggctcctttaagtttattttgcatacagtttattcaacttattggatctgtgggcttagagtttccatcaaatgttgaaaattttcaaacattattttctcaactaatttttctactttcttccctccctttcaggatgtcagttacacatagcttagtggctgagttggtcactgctcactgatgctctgttctattttttttcaatccttcttctttctgtacttcattttagtttctattgctagatcctcaagttcactaatcttttctgcttcagtcctatctctgttattaatctcatctagtacacttttcatttcagctatcatattcattatctccagaagttccacttgagtcatttttttcttacacttctctcctcatgctcatgtatccctttatgtgcttgagcattttataacactgttttatatatacataatataacagctattttgtaaacagctttgctgctaaatctattgtctctgtttctactgatttatttatttttctccaggttatggcttctttacacacaaaataattttttactgtttggtgaacattgtgaattttacattgttaggtgccagattttgttatattctttataaccaggacatagttaattaatatgcagatcagtttcattactttgaggcttcctttaaactttgttaggataattccagaacaatcttttttcaaggccacattatccccattattaaggagagactcttctgagtactcttccagtgccttgtatcttacaatttaggtctcttcttttcactgttgggaatataaaacattccccactctgtgggagctctgagaaccgctgagtattgcttttcagtgggtccttccccagcctcactgtgtgcagttcccacctctccaataccctgagctacaaatcctagcaaattcaagctacctgaaatctaaactctgtctcctcatcaagaactctctccctgctttgtagtctataaaccaccttcaaacacataggtgggtaattgtaaggctcacctcatttgtttctcttatctcagaatttacagacatgtatcgcctaatggccaacaactgaaaacatctgttttatatactgtgtccatttttctagttctttacagtggaaaggatattcccaaaataacaaatgcctcttgatgagagactgatcgttttcggaaaatatcaatataaagaaaaaaggcaccaaggactgtgtctcaagcctgtaatcctagcactttaagaggctgaagtgggaagatcacttgaggccaggagttcgagaccagcctgggcaacataacaagacttggtctctagaaaaaaacatagccaagtatagtggtgcacacctgtagtccaaactacttagaactacttagaaggctgaggtggaaggattgcttgagcccaggagtccaaggctgcagtgagctatgattgcaccatcacaatccagcctgggtgacagactgagatactgtctctaaaataataataataattacatgagcaagtgctaaatttaaaaaaaaaaaaagagagaaaatgcaagttacaaaagttgtgaatttcttacaagtaatatattttaagggttccattgtgtataaaaaaattacctatgtgatcttggactagttatttagactttttagccctaaaatcatctcaattcaaattttcctcaaactgaagaaattttcttcccccaattcacaatcctctacttcctcatcttcaatgttcctacattacactattgtaaatatcccctatttgatattttggtttctagttttaaactattcaaatccatctttcactctaccactagattattctatttaaaacacaaaacatgtcttattcatgtttgaattcctaataattagactggattgttaagacaaatctctctaagaagatctcttttaagatgaaaccaggctaacaattagagccagccatgtagagattaagaaccaggcagagggatcaaataatgcaaagaagaatacaagagtaagcttagtgcgtgtggcaggcagaattttaagatggctctaagattcctactctctgatttacacaccctgtatattaatcctcccctcacatgtcagctcaatctgtgaataatatgcaacatcactcttgtgattatgttatgttacctggccaaagaagttatgtagatgtaatcaagctgggttagctcaagttaatcaaaagggagagtatcctggctgagccagacctgatcaggtaaggatcaggtctgctcacctgaggtcagaaaaattcatctgctggctttaagaaagttagcagtcatgcactgagacagccatgtggctagaatctgagaccagcctcaagttgaaagcaactctcctccaatagtctacaagacaatagaggcctcagttctacaacctcagaagtgaatttaaccaaaaacacatgagcctggcagagaacaactgaacttcagaggagaccacagtcttaaaagacaacttgattgcagccttgtgagaccatgtacagaggacctgttattagtccattctcacaatgctatcaagaaatacccaagaatcgataatttataaaggaaagaggtttaattgcctcacagttccccattgctagggaggcctcaggaaacttacaatcatggtggaaggcaaaggagaagctggcactttcttcacagggcggcaggacagagtgagtgcaagcagggaaatgccagatgcttaaaaagccatcagatctcatgagaactcactcactatcatgagaacagcataggggaaaccgccgccataatctaattacctccacctggtcccaatcttcactcatggggattatggggattaaaattcaaggtgagatctggatggggacacagaggcaaattatatcattccacccctggcccctcccaaatctcatgtcttttcacacttcaaaaccaatcatgccttcccaacagtaccctaaagtcttaactcatttcagcactaattgaaaagtccacagtccaaagtctcatctgagacaaggcaagtcccttccacctataagcctgtaaaatcgaaagcaagttagttacttcctagatacaatgagggcacacacattgggtaaatatagccattccaaatgggagaaaaaggagctacaggccccatgcaagtctgaaatccaatggggcaatcaaatcttaaagttccaaaataatctccttttgactccacgtctcacatctgggtcacactgatgcaagaggtggtctcccatggccttaggcagctccacccctgtggctctgcagggtacagcccccatactggctgcttccacaggctggtgttgagtgtctgccggttttccaggtgcacagtgcaagctgtaagtggatctatgattccgaggtttggaggatggtgaccctcttcttgcagctccactaggcactgccccagtgggaactctgtgtggaggcttcaaccccacattttccttccctactgacctagcagagggtcttcataagggctctgcccctgtagcaaacttctgcatggacatccaggcatttccctacatcctctgaaatctatgcagagattctcaaacctcaattcttgacttctgtgcacccataggctcaacactatgtggaagacaccaaggcttggggcttgcaccctctgaagcaatggaccaagctgtacctttgccccttttagccatggctggagctgaagcagctgcgatgcaaggcaccatgttccaaggctgcacagagcaggagggccctgagcccaccctacaaaaccatacttcctcccaggcctctggacctgtgatgggagggccttctatgaacgtctctgatatgccctggagacttcctccccattgtgttagtgactgacattcagctcctcactacgtatgcaaatttctgcatcaggcttgaatttctccccagcaaatggtttttcttttctattgcattgtcaggctgcaaatttttcaaacttttatgctctacttcctcttgaacactttgctgcttagaaatttcttccatcagataccctaaatcatctttctcaagttcaaagttccacagatctctagggcaggagcaaaatgctgccagtctctttgctaaagcatagcaagagtgacctttactctagttctcaacaaattcctcatctccatctgagaccacctcagcctggatttcattgtccatatcactatgagcattttgatcaaagccattcaataagtctctaggaagttccaaactttcccacattttccagtcttctgagccctccaaactgttccaacctctgccaaagttccaaagttgcgtccaaattttcaagtatccttgtagcagtgccccactctcagtaccaatttaggacccagttaagctatgcctgaactcctgacacacagaaactgagataacaaatgggtgttttttaaatcatgaagtgtgtagtaatctgttacacagcaatagaaaactcatggaatatgtttaagaggcaagaacaacaaaagccagtacaactggggtatggtgggcattttaagataaaaaatgggataaattgttaggagattaggttggcgagatagatgagagtcaaattctgtgaaaatttgttgttaaaagtgggaagttttttataattttgcttgttaagtatataagaaagtcatcactgagatttaagcatgggaagaacctgattggcaatttttaaagaacattctggatgctgtgagtaaaatggattgtaggaggggaataacagaagaaggaatgagactagttagaaggctgttacaataatccggtgagaattgaagaaggctgggatagtggcaaaagaagttagatgtggtcagatagcggtcatattttttaaagtggagttaacaggaattattaatggatcaggttgagggtaagaaaaagagatgaggcccagcgcagtggctcatgcctgtaatcccagcactttgggaggctgaggtgggaggatcacttgaggtcaggagttcaagaccagcctgggcaacatggtgaaatcctgtctctactaaaaatacaaaaattagctgggcatggtggtgcatgcctgtggtcccagctactctggaggctgaagcaggagaattgcttaaacccaggaggcagaggttgcagcaagctgagatcgcaccactgcactccagcctgggtgacagagcaagattctgtcaaaaaaaaaaaaaaaaggaaaagaaaaagaaatgaatcagggatgactttaagtttttgacttgacgaactaagctgatggtgggttgtcgtttattaagcaggggaagtctatgggaggaaccagttggaatgacgggatggggaaaagcatgtgttctacttcggataagttgttttaactgcctactcatcacctgaatggtgatatcaggttagcagatggttatacatgtctcaaactgcaggcacaattcagaactagaagtaacagagtcattggcatgtaggcagtatgtaaagcaaaagtactggatgtattactttgggcaagtgtgttaattgaaaatacaaggttttctgtgcctaatccctggaaaatacaactgacatatttgaggtacagcagaggaagaggagtttgcaaaggagacttaaaaagagcagtcaaggagggaagaataaggaaaaatagtataaagtcatttaaacaaacagaagaatgtatttcaagaaagagaaaacaatcacactttatcaaataatgctgaaaggaaaaaaataaaatacattaggtcagagaagtgatcattggattcataatcatggatatttaaatggtagacttaacaaaagaactgttggagtactggttgtgatggactgcccattaaagcagagacaggacaaaatctaagtgtaaaaaaaccagaaacaataatgacagtagatatctctttcaaaatatgtcactgtgaaagggttcagagattgaagctattgtgttgtgacagctggggtcaagagattttgttttgtatggttggcggtaagatgggatatatcacagcatgtttttagaaagtacattggtatccagcatactattgcaataaaattaaagctgaccttatctgattctacctaactgaattttaatgctaaataaagccaaaactttagccagttcaggatagtcatcatatacatgatggcaaaatgaatgttaaaaaataaacaactacattgagagaagataccaggcatccagagttattcataagttaaatgactggttcctacacactggtctttcaacaaatattttttggactttttttttttttttttgagatggaatctcgctctgtcacccaggctggagtgcagtggcgcgatctcagctcactgcaagctctgcctcccgggttcacgccattctcctgcctcagcctcccgagtagctaggactacagatgcgtgccaacatgcctggctagtttttgtatttttagtagagacatggtttcactattttggccaggctggtctcgaacttctgacctcatgatctgcccacctcagcctcccaaagtgctgggattacaggcgtgagccaccatgcccagcccttttttggacatttttattcaaagttgtgagtaccaataattttctataaaagcattagaattgtcagactatgagatgggcacggtggctcacacctgtaatcccagcactttgggaggctgaggtgggcagatcactgtgtgtggtcaggagttcgagaccagcctggccaacatggtgaaaccctgcctctattaaaaatacaaaaattagctaggcacagtggtaggtacctgtaatcccagctactcaggagtctgaggcagaagaatcgcttgaacccgggaggtggaggttgcagtaagctgagatcatgccactacactccagcctgggtgacagagtgagacttcatctaaaaaaaaaaaaaaagaattgtcagactatggatggacttaccctctattttccaaccatctgtaatatttctatatggagtttcaacaaaaagtaatgacattaaacatgatactgtaaaagataaataaaacctcagctgaccaaagcatcataaatgtaatatcttaaaataataagagcataattatattaagacctacagaattatccatgtctagtgaaacataaagtaacaattttaagactaaaattgtaaagagttaatggttttcaacaaacacataccaaaaattaataattaatttttaatccatagaattttagaccataaaaagatcttacatgttattttgctcaacctattcctagtgccaaacttctttcttcagcatctctgggaaatctatgcttcagcttgaaaatgtccactaagaagctcatgctttctcaaggcaagtacagtggaacagctttcatatattaagctaaaacctgcctctcccaaacttccactcattaatcttagttttgtccttggaatgcatacttagaaagctctgaaattaaaggaacagggtctttacaaagcaaactgtttgctttcaaacttttgttactaggaatatctcaaagtgggggggaaatagtgcttctgtgcttaacaaatgagctctgtttataatcaaaaaagtaaggtttacataaattatttattatcaggaaatccctaaattcagaagtagcctatagaagttgacgttttaacaaattactaaaatcagcttttgttttgttatctgatgtggtcaaagtgttatgcatggctagatacaaatatagcaaaacttcaaactcacttcctcttttcttctaatttaatatttactgattaaatcaaattttaatatgcacttgcttctgcagtagaacagatatctcataaagacaaaactcccactgaacgtagtggtagtcatcagtgctcacagtctaatgtgcactgcaaaaacatgtagagaaaaatccattaaactacattggctattgattcttttctcctgagaagttccagccagaattcattgctatcactgtcttatgcatggtggtgcctcactaatgaaagattcagatttttttaaagggtctacctggcctaaataagatatgccacttaaaattagattcataataaaccaaacaccgcatgttctcacttacaaataggagctgaacaatgagaatacacggacacagggaggggaacaacactcactggggcctgtcgggggagggttgggggagacagagcatcatgataaagagctaatgcatgcagggcttaatacccaggtgatgggttgataggtacagcaaaccaccatggcatatgtttacctatgtaacaaacctgcacatcctgcacatgtatcccagaacttaaaataaaataaaacttttttaaaagatggtaacaatagacactggggactactagagcgcggagggtggaaggggagcaagcatttaaaaactacctactgggcactatgctcactacctgggtggagggatcacttgtaccccaaaactcagcaaagcacaacatacccatgtaacaaacctgcacatgtaccccttgaatctaaaataaaagttgaaataaaaaataaattaaaaagagaaattttttttaagtagattcataaatttcacaatttataaattaatacatatatggttcgttgttcatctcatgataaaatcacttggaaaaactccaaatgtcattaggaagatacctataagatgatgtagagtcattttatggagtctacgatatattgttaagtgaaaaacaaaagcttcatatcattcctactcgatttcaaggtgtactataaagctacaataatcaagacagtgtggtattggtgaaagaatagacaaacatattagtggaacagaataaaatccaaaaataaacacataccaatacgctcaagagatctttgacaaagtagcaaagcaagtcaatgtagatagcgtttcaacaaatggtgctggaacaactgaacatccacatgtaaaaaaaaaaattagacacaggtcttacacttttcacaaattaattcaaaatggatcataagcctaaatgtaaaatgaaaagctataaaacttctagaagataacaggaaaaaaatctagatagtgttgggtttggcaataacattttaggtgcaacactgaaaacatgatatataaaataaaaattgataaattagacttcatttaaacttaaattgaaaaattctgctctgtgaaagatactcttaagagaatgaaaggacaagccacagacttggagaagatcttggcaaaacacatatctgataaaggactggtattcaaaatatacaaagaacacttaaaatacaacataagaaaacaaataacccaatttttaaaatgggcaaaagatcttaacagctacttcaccaaagaagatatacagatgccaaataattgcatgaaaagatgcgaataccatatgtcactagagaactgcaaactaaaacaacaatgacataccactacgcatctaccagaatgactaacatataaaacactgacaacaccaaatgctggtgaggatgtggagcaacaggaactctcattcattactgtggaagtgcaaaatggtacagccactttagaaaacagtttggaagtttcttacaagctaagcacaatcctaccatgtggtctagtcatcacactggatttatttcatttgagaatttatccaaatgaaaataaacccacagaaaaatctgcacaggaatgtttatagcagctttattcataattacccaaacttggaagcaactaaaatgtctttcagtcagtggaacagataaacaaactgtggtatatccatgcaatgaaaaattattcagtggtgaaatgaaataagctttcaaagcatgaaaagacataaagaaaccttaaatttatattactaagtaaaataatccagtctgaaaaggctacttactgtataatttcaactatatgacattctgaaaaggcaaaactatggagacaatgaaaagatcagtggttgccaaagttctgggggataaagcaagggatgaataaggagaccacaaaaggtttttagggtagtgaaactattctatatgttactgtaactgtggctacatgacattatggatttgtcaagagccacagaactgcacaacacaaagagtaaaaccctatataaacaatgaactttagttaataataatgtatcaatatcagttgaacaattttaacaaatataccacattaatgtaagatgttaataacaggagaaatgggagaggtagcaggtatatgggaactctgtactttctgctaaacttttctgtaaacctaaatttactctaaaaagtaaagtctattaatttttttaaatctataagcaaaaatgtatgcatacatagcatgcttttgattaagaaaaacggggcagaaaacataggaaggataaaccagaaaaacgttagattacctatatggggtgggtagaaagagcagaaggtataggaaagaggtaggatttctctgagtatacctgtttatatagttttgatgacatattaatattttatataataaaaacaaaactaaatcaacaagaatgttgtggaaagtccttataatttgctaaaaacaaaaacatataaacctaattatatatcaaatagataactatatagaataaaataaaaacaaattaatccaagaacgttttgaatacaatactgtttccaccctcagtggaaatattctaaggaccaaaataaccgcaaataaaccttgaatttcacttggtaaatttggtggcattgctggtattgtacagcaatttaagtgtgtgtgtgtccgtgtgtgcatgtgtgttgcacaagcacatgtacatgtgttaaaaatgagtaaataggcggttacactgacactattgggaactgggattttcaccatgaaagaaaggaaatacaaatatggattgaggaacagacagaatttgtggctgaagagaataaatccatgacttaagaaaaaaaaatgctttctaccattacctactaaaaggttcccgaagcaataacactctacagcaaacaataagttcctttgctatatatttaagcctcgggtttatgaatctaacattgcgtcttatctgtagttgggacatgctgtttcattcttggaaaatttctttttcctcttttttacctgcttaatgcttactcattcttaatgtttcagctaaatatgactatttctggaatataataaattaccatcgatttctctccttaaggcctatgatgacttcacactacttaatagatatccagatatacacactctgcccatggttttctttatcagattgtgctggactatcttatctagcttgttttcttcctactgctgttctgtgtgtgtgtgtgggtgtgcacgcacgtgcgcaagcacatgtgcgtgctctttattagctctaacagattttcttatttttcaaatttattcattcacttattttttcattcattcagattcattcaatgacacaggcagtgtgccagtgagtctcccaagttccattctatacttgggaacatttcattgcccccctgccacccacttcacacagacacatacgtgtgtgtgcatgtgtgcacatgtgcacacacactgctgaaattctacttctgtaaattcttcaattaatggaagagaagtcaccatttttccatgtgttttttctttctaaaattgtgccatccatgaatctaccattcaaataacagtgattcttttcataaataattacttacttaatttatgttttgctcagctctatctcttcagtgctgactttcttaagctataaaatcctggagagtaaaaatatatgccttttcatcccctttgcccttagtccagcacctgagaagccgttaagaaataccaacaataataatgcattatgcacagtggttgcacaataaatattgacagaatgaaaacaatacccttaataaatgtgaaagaacagagtcttcttgtattgctgttttaaatatcccgtaacttctggtcaaatctccttacttgctaaacgatacaaaaattaagtaatttgtaagacttgctcaagattttatacttcaggatagagtgtatattcatcaatgcaagtaactaaaatgtagaagagtaaaatgaattttgataaagttattccattttaatttcaacacacaggtgctggcactgataaatgtaacctgaaggtttaattcagagaaatctttgccttcaagcatatttaaaataagctgtttgcattttcctgcatataattattctaaccctgaaagcaccttttaaatatggattacaaatccagctgccttaaaatgaaagtaaaaggttttcctttctcagtctattttgtaagttggaaattaatgtaacagaactattttgagcttagagagttaaaccttctgactaaattcatgcttaattttttaatgtatttgtgagtttaccaaggtttgcacagaagacaacttttaaaatatcaaaaaaattaacaatgcttcatttttttaacattgtaatttttaaaattagtcatctctcctcctagagggatacttcacaaaagaggcatcccttgatcaggcagggtttactcagccaagtgcttggaatgaacccagaggaaccaaaagccctgatatttctggtatttatttgcaagaaacagtagtctccccatacccataggggtgagttccaagacccccagtgaatgcctgaaactgaggatagtacccaatccaactgccatcaataggaacatgcttcttttcatgtattctactcacaaactgaaagcctttgccatattgactaaggatttattacacactgtggctgtaccttttgcagtttgaggtgcaacaacaaagcgagcacgaattttttttccttctttacaatttcatgaatggaagtctcatccctaccatagatcttagcaacctcagcacataatattttttttctttattgagaactttcaccttttcacttaaagcactttacagcttctccttagcatatcccaattgccagcatcattacttttgtagtggtaccacaggtaactgaaaccacgaaagtgaaaccctggataaaggggaactactgtattcccattctaattgctaggatcctgttcctaactggaaactaactttagaatatgctagagaatttatgttctgcaattcaataaaacatgtgattgcccttgacagtctcaggtcattgacttgaagcagaaagttttgcttaatgactacagagcagtcttccaatccccacctgctgaactggtgcttatctcttacttgtaatatcttgtaaggaatgcaagaaacctacaaactctactattctgattatttctacaaaggtgacctttggtgagtacgtggtctaagtcccaagaaacaacacattatagtttaactttgttaccacacttcaataattgtttctcaacctggtatatagaaattctaaccaggctcctgatccattttgcctatttcatatcttagaatctcttggttgtgccaccacttcctgacaccagttgagacactttggggttgcaagtgggtttgcactttggggttgcaaaatccaactcaaactagcttaatcataaactggaatgtattatctcttggaatccagggaaatgctaaacaatagtatatagatgagcctcaataaaaatgaaccaacaacagatatgctgctgctgctttttttaaatcttgtatttttttatttttatgggtacatagtaggtgtatatatttatgaggtacatgagatacttttatacaagcatacaatgtgtaataatcacatcagggtaaacgaggtatccaccacttcaaacattcatcatttctttgtgctacaaacattccaattgtattccctcagttattcacaaatgtacaacatattattgccgactacagacaccctgttgtgctattaaatactagatcttattcattgtatctaaccatattcttatactcattaatcatttccccatccccgcccccaacactaccctttcccagcctctggtcaccatcattttactctctgtccccataagttcaattgttttgatttttagatcccacaaatgagtgagaacatgcaaagtttgtctttctgtgcctggcttatttgactttatataacgtcctctagttccatccatgttgttgcaaatgataggatctcactttttatgtctgcatagaactccatcatgtatatgtgccacattttctttatccattcatctgttgatggacacttaggttgcttccaaatcttggctattatgaatagtgctgctgtaaacatgggagtgcaggtatctctttgatatactgatttcctttcttttgagtttatatctagcagtgggattgctggatcatatggtagttctatttttagttttttgaggaacctccatattgtcttccatagtggctgtactaatttacattcccaccaatggtgtatgagttttcccttttctccacatccttgcctgcatttgttattgcttgtctttttaataaaagccattttaactggggtgagaggatatctcattgcggatttatttgcatttatctgatgatcaatgatgttgagcaccttttcatatacctgttggccatttgtatgtcttcttttgagaaatgtctattcagatcttttgcccatttttaaatcagattgttgtatctttttcctgttgagttgtttgagttccttatacactctagttattaatcccttgttataggggttgtctgcaaatattgtctcccattctgtgggtcatctatttactttgttgattgcttactttcctatgcagaaggttttgtttgattgccttttttttatttgagacagcgtcttgctctatcgctcaggctggagtgtagtggtacaattatggctcactgcagcctcaacttcccaagctcaagcaatcctcccacttcagcctcccaagtagctgggaccataggcatgcaccaccaaacccagctaattttttttttttttttgtagaggcagagtttccctatgttgcctaggctagaagctttttaacttgatgtgattacatttgtccatttttgctttggttgcctgtgctttggggttattactcaagaaatcttcacctagaacaatgttctagagagtttccccaatgttttcttttagtagtttcatagtttcaggtcttagatttaagtctttaatccactttcatttgatttttgcacatggtgaaagacagggtctaatttcattcttctgcatacagatatccagttttcccagcaccatttttgcaatttagatttcattctctttcattataaattttgtttctccacaaggcaagaaacataaccatcaaacatctaagttttatatcttaaagtttctttggccattaaaggaaacattgactctctttctcttgattccagttttaaatttcctgaaaataattctgattggcctgacttgaattagatcaatctgaaatattccattgttgagatggcataaagtggccaactgtcctggtttgcctgaaactaaagggtttcctgggatacaaatgcattgactctgatactactgttgattatttgtaatagtaaatgaaacatcatgtctaatgtattctgtgtgcttcaaatctttttaaaagaaactgaattaactaactggcatccattgctcttctcaaaaatgtttttatattttgactgaaacccaccatgtgttatggttatctcctttctttacgtttcagtatccctgaaacatattatcctgtttcacgcctcgtatctttacatatggtatttccacccctccctccttattcatgtgtcataatcctcttcatttaaactcagctcagacactgcttttgtgaagtcattgtgaatcctgttctcctcccctgggagagttagtcattccctgttttgttctctactcccaggatatatttctgtacttgtctcataattctgttttataatgatttatttacaaatatatctcatcactatcctataaggtatatgaggccacatctttatattcccagtgcctagcgcaaagcctggcataatggcagtatccccataaacgtttgataaatcgaaaaatctaaaataggaatattttaaatttggtttggggcatcaggtatcatgtacctattatttctatgatcagtctctgaataatagccagtatatctggcatatttgttaacatttaaattacaaatgatagcgtatcaagaataatgtgattactaaaaccagtaacgtgatttgggcctttaaagaagttaatttcaagcttgactttgctgtaggcccaaagtttataacttgttcctaaatagaagttaaatgataccaaaatagatgtataaataagaacagaaagtatgaacataatcagccctgttctctgacaggtgggttggaggctgaggatgcatcaaacagtaaggaaagtcctctgtgggctaacgtgggagggataatttggcttcctctctccacaggcagatggaggccttttccccctgcatagtttctgagaatgcaatgaggaaagatgattgggatgctcatgtggaacaagcatactatttggcttacattaaaaaatagaatgaaatgagtatccctagggagaactaacttacccaagacacttcaacatttctagactcatttctctgaaacagtctagaaatagaaatatatacacatattagactacatctagaaatgtatttgtatatgtatttctagacacacacatacatacacatacattacataatatatgcatacacatacatatacacacacacacacacaaactctctaatgaaaactgtgccaatttcaaaagtgaagctaaattatatttcagttatgctcccttgcatcacaaaatgaggctctccagcttaatattggcattcccaagccaggtcaagaaagtaggaactgataagctgtctggtataatagttctctagctaaatctctagaaaggtgctgcatctgacatttcttcaaattagaggaaatttcataagacttggtagggaaaaatatgtcagatgacagatatgtatatcttctttcacttttgcccaaaacgtcattaaaatgatagaaatatatttgtaaaggcataaagacataaagacaagcagaacaagaaaggaaactacagtaacaaaattctggatgctataaagtagttacatgacaaatgactaagcagacttgagaactggatccaaagctagccatagaaaaaactaaaaatcaacctggtaagactacagaggactcatgaattccataccagatatgtctgaaagaataggtgaataaaaaggcaaaaatagcaactatgtgaaagaatattttaaagcagttagattcccatatgcctttctcactctatagcctggtgactatccgtccctcaatcttgcaaaacactgaagatttcttctcttagaagagtaaaacagttctctaaactaatcacagtttagggtatggtaagataatgaaaataggtgattgagaaaacaggtatactggatgttgacattcctgtgtgccctctttccttaaacagccctaagaacttcccattaggagcttaaaagagggatttcctaggatgttccggtcaaaaggaaagatctaaagatgctgttgtcaagacttctccaactaaacggaccaatggaatcaacctaaagcaaagcttatagtgacaatggcatctagaagacaatatggtcattgttttaatttctctagggaatttattctcaacactagaatttcacatccagtctatgaagcaagagtgaggacagaataaagacatttgcatgaaattactgggagatgtgctgcataaaacaagaaaaggcatggcatacagaaatcaagatatccaacaaaggaaagaggcaataaaaatccccaaatgatggagaagaattgcaaggttgatacctatcagaaggagtagaaggtgaccagtccggatttaaatgaatggaaaggctcaggtgagattcttcagagacatgaagcatatagaatacctgatacacataaacatgttaagaaaagatgaatctggaattgtgttgactatatatacatagaaaatcaatcacaattaggaaagacaataattaatcctaggggaaataaaacattgtaatggaaaggaagaggaatcagggtttagcctatggatcagtaacattataaataatgtctgtcgacaaacataacaagtaaatagagaagactaatctaacccaaattttgcaattaatgtgttaaagagatagtcatggaaaacatgtgtgtgcttgtgtggggtactgttatagtaagcggtaggaaagagaggaatgccatattccatagtgggatgtcaatagataatgtctaaaactgaaacattaaaaaggagcaaaacaaatagattagagacataaagataaatacccagataactagataaaagagatgaaggtgttgggaggaagagaagaagatggttggggtactgctttttaaaataataataaataatatataaatatttgacaattcaagtaaaatcctctaaaacttatataatcttgactttatgatattatataatttacctaaattgaatgcatcaattctcacccataattactttttgtaagctcaaacattaagaatttggcaatgtcttataactcgcttctgtgttagggacctatggcagaaaaactctgaaattacccccaattatccctgtttctcatgcctttgtgtaatcccctccccttgagtggaagcagaacctctggtttgtttctagctaatagaatatgacaaagacaatggcatgttaattccatagttatgtcacataagattgtgacttccattttgcaaacataccctctgttgattctctccctttctggctttgatgaagtaagctaccatatggaaaggccatgtggtaaggaactaagggaggcttacaaactgaggctctcggtcaaggaattgaaagcattcagcaaggaactggggtcctccattgacaaaccacaaggaactgaattctgccaacagccatgtgagcttggaaccagatccttccccagtcgagccacagacgaggtcccattcctgggtgacaccttgattctagtcttgtgagagaacatgaaacacaggacccaagccatgcttgaatacctgacacacgaaactgtgagataataaatattttgcataaggcactaaatttgtggtaaaatggccacacagcaatagatgaataaaggatctaaccaaaagagaccatgatttgagcacctctccaactcaggtgttacaaaacaaagattgttgagttctgcttgtcagaggtatgaattctgactgattgcccaagcctccagtttgtttgcatcatccagctacttaagctgacactgctacacctaaggttcagcacggcaacctcagatgacttcattctgggctacgtcatccagaagtcataaaattatctcccaaatattaaagaatttaaacaaattactatctttagcagtgccaatcaaatgtcacccaagaggtaaagtaatattcacttcagtattttagagggaaaagtcataagaggtaacacataatagaaatcttctatttaataaaatgttaagagtagatgggaaaaatcaagtttttcaccctctaaaaagcatacattctaattacaacacattaaatatttaacaaatcctgagttctaggtaaatggaaaggaaatttcctttgcttttaatttagaataaaaggtgatatgtgggtggtgaaatggtgcagcttacagtgcctacattattgtacagaaagaaagggcagcagggagctagaattatagaagcaggaaaaaaatggtatgacaaccaggtaggcagcaatagccatttgactctctacctaccagctctcataggcttcgctgtcttagagttattataactatattgctaaaggaaaaaaaaagtgtggttatttgttacttagctgtccttatcacactgactcagaaatcaggtgtatgtgtgggagaattttcaaaagaaaatccacatacagctgtgaatcactcacctgaagaacaatgagccaaatgggcaatcactgagacaaactgtcacttatcaaaactctataagcaatgcggaggttaacctgggggtctgaatctgtcagtgccaagtttcttccagctgtcacaatcagacaagctgcctccatcataaaataatgcaagccaaattcaactgagtgggactcaaagaaacatctgaaattcaacaacagcagccttgccatctagactattttgtgacaaagttgatgacaaggggttggaaatgacagaatacatcagtatggaagtctctctttaatgacccgatgtcatgaatgaagcatgaaggacaagtgactaaacacatatcattcttatttaataccatattgaggactaaggctcacattatcctctacaggtactgcttggatcctgtattagtttcttttgctgctgtaacaaattaccacaaatttagtggcttaaaacaatacaaatgcattctctttcagctctggaggccagaaataaaaagtcagtttcactgggctaaagtcaaggtgccacaagggctgcctcctctagaggatctgggaataatctgtttcttgactcttccagctactagtggctatgctatgggtattcctcattggctctggctcatggccccttcctcccatcttcaaagccaacagtttagtatcttctatcattgcatttccttattctttctgtagtctattccccctctacctccctcttataaggacagttgtgattacatttagggtccacccagataacccagaattatttccatatctcaaaatcctaattcacatcacatctgcaaaggctcttttgctataaaaggtaacattcacagtttccaggaattccaacctggatatttttgggagctattattcagcataccacaggtcctgtctcataaatgttttaattggaagctgttcgtctgtggtaaagagtttattactcatatacaaagccatctaaaatacaataaatgtaaattaattagagattgaaaatcaatagtattttgactcctaaacactttattaattgttctgggaaatttttgagccatttctcttggtaaacataatgtaaaaaaactaaagagcagattttagtgggtcaatattatcttggcaatctcatgaatactgctgtgtgtgtgtgcacgcacacatgcacacataagcacacgcaagcttgtgagggtcaggagattggataaaggtatactaaaagtgaacacttaaagaattctaatgatacctgcatgctgtactcatggaatgattcacactataacaactatgggtgctggaatgtacttcagtaagcatcaggcaattttaattcaaaagactctgagcagattttgaagcagttgctctgacacctgagggtgtaaccatgtttgaaggtgtgtgggatgttgagaggagaaggaactaacttttattaaatggctactatgtttcaggtacagagttacaggttttacaaattttaatgttaattaaggctcacgacaacagatgctgcaggtattaaaagaagataataatacccagagaggattaggtaacttttccaagtttgccagctagcaagtggtatagctagacccacattttttgaaatctaaatatccataatggggttttagcatgttagagcagatataggagaggtcaagagtcaagaaaacacaatggttctttcagaagagctctggggaaaaaaggaatgagacaaggggaacaacattatcacacactgcaccagctgactatagtggtaggtcataatgactgcaaaacagtgtgctgggccccatttagtgatgacatcacaatacataactctaagcaaataatgtttctacttctgattcctatttcactgctttgaccctccatcacttacctgggcacagagtattcatggtatcacttctccccataaaatgggtttgacaaccaagcccaatttcttacttcatcctcagatgtagccttatacctttaaatgaacagagattaattgcatagattttccataatggggctcattcattttccgtattatagtatctactttctaaagctgattttactgagatctaattttccagctcatgccactatagaaatgactgttaaaaacttgatccaacaggaatctgagtcattgctacaatgggaaaacatctgtaccataaagaagacaagattgtcatttcattagaattcctcttgactttaaaccattaatctttgtcaataatgggatattcatttgcagctcactaactggaataaaactgaaagtgataccatcaagatatacataattctttgataaaaccacagctttagggtccatgcctccaaggataattaaagaaatagctgttggtgttctgagtctgcttgagtaacctatagtttatgggataaaagagatagattaagacagggcgaatccaggccaagacttcactgagatctcaagtctatgtattgtgaacatatgttttgtgggggaaatgaattaggtaagacatgtcatgaaacgaaggactgagagtcaatgtggttttttctttataataccttcagtagcaaaaattcctttccttatttataggcatcctttcatactttgcctttatcatagagaagaatatatctctggtcctttttagtcaatatctatgaacagctgaaaatacaatgaaagtaagaattgcttcccaaagttcctgtttgcatttccgtttatttacatatgttcctttagacctatatagacccaaaacaacctgagataaatgccactcataactgtatccctcaggggagcatataattaacaaaagcccatatatttgagcttaactgattaatcattttccctcaactctttccattataattcagtttgctttgtgttaattcctttttttaaataatctctcaactcctcctatcacccaggctgaaaaacccaggaatcaccaaagaccctctccctcaactcctgcagccaaagcccagtccaacagaatctatccaacttccttatttcacttttccagctctgattggatttgtatctataataaatcaaaaagaggtcaactaagaacaaaactaacatcattagaataaaatcaccttataaactggaatgcaaggtgctaatgttattacttttcattctgataaaatcaccttataaactggaatgcaccatgctaatgttattacttttatcttttttttagtttgtactgcacatcacagttttaatttttttaacttttaagttcatggttcatatgcaagtttgttatataggtaaatttgtgtgatgtgggtttattgtacagattattttgtcacccaggtactaagtctagtactcattagttatttttcctgatcctctccacccttccagcctccaccctctgataggtcccagtgtatgttgtttccctctatgacttaaacaaaatgacaaaaaagagcaaacaaccacatttaaaagtgggcaaagaacgtgaacactttcctaaagaagatatacctgtggccaacaagcatatgaaaaaaagctcaatatcaatgatcattagagaaatgcaaatcaaaaccacaatgagataccatctcgcaccaatcagaatggctattattaaaaagtcaaaaaaatagatgctgtcaaggttgcagagaaaagggaacatttatacacagttggtgggaatgtaaaattagttcaaccattgtggaagacagtgtggaaattcctcaaagatctaaagacagaaatacaattcaacccagtaatcccattactgcatatatactgagaggaatataaatcattctgtcataaagacatgcacacatgtgttcattacagcactattcacaaaagcaaagacatggaatcaaactaaatgcccatcaatgatagactggataaagaaaatatgctacctatacaccatggaatactatccagtcataaaaaataatgagatcatgtcctttgcagggacatggctggagctggaggccattatccttagcaaactaatgcaagaacagaaaaccaaacattgcctgttcgcacttacaagtgggagctgaatgatgagaatgcatggacacacagaggggaacaacatattatttttatctttacttgaaaagtatgtcttgatttcctccatataaaattcaagaccttggggatgcagacaaaataggttgtttcatgtggggtttatgataggctgaataatagccctttcaggatggctacatcctaataaccagaacctgtgaatattttaccataaacacacatcacaaatggacctatgaagctacaattaaggttcctgagagtgagagattattatggattatctggatagacccaatgtaatcacaagagtccttaaagaaggaaaaaagggtcagagtcagacaaggtaatgagaagagggcaagggccccaatagtctcaaccccttataacatacattcaaatacaaaataccatctaaatctcatcagcttaaaagtcccaaaccttatcatctaaaggatctatgggtgaggctctggatataatctatcctggagaaaaatacctctccatctgtggatctgtgaagctagaaaataagttatcagatcaaaaagtacaatggtggcacaggcataagataatcaatatagacattctcattgggagaaaatagaaggggaaaaaggggtcactattcccatgacattttgcaatccaactgggaaaattctatcatgtttcaaaacccaggaataatcctctgtggctggagggtccatcctctgggcccgtggctctgccatgacctcagagttatccttcttttcatgaagggtaatgtgtctaaacctgagttattttattagcctgttttctaactggagaattttggaagtcaaacaaacttctatcattttgttctttctctgtctctttcagtccaagctggcagtgtttctgctgatacaacattctcaaaaactttgtgggtctcccacacatgttacagggagtaaatccatcaaacaagaggctcttccacaaatatatgcaggataatcccatttttattcctggctcctattgagatctgtgaggggatccatgagtcatatacttaatcttttcaaacacttttctgtgtgattaaaatactgaccttatctaaaatcgttccaaggcacaagcaaaagactgctcagccaaacctttggcattctctccagagcatactttcttgtaatcaaatcttctaactttagcagtttttgaaagctgaatagactgagaatttcctaaattatcaagtcctagttcctttttgtttaacagttcttcccttaatctatgtctttcctctcacattttactataagaaacaagaaaccaagccacattttcaacagtttgcttggatttccaagcaaatttcctcggctaaatctccacgctcatggcttagaaattctatttcccacatgactgcagaacaaaattctgctgagtcttctgccaccaaataacaaagaacccttaattccatctgggccattatgaggagttcctttagtattcctatttctatagtttatttataatagctttaatattctctaagacaatttaatttttctctattatgttcctcacttccttctgagcccttactagcagagtccttagtatctatatttccactagcaatctgttcacagaaatctaggcttttctatcatgctcctcaacattcttccagcctcttcccactggaaatcacaaccacatttttaggtatttgttagcgcataacctcacttccaaatctatgttagcttcctacttctgctccaataaattctcactaacttagtggcttgaaacaatgcacatttatcttctttttctggaggttagaaatctaaaatagattttgaaatgtactgacatttatgagtcttacatgactaaaattaaagtgtcataatcttcattccttatggatactttagggaaggatccattccttgcctttcccagcttcaaaaggccgcccgcattccatggctcatggctacatcacttggatctccgcttctgtcatcacatctctttctctccctctgcttctgtcatggcattgctttttatgacactacccctcatgccttcttctcataagaacccttgtgatttgtctggacccacagaagtaatccaggataatctcaagaacattaacttaatcacctgtgaagccctttttgctatgtagtcatacctcattttattgtgctttgctttattgctctttgcacatattgcctttttacagattgaagttttgtcacaaccctgcatggagcaagcctatcagcaccatttttccaacagcatgtgctcacctcatggcttggtgtcacattttgataattctcacaatatttcaagttttttattattattatattttttgtggtgatttgtgatcagtgacctttgatgttactactgtaatcacttgaggcaccatgatccactatcacatagaatggtgaatttaatcaataaatgttgtatgtgttctgactgctccaccaaccagcctttgccctgtcttgttctttctccttgggcctcctagttcctgagacacaataatattgaaattagactgataaataaccctataatggcttctactgttccagtgaaaagaagagtcatacatctcattttaaatcaaaaactacaggcccagtgcagtggttctacctgtaatcccagcactttgggaagccaaggcagacagatcacttgagctcaggagttcgagaccagcctggccaacatagtgaaatcccatctctattaaaaatacaaaaaaaaaaaaaaattagctgggcatggtggcaggttcctgtaatcccagctactcgggaggctaaggcaggagaatagcttgaacctgggaggcgggggttgcaataagcagagattgcaccactgaacttcagactaggcaacagagcaagagtccatctaaaaataaaaaataataaataaataaataaaaagctacaaatgattaagcttggtgtcaggcctcgagcccaagctaagccatcatatcccctgtaacctgcacgtacacatccagatggccagttcctgccttaactgatgacattccaccataaaagaagtgaaaatggcctgttcctgccttaactgatgacattgtcttgtgaaattccttctcctggctcatcctgactcaaaagctcccctactgagcaccttgtgacccccaactcctgcccaccagagaacaattcccctttgactgtaattttcctttacctacccaaatcttataaaacggccccacccctatctcccttcgctgactcttttcggactcagcccgcctgcacccaggtgattaaaagctttattgctcacacaaagccagtttggtggtctcttcacacggatgcgcatgaaatttggtgccgtgactcggatcaggggacccttggagatcccttgggagatcaatcccctgtcctcctgctctttgctccgtgaaaaagatccacctatgacctcgggtcctcagacccatcagcccaaggaacatctcaccaattttaaatcgggtaagcagcctcttcttactctcttctccaacctctctcactatccctcaaccactttctcttttcaatcttggcaccacccttcaatctctcccttctcttaatttcaattgctttcattttctggtagaaacaaagaagacacattttatccgtggacccaaaactcaggcatcagtcacagacttgggaagccagccttcccttcatgtttaatcattgcagggacgcctctccatttacccacgtttcagaggtgtctgaccacgcagggatgcctgcctcggtccttcacccttagcagcaagtcccgcttttctgggggaggggcaaaaaccacaaccccttctctccctgtctctaccccttctctgcttttctggggtgcaagaaccccccgatcccttatttccgtgccccgacctcttatctctgtgccccgatcccttatttccatgccctgacctcttatctctgcaccccaattccttatttccatgccctgacctcttatctctgcgccccgatcccttatttccacaccccgacctcttatctctgcaccccaaccccttattttggcgccccgacacctttcccacttttctggagggtaagaacctccgaacctcttccctccatgtccctactctctcttttctctgggcttgcctccttcactatgggcaaccttccaccctccattactccttcttctcccttagcctgtgttctcaagaacttaaaacctcttcaactcacacctgacctaaaacctaaatgccttattttcttctgcaatgccgcttgaccccaatacaaactcaacagtgattccaaatagccagaaaatggcactttcaatttttccatcctacgagatctaaataattcttgtcgtaaaatgggcaaacggtctgaggtgcctgacatccaggcattctttcacacatcagtcccttcctagtctctgttcccaatgcaaatcgtcccaaatcttccttctttccctcccgcctgtcccctcagtcccaaccccaagcgtcgctgagtctttctaatcttccttttctacagacccatctgacctctcccctcctcgccaggccgagctaggtcccaattcttcctcagcctctgcttctccaccctataatccttttatcacctcccttcctcacacctggtccagcttacagtttcattccgtgactagccctcacccacctgcccagcaatttactcttaaaaaggtggctggagctaaaggcatagtcaaagttaatgctcctttttctttatcccaaatcagatagcatttaggctctttttcatcaaatataaaaactcagcccagttcatggctcgtttggcagcaaccctgagatgctttacagccctggaccctaaaaggtcaaaaggctgtcttattctcaatatacatcttattacccaatctgctcccaacattaaataaaactccaaaaattaaattccggccctcaaaccccacaacaggacttaattaacctctccttcaaggtgtacaataatagggtagaggcagccaagtagcaacatatttctgagttacaattccttgcctccactgtgagacaaaccccagccacatctccagcatacaagaacttccaaacgcctaaaccgcagtggccaggtgttcctccaggcccgcctcccccaggagcttgctacaagtgccagaaatctggccaccaggccaaggaatgcccacagcccgggattcctcctaagccgcgtcccatctgtgtgggaccccactgaaaattggactgttcaactcacctggcagccactcccagagcccctggaactctggcccaaggctctctgactgactccttcccagatcttctcggcttagtggctgaagactgacactgcccgatcgccttggaagccccctagaccatcacggacgccgagctttaagtaactctcacagtggaaggtaagtccgtccccttcttaatcaatacggaggctacccactccacattaccttcttttcaaggcctgtttcccttgcctccaaactgttgtgggtagtgacggccaggcttctaaacctcttaaaactccccaactctggtgccaacttagacaatactcttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccatgttagccaggatggtctcgatctgacctcgtgatccgcccgcctctgcttcccaaagtgctgggattacaggcgtgagccaccgcgcccagccgacaatactcttttaagcactcctttttagttatccccacctgcccagttcccttattaggccgagacatttaactaaattatctgcttccctgactattcctggactacagctgtatctcattgccacccttcttcccaatccaaagcctcctttgcgtcctcctcttgtatccccccaccttaacccacaagtataagatacctctactccctccttggcgactgatcatgcacccctcaccatctcactaaaacctaatcactcttaccccgctcaatgccgatatcccatcccacagcatgctttaaaaggattaaagcctgttatcactggcctgttacagcatgggcttttaaagcctataaactctccttacaattcccctattttacctgtcctagaaccagacaagccttacaagttagttcaggatctgcgccttatcaaccaaattgttttgcctatccaccccatggtgccaaacccatatactctcctatcttcaatacctccctcaacaacccattattctgttctggatctcaaacatgctttctttactatgcctttgcacccttcatcccagcctttcttcgctttcacttagactgaccctgacacccatcaggctcagcaaattacctgggctgtactgccacaaggcttcacagacagcccccattacttcagtcaagaccaagtttcatcctcatctgttaccaatcttggcataattcttataaaaacacacacgtgctctccctgctgattgtgtccgactaatctcccaaacctcaatcccttacaaaacaacaactcctttccttcctaggcatggttagtgcagtcagaattcttacagaagagccaggactgcaccctgtagcctttctgtccaaacaacttgaccttactgttttagcctagccctcatgtctgcgtgcagcggctgccgctgctttaatacttttagaggcccttaaaatcacaaactatgctcaactcactctctacagttctcataacttctaaaatctattttcttcctcacacctgacacatatactttctgtttcccggctccttcagctgtactcactctttgttgagtctcccacaattaccattgttcctggcccagacttcaatccagcctcccacattattcctgataccacacctgacccccatgactgtatctctctgatccacctgacattcactccattttcccatattctttcatgttcctcaccctgaacacacttggtttattgacggcagttccaccaggcctaatcgccactcaccagcaaaggcaggctatgctatagtatcttccacatctattattgaggctactgctctgcccccctccactacctctcagcaagccgaactcattgccttaagccctcactcttgcaaaagcactaaaagtcaatatttatactgactctaaatatgccttccatattctgcaccaccatgcgagaggtttcctcactacacaagggtcctctatcattaatgcctctttaataaaaacgcttctcaaagctgctttacttccaaaggaagctagagtcattcactgcaaaggccatcaaagggcatcagatcccatcgctcaggacaatgctcatactgataagatagctaaaaaagcagctagcattccaacttatacccctcactttcagtttttctccttctcatctggccactcccacctactcccccgctgaaacttccacttatcaatctcttcccacacaaggcaaatggttcttagaccaaggaacatatctccttccagcctcacaggcccattctattctgtcgtcatttcataacctcttccatgtaggttacaagccactagcccatctcttagaacctctcatttcctttccatcatagaaatctatcctcaaggaaagcacttctcagtgttctatctgctattctactacccttcagggattgttcaggcctcctccctttcccatacatcaagctcggggatttgcccctgcccaggactggcaaattgactttactcacatgccccgagtcagaaaactaaaatatctcttagtctgtgtagacactttcactggatgggtagaggcctttcctacggggtctaagaaggccaccgcagtcatttctttccttctgtcagacataattcctcagtttagccttcccacctctatacagtccaatagcagaccagcctttattagtcaaatcagccaagcagtttttcaggctcttggtattcagttaaacctttatttcccttacagtcctcagtcttcaggaaaggtagaacggactaatggtcttttaaaaacacacctcaccaatctcagccaccaacttaaaaaggactggacaatacttttacctctttcttttctcagaattcaggcctatcctcggaatgctgcaaggtacagcccattggagctcctgtatggacgctcctttttattaggccccagtctcattccagacaccagaccaacttggactgtgccccaaaaaacttgtcacccctactatcttctgtctagtcatactcctattcaccgttctcaactactcatacatgccctgctcttgtttacactgccggtttacactgtttctccaagtcatcacagccaatatctcctggtgctatcccaaactgccactcttaactcttaaagtaaataaataatctttgctggcagggctatgctgaacctccttaggcactctctaattagatgtcctgggtcctcccaattcttagacctttaatacctgcttttctctttctcttattccgttcagtttttcaattcatacaaaactatatccaggccatcaccaataattctaaatgacaaatgtttcttctaacaaccccacaatatcaccccttaccacaaaatcttccttcagcttaatatctcccactctaggttcccacgccgcccctaatcccactcgaagcagccctgagaaacatcgcccgttatctctccataccaccccccaaaattttcgtcgtcccaacactttatcactatttcattttatttttcttaatataagaagacaggaacgtcaggcctctgagcccaagctaagccatcatatcccctgtgacctgcacatacacatccagatggccggttcctgccttaactgatgacattctaccacaaaagaagtgaaaatggcctgttcctgccttaactgatgacattgtcttgtgaaattccttctcctggctcatcctgcctcaaaagctcccctactgagcaccttgtgacctcccactcctgcctgccagagaacaacccccctttgactgtaattttcctttacctatccaaatcttataaaacggccccacccctatctcccttcgctgactctcttttcggactcagcctgcctgcacccaggtgattaaaagctttattgctcacacaaagcctgtttggtggtctcttcacactgatgcgcatgaaacttggtgaagtatgtatgtcaaaagctgagataggctaaaacctaggcctcatgtgccaaacagttagtaaatgcattatgtaagaaatacatttcaagttgtgaatgcaaaggaaaagttcttgaaggaaattaaaagtgcgactccagtggacacataaatgataagaaagggaaacagcctgaatgctgatatggcaaaagttttagtgctctggaaagatcaaaccagccacaacatttacttaagccaaatgctaatccagaacaaggccctaactctcttcaattctatgaaggctgagagaggcaaagaaactgcagaagaaaattttgaagctagcaggggttcatgaggtttaaggaaagaagccatttccatgacacaaaagtgcaagaagcagcaagtgctgatggagaagctgtagcaagttatccagaagatccagctaaattgataaaggtgactacactaaacaacagattctcaatgtagatgaaacagccttctattggaagaagattccatttaggactctcataaccagagaggagaagtcaacgtctggcttcaaagcttcaaagaacaggctcactgttttgttaggttgtaatgcagctggtaactttaagttgaagccaatgctcatttgccattctgaaaacactaaagcttttaagaacgatgttaaatgtactctgcctgtgctctataataaaataataaagcctggatgacagtacatttgtttacagcacagtttactgaccattttaagcccactgttgagacctactgcttaaaaaaagattcctttcaaattattattgctcatcgacaatgcacctaattacccaagagctctgactggaggtgtacaaggagactaatgttttcatggttggtaacacaacatccattctgcagccaatggatcaagcagtaattttgactttcaagtcttatgtaagaaatacagggtgggaccaagatggccaactagccaacaagaagcagccaccgtcagaggctcccatcaaaaagaaccataatagcatgtgaatcctgcactggcaactgaggtatccaggttctctcatcagaactgactaggcagctggtgtgacctacagagagaaaggaagcgcagtggtgcagggggcccacctgagagccacacagggcaggtgggtccccacccccccgccaagggaggtgatgagtgagtgtgccatccagcctgggaaaccatgctttttccacagactgtgcaacctcctgatcagaagatctcactcatgaaatcacaacaccagggcctaggatcccaaccacagagccctgcagattctcaaaagcctctcagctagactctgcttaagcctgctgagttcccggtggggaggggcgactagcaccacagttgcggctgcctgttgtttaagccatttgagctctttgggggaggggcagcagccagcactgggactgatagctgcctaacacactaagctccctgggcaggggaagggtggcagccatctctatagctccaggctacacttttcccctgctggagccaggaaggcttggttccgagaggggtcccccgcagcacaacacaccggctgtggcagactgtggccagagtgcctcttcaggcctgacactgacccatccctcctcactgggaggggcctccctgcaggaactccaactccaggcaggggctcaggcacaaagctctgatctccctggccggagccactaggggtaggggtgaccacagtctctgaggaccagcagacttagcctttcctcctgctagttctgagaaatctgggcagcccagatgagtgggtttcccctcagcaaagcactccccctccaccaagggatagtcaaagagcttcattaaacgggtcctgctccctgtaccacccaactaggtgagaccatcaaacaggggttgtcagacatcctatacaggagtgatcatactggcatcagatcggtgctcctcgaggtcagagttcccagaggaaggaggaagcacccatctttgctgttttccagcctccttgagtgactggctccaggcacaggagcgagccagatgaatagtgcctgaagtgaatgcccagcaaaccacaacagccctacagaagaggggcctgaccattgaaagaaaaacaaacagaaagcaacaacaacagcatcagcaaaaagtgtctccccaaaaaaacccatcaaggataggcagcctcaaatatcaaaactagacaaattcatgaagatgagaaaggatcaacaaaaaaaaaaacactgaaagcccaaaaggccagagtgcctcttctcctccaaatgattgcaatgccgctccagcaagggtgcagaactgggcagaggatgagatggacaaattgacagaagtaggcttcagaaggtgggtaatatcaaattctgctagctaaaggatcatgttctaacccaatgcaaagaagctaagaaccttgaaaaaaggttacaggagctgctaactagaataaccagtttagagaggaacataaataacctgatggagctgaaaaacacagcggaagaacttcgtgaagcatacagaagtatcaatagccgaatcaaccaagaggaagaaagtatatctgagtttgaagaccaccttgctgaaataaggcatgcagacaagattagaggaaaaagaatgaaaaggaatgaacaaaacctccaagaaatataggattatgtaaaaagaccgaacctacaattgactggagtacctgaaacagacagagaaaattgaaccaagctgcaaaacacacttcaggatgttatctaggagaatgttgccaacctagcaagataggccaacattaaaattcaggaaatacagtgaacaccactaagatactccatgagacaatcaaccccaagacacataatcattagattctccaaggtcgaaaggaaggaaaaaaatgttaagggcagccagagagaaagaccaggtcacccacaaagggaagcccatcagactaacagcagacctctcagcagaaacggtacaagccagaagagagtgagggccaatattcaacagtcttagaaaaattattttcaactcagaatttcatatccagccaaactaagcttcataagcaaagaagaaataaaatcctttccagacaagcaaatactgagggatttcatcaccaccatgcctgccttacaagagcccctgagggaagcactaaatatgaaaaggaacaactggtaccagccattgcaaagacacatcaaaatataaagaccaatgacactatgaagaaactgcatcaactagtgtgcaaaataccaaggtagtatcatgatgacaggatcaaaatcacatataacaatattaaccttaaatgtaaatgggctaaatgccccagttaaaagacacagactggcaaattggataaagagtcaagacccatcagtgtgctgtatttaggagacccaactcatggtcaaagacatacataggctcaaaatgaagagatggaggcaagtttaccaagcaaatgaaaagcaaaaagaaagcaggggttgcaatcctagtctctgacaaaacagactttaaaccaacaaagataaaaaaagacaagggcattacataatggtaaagggatcaattcaacaagaagagctaactatcctaaatatgtatgcacccaatacaggagcacccaaattcataaaacaagttcttagagacctacaaagagacttagactcccacacaataataaaaagggacttctaacaccctactgtcaatattggacacatcaatgagacagaaaattaacaaggatattcaggacttaaactcagctctggatcaagtggacctaaaagagatctacagaaccctccacaccaaatcaacagaatatacattcttctcagtgcatggcatttattctcaaattgaccacaaaattggaagtaaaacacttctcagtaaatgcaaaataactgaaatcataacagcctctcagaccacagtgcaatcaaattagaactcaggattaagaaactcactcaaaaccacacaattacatggaaattgaacaacctgctcctgaaggactcctgggtaaataatgaaattaaggcagaaatcaagttatttgaaaccaataagaacaaagagacaatgtgccagaatctctgggacacagctaaagcagtgttaagagggtagcactaaatccccatatcagaaagctagaaagatctcaaatcgacaccctaacctcacaattaaaagagctagagaagcaagagcaaactaatccaaaagctagcagaagacaagaaataactaagatcagagcagaactgaaggggatagagacacaaaaaaccctcaaaaaaatcaataaatccagcagctggttttttgaaaaaattaacaaaataggtagactgctagctagactaataaagaagaaaaaagaatcaaatagacacaataaaaaacgataaaggggatattaccacttatcccacagaaatacaaactaccatcagagaatactataaacacctctatgcaaataaactagaaaatctagaagaaatggataaattcctggacacatacatcatcccaaaactaaaccaggaagaagtcgaatccataaatagaccaataacaagttctgaaattgaggcagtaattaatagtctaccaaccaagaaaagcccaggaccagaaggaatcacagccaaattctaccagccaaattctacaaagaggagctggtgccattccttctgaatatgatccaaacagtgaaaagcaggtactcttccctaactaattttatgaggccatcatcatcctgataccaaaactgggcagagacacaacaaaaaaaagaaaatttcaggccaatatccctgatgaatattgatgcaaaaatcctcaataaaatactggcaaaccgaatccagcagcacattggaaaacttatccaccacaatcaagttgacttcatccctgggatgcaaggctagttcaacatacacaaatcaatacatgtactccatcacacagacagaaccaatgacaataaccacacgattatctcaatagatgcagaaaaggcctttgataaaattcaacatgtcttcatattaaaaactctcaataaactagatattgatggaacatatctcaaaataatcagagctatttatgacaaacccacagccaatatcatattgaatgggcaaaagctggaagcattccctttgaaaactggtgcaagacaaggatgccctcactcaccactccctttcaacataatattggaaattctggccagggcaatcaggcaagagaaagaagtaaagcatattcgaatagaaagagaggaagtcatattgtccctttttgcagatgacatgattctacatttagaaaacccagcatctcagccccaaaactccttaaactgataagcaactttggcaaagtctcaagatacaaaatcaatgtgcaaaaatcacaagcattcctatacaccaacaatagacaagcagaggaccaaatcacaaatgaactcccattcacaattgctataaagagaataaaatacctaggaatacagctaacaagggatgtgaaggacctcttcaaggagaactacaaaccactgctcaaggaaatcagagaggacacaaacaaatggaaaaacattccatcctcatggataggaaaaatcaatgttgtgaaaatggccattctgcccaaagtaatttatagattcaatgctattcccatcaagctaccattgacaatcttcacagaattagaaaaaactattttaaatttcatatggaaccaaacaagagcccatatagccaggacaatcctaatcaaaaagaacaaagcaggaggcatcacactacctgacttcaaactatactacaaggctacagtaaccaaaacagcatggtactggtaccaaaacagacatatagaccagtggaacagaacggagaactcagaaataacaccacacatctacaaccatctgatctttgacaaacctgacaaaaacaaacaataggaaaagaatttcctattcaataaaaggtgctgggaaaactggctagccatatgcagaaaactgaaactggaccccttccttataccttttacagaaattaactcattaaagacttaaatgtaaaacccaaaaccataaaaaccctagacgaaaacttaggcaataccattcaggacataggcatgggcaaagacttcatgatgaaaacaccaaaagcaattccaacaaaagccaaaattgacaaatgagatctaattaaagagcttctgcacagcaaaagaaactatcatcagagtgaacaggcaacctacagaatgggagaaagtttttgccatctacccatttgacaaaggtctaatatccagaatctacaaggaacttaaacaaatttacaagaaaaaaaaatccccatcaaaaagcgggcaaaggatatgaacagacacttctcaaaagaaaacatttatgtggccaatgaacacatgaaaaaaagctcaacatcactgatcattagagaaatgcaaatcgaaactacagtgagatactgtctcatgccagtcagaatggtaattattaaaaagtcaagaaacaatagatgcttgggaggctgtggagaaataggaacacttttacactgttggtgggaatgtaaattagtccaaccattgtggacgacagtatggcaattcgtcaaggatctagaaccagaaataccatttgacccagcaaccccattactgggtatatatccaaagaattgttccattataaagacacatgcacacatattatcactgcagcactatttacaacagcaaagacatggaaccaacccaaatgcccatcaatgatagactggataaagaaaatgcggtaaatatacacgatggaatactatgcaaccataaaaagaaatgagaccttgtcctttgcagggacttggatgaagctggaagccatcctaactaactaactaacaggaacagaaaactaacacaggaagagaaaaccaaacaccgcatgttttcactcataagtgggagctaaacaatgagaacacatttagcggacaacagcatagtgtaaatacaacttttatatgcacttggcaatcaaaaaattcatgtgagttgctctactgcagtattcgctttattgcagtggtctataactgaatctgtagtacctccaagatatgcctgtgtaaagcaacatattcacagttctgtgtattacaatatgaacatctctgacatgaaaatatgcataaatttctcacattttataagaagtttttattcatctttctatttgaaagacgctttttccgagtataaaattctagatcaacagctaatttttggcaccttaaagacagtccattgtctttctgggtcacaaagctagtggtaagaagtccaccatcaccctcatctttgttcctctgtaagtaatgaagttttggagtaatgaagtagtttgtaagtaatgaagtcttgaagtttgccattttttttcttctggcaatttaaattttatagttgaggttcttagagtgaacttttcatttcagtaattgtacttttgaactccagaatttctatttgatttttttaatcatttctctctattgatattctctatttgatgcaaaattgttgtcctaccttcctttatttaatcatagtttcctttagttctttgaacatatctacaatggctactttctagtcattttctgttagtctgatttctgaccactgtctgcctactgtacttacaaagtatgggtcatattttcttgtttcttttcacgccttgtaaatttctgttggtaactggacattttaggtaatacatcatggcaactctgggtaaacccacccctgctctaagcttgttattatttgttttttgtttaatgactagctggactattttagtgatgttcactgtcatcctcatctttgattctctgtaagtaatgagtatttttccctttttgcatataagtttgtcactgtatcactagatttcagtaaactgaatatgacacaaatatgactattttccacctgcagtgttaaatctttggtgctgctcctcaaggagttgtagctttgtgcatgtatgctcacatatggtcactagtatgacagtggttttggcaggactctttttgtcactttctctgaccacgtccaactgttaagctatactaagtgccagctgatttatgtactgctttcaacaatactgtggtgcttaaattgttctatagactaatccatcaaattcgggttcctttgaaggagtagttcctacattgtttgagatttgctctgttgaggagctctgaccacagatgggctcccacaagctgtctctttccaagggtctctgcttttccctccaggcaaaatctcaagtcaagtcaagttgagtcaaggctctggaactagggtggcagacaattgcacactctctctaaatgacaccctcactttaagagctgagtgctcattgggggccagagagggtagaagatgaacagtagcctccaacttttttggctagtttcatccagagtacaacactcactttacagactaaggcaaggacaatcagaacccctatatctcagcagtgccaaacccaaggtaaagactgcatctcatgagtggggagctgtgcagaagagaactctacttcagaacttagcctcatcaataggtagctgtggcaagatgagaaaagctgatatccttccataggattactctctgtctgggagctgagaatagagagagccttgtgttttgggctgcactagtttggaataaagtttccatctcactaagctgggaaaggggataggagggaaagggtctcagttccccatagagtcttgctgttcttaccacaatacagattttctggaataaacgtttcttcatctacttattatttaaatgtccgtaagactatttccagagacattaaatggtatgttgttgggtatttttgtttttgtttttgttttgtttcttttgtttgtttgcttgtttttgagatagagtttccctctttttgcctaggctggagtgcaatgttgttatctccgctcactgcaacctccacctcccaggctcaagtgattctcctgcctcagcctccctcccaaatagctgggattacaggaatgcaccaccacacctggctaattttgttttatgtttatttgtttgtttttgagaaaatgtctcactctgtcacccagactggagtgcagtggcacgatctcggctcaccgcaacctccgcctcccaggctcaagcgattctcctgcctcagccttccaagtagctgggattagaagcgcacgccaccacacccagataatttttgtatttttagtagagacggggtttcaccacgttggccaggcttgtctcaaactcctgacctcaaatgatccactcgcctctgcctcccaaagcgctgggattataggcgtgaaccaccgtgccgtgtgtgtgtgtgtgtgtgtgtgtgtgtgtgtgtgtgtgtgtgtgttttaattatcttcaccagtttttctggagaaagagtctgctgagcttctcatgctattatgccagaagtccctcccagtcaattaacaaaagtggcaaggtaattcaatgagaatactagagtctttttcaaaaaatggttctagacaatgaatatgggaaaaatgaaactcaacctttccttataccatatgcaaaataatttggaatgaattacagcctaaaatatgagtcaaactattaaacttctagaagaaaacacaggaagaattatttgtaattttgggataggcaaagatatcttagctaagacacaaaaaacatgaatcatacacacataaaaactgtaaaactgggcttcatcaaaaatttttaaagtttgtcctttaaaagatactgtttgaaaaattaaaaggcaagccaaagactacgagaataactttaaaaccagaaatctgatgaagaacttgtttttgagatatataaagaattcgttcaactgaataataatatagacaatccaatttaaaaatgggcaaaagtttgaacagatacttcatcaaagaagatatgaaaaatggcaggtaaataaatgatgttctataatattggtagtctttaaggaaatgcaaattaaaaacataggattgcactatttacctattaaaatggctaaaacttaaaagactgatgatatatatagcaagggtacagagcaactgtaatacttatacattactgattggaacttaatacggtacagccactttggaaagcagtttggcaatttctccaaaagttaaacacagacataacatacagtgcagtaatcccactcttacatgtttacccaagagaaataaaaacacaaagacttacatgcaaagattcataactttattaattacagccaaaatctggaaacaacccaaaagtctatcaacaggcaaatggaaaaacatgttgtagtatagccttacaataaaatactactcagcaacaaaaggaatgaaaatatcagtgaaagaagccaggcacaaaagactgtatgattctatttgtatgaaattctagaaaaaaaaattatagtgatagaaaacaaatgtgtggttgcctcagggtgggactgttgtgtggaaattggccaaaggggcatgagagatctttggaagaatgatgaaaatattttatatctttattatggttttagttacattactatacatttttcaaactcacccaaatgaatcctgaatgaattttattgtatgtaaattatatctctaatttttttaaaaaggtcaatagaagcaatgtattaaatagtttaatagtagagaaagatcagaaagatcaagacagagacactgtcttcatgtatattaacgtactggatatcagagattctgaaattatgttagatatcaagtgaaaatattcttttgtcaatcattttcattcagttataagaccaacatttatcttaagccagatttgtgaaaattcaatgtaaaaataattatcatactatttcacaagagtgttattgttccttgctcattaaaaaaaaaaagagcaagagcttgttgagatgtcatagctaacaaagctataataaactgggatttttttcagcaaatgtttgcttccctttcctctttgggtcagggtatactttccactcccactgcctttatgcttggccatgcgacttgccttggccaatggaatatgagcatgcaggatatctgcagaattttaaatgtgtttgcctggcttagcttgcacttgaactcctataatcaacatacaattacaacataggcaaccagtgcctcgttaggctggatcaaagcgtgaagcttaaggggcaaacctgaacttacctcaaagcctgaaactgaactacagcataaagcagagccacttatgagtgagaaaattaaaagcttgccatgatacgacaataaatttggtggaggtttgttacagcattattatggcaagagttgactcatgcaaagctaacatttgaggagaaattacaatgttctaggcactgagctacaaactttacatatattacccatttaattatcacaatgactctgtaagagaaaacattttacattgtctttctaaaatacatgatgaaactgaagcacaaataggataattgcattatccaaagtctcagagctagtaagtaaccaagtagggtttaaacccaggatgttataattctaatactcacccaatgcactaattatcaagatcaaattgaatttttaaattctattcttctagttggggtgttaaataatggttaacactcttcaatctccataaacccttttcttctcttccacctaacctgcccatcttcatacctgtatctaaacaaccatctgtttactgtaccccaactattgggttgtcagtagctagaaaagtacgctgccttgactccattacaaggttagctgatggactttccatatagctttgcaaaattgtgcttattcatgttgattccattttgcattccccacaatagctgttccaaaccttaatcaccaagataagccctaatttcaatatcactcctcactctcagaggctctgcctccaatttctcagcgaatgaatattccatgaggcattacatttctcaacttttttcctctctgccttatacctatctttacctctctttactccttgctcttgtgtctcaaatgactaattctacccccatattcttgtctttcttccttcccataccttgttctacagatttaacatcttcctttttttctctctactagaaaacctacatactcatttctcccacatctttttttgctcttgttgcccaggctggagtgcaatggcatgatctcagctcactgcaatctccacctcccgggttcaagcaactctcctgcctcagcacccccgagtagctgggattacaggcatgcgccaccacgcatggctaatttttgtatttttagtagaaatggggtttcatcatgttggtcaggctggtctcaaacacctgatctcaggtgatccgcccgcctcagcctcccaaagtgctgggattacaagcatgagccaccatgcccagccctatttctcccacatcttaagccaactttcccacaaacctgatgcctccacaaaccaccaactcatctttctccctgctttcactgttaaacttcttgacaaagtaggtgctgtatcagctatctttactttttcacctccaagtcactccttaatacattacaggataagttccccttctgtgaactttaccaaaattattctctcaaaggacactgacagtttccaaattgcccaagtcagtgatctcctctcagttatcatcttaaccaagcctttctctagttttaaatgacactgttgactacatacatcaactccatccctccagacccaccctgcacctcattgttcctccttctatgttctctattatggttactggtaccattcagtcacccagcctagaagtcttaaggtcaatctagtctttttctctctcacatcatagcctcttaacatctccaatattatttttattactattttgctcttataatctctcagttggactattcaaaaagtcttctaagatggaagttgatagcaataaacacctacatcaagaaacgtagaaagatttcaaataatcagtctaatgatgcacctaaaggaattagaaaagcaagaataagccaaatcccaaagttagcagaaggaaagaagtaataaaaatcagagcagaaataaatgaaatagagaccacaaaaataaaaaagatcaacgaaatgaaaagttggcttttcaaaaagataaaattggtaaaccactagctagactaaccaagaaaaaaagagaagtccaaataaataaaatcagaaattaagaaatggaacatcacaaccaataccttagaaatacaaaatatcatcagagactattattaacagctatacataaacaaactggaaaacccagaggaagtggataaattcctggacatatacagcctaccaagaataaatcaggaagatacagaaaacctgaacagaccaataataagtaatgaaactgaatctgtaataaaaagcctcccaacaaggaaaggcttggaccagatggcttcactgccaaattctaccaaacatataaagaagaactagtactaattctcctcaaactattccaaaaaaataaagaggagggagttctccctaactcattctatgaggctagaattaccctgatactaaagccagacaaggacatataccaaaaaaaaaaaaaaaaagaatatccctgaaggacatagacacaagaatcttcaacaaaatactagcaaactgaatatcatagcacatcaaaaagataacacatacaccatgatctagttgcatttatcccaggttgcaaggatgtttcaacatatgcatatgaataaacataatatatcacatcaacagaatgaaggacaaaaatgatatgatcattgatagatacagaaaaagcatttgataaaattcaacaatgcttcatgataaaaattctcaacaagctagcatagaaggtagatatctcagcataataaaggccatatatgataaacccacagctaacatcatactgatggggaaagcatttcctctaagaactagaacaagacaaagatttccactttcaacactctatgcaacatagtactggaagtcctagccagagcaatcgggcaagagaatgaaagaaaaggcgtccaaactggaaaagaagtaaaattgtccctctttgcagacaatttgatcttatatttagaaaaatcaaaagaaaccaccacaaaaaaaaactcttcaaactgataaattcagtaaagttgcaggacgcaaaatcagcacacaaaaatcaccagtatttttatacaccaaaaatgacatagctgaaaaagaaaccaagaaggcaatcttatttacagtagctacaaaccaaataactaaaaataaatttaaccaaggaggtgaaagacatctagaaggaaaactacaaaacactgataaaagaaactgaagagggcataaacaaagagaaagacatcccatgttcacagatcagaggaattttatggcaaagaattcaaaagcacagacaacaaaaacaaaaatagacaaatggaattacattaaactaaaaagcttctgcacagcaaaggaaacaatcaacagagtggagagacaacctattgaatgaaagaaagtatttgcaaactattcatccaacaagggactaatatccagcatataaggaactcaaatgattcaacaataaaaaatctaataatcccattaaaaataggcaaaggaaatgaatagacacttctcacaagaagacatacaaatggccaccagggatatggaaaatgtcaacatcactaatcatcagggaaatgtatattaaaaccacaatgagatatcatcttaccccagttagaatgactattattaaaaagacaacagatgctggtgagaatgcagagaaagggaacttttatatgctgttgataaaaatgtaaattagtacagctgctatggaaaacagtatggagatttttcaaaaaactaaaaatagaactaccatgagattcagcaatcacactgctggttatttatcatcaaaggaaggaaaatcagtatatcaaagggatacctgcaccttcgtgtttattacagcactattcacaacagcaaagacatggaatcaacttaagtgcccatcaacggatgaatggataaagaaaatgtggtatatatacacagtgaaatacttgttgtccataaacaatgagatcctgtcatttgcagtaacatggatggaactagaaatccttatgttaagtgaaataagctagacatacaaagacaaacataatatcacattttctcactcatatgtaggaggtaggaaatgcaaacttaatcaagtaatggctttcctctccttcccacttcttttccccatgcttaaaacccttcagtgggtattccataattatccattgcctagaggataaggacaaaatgtattattgggaataaaaggtgttttttggccacctctacagcatcaactcctgatcacctccccataccatgtcttttgcatccttgaaatttttccaccttgttcccttcaacatcactttttcctatttcccccctacctgtataatacctttcagtttctttctcaagttcttagatcctcgggtctttgttttttcttctcttttagttctagcaattcaattgccctgggcaatcttgtcccttctgatcaacctcattgtgtccaattaccaactattcatcaatagtttattaattttaatctacagcctccaacttctatcctaagccatagtcccatagacattctagtattgtcaataattacagctcatttattgaaaaactgctacatgccagcaattgcattagatgtgtgctagaacacatatctattaaataaacatgttctcatttaatcattacagaatgctgtaaagcaggcacaactgttccttctttgggatgaacacagacatggaatttatataatgttcccagtatcatataggtagaaagtactgaagcaggaatttaagctcagattggcaaaagaccatttcactaagatattcactactttttaccaaactccttcaaatgcacatattcttcagtacttattttattatttccaaacccaaatcactcctccatctgttattcccacattcactcatagcattactattaccaggaacaatacagaagtcttccaagtcacatttaactcctccatctaacttctccatatttgttgggtcactaagccacattctatgtctgaaaaagctcttgaatctccctctttttattgtagtatttcagtagctgtctcacagttctccagtttctgcccctgtaattatcttccatttctttgagagtttgctttctaaataaatctgactgacttctagataagatgactgaatatgcacaattctcttctctacttcctaatattccaattaaaatgatcagtgaaaccattaaaaactagagtaaccagtactacaaagaataacattctcacatcacagaattgaagaacttttgtaagtttaggccaacagaactttattgaaggaaggattggcccaaaccaagactcactagttaagaagtaacttgtctggaaagtaaataaagaaaaccaacagaatcccacaaatatgctcacatttggagatgtgaggctggaggtgaaagcagactgtgaagcaagtaggtgattccatattatattgtggcttagagttcaggtggacatttgataccaactcactgtgtcctttaagctgtaagggcatatactaatactaagtactctgtggaatattaagtcctctagtggaaggccatcttccactagacttaggcaaaggttaggaattacttccctcactccattcagggagggtattcacatacactatcatctttctccaaaatctctcccctaatctcccatctcctaactttcacaacctccatgtctttaagggatgcaaatgctgtctgactaattctaccctaactttataaattctaaaccactgtggccttcaaccccactttgaagtatggcatctagtatcttggggcttcaaaagaaacttccattttaatatccttttacattaatactctggataatgtttctatctgtgatttgatggggagggttttttttggggggggcggggccaaaaaaaaagtactcaaagctaaaaaaaaactccatccaagatcctttgtctttaaataccatttgaagttagactagtggattcaaatcctgactccagggactaactgtataagctttgggaacaatctaagcatcttaagtttcagttttataatcatatatgaataatgacaggccttcgtagaattttgtaaaaattaaataacatgttctaaacaaaactaaaaatatttctagcggcccataatgtcccagatgaaaactgccccttccacgtctctttgaccatgtcatctccatgtcatctctatgtcatctccgcctcactcatgccaatcactgttccacctcaagcgttctgctgccacttcttttttctccccctggaatattcattcctcagatagttgatggctaactgttccacctgcttcaggtctttgctcaaacacaaccttctccatccttctctgagcattccatgtaagcctaagccccttgttttacttctgcccttccctctatcccttccctgccttgatttgctccatagcacttatcatctttatcatactacatattttcacatttttactttaccttctgtctcctcccacttaatgtgggatccactaagaacattacctggcacataagaactagtcggtagccaggaacagtggctcacacctgcaatccagcacttttggagacagaggcaagagaatcacttgagcccaagtgttcaagaccagcctgggtaacacagtgagaccccatctctacgaaaaaagaaattaattagctggccatggtggcacacacttacaattccagctacttgggaagctgagggggaggatcacttgagcccaggaagttgaaactagagtgatccatgatcacacaactgtactccagcctggttaacagagggagaccgtgtctcaaaaacaaaaacaaaaacaaaaaacaaaaaacaaaaaaactagtcaataaatacaggctactgttgtaataataaatattataatgcagcacctctgtgaaatattccaggaatcagacctgactgcagcattgttcctggcttacacacagcatgtcaggcaaaagtgtatgtcagacaagaaaaaggatctgctcatatgaaagcatagggtaaaatcacaaggatcaatgagggtaagttaaatagtatcccataacatcaagttaaattaaaaattaggagaaatggggccagcaagatggccaaataggaacagctccagtctgcagctcccagtgagatcaatgcagaaggcgggtgatttctgcatttccaacccaggtacctggcttatctcactggaaatggttagacagagggtgcagcccatggagggcaagctgaagctgggtggggcatcccctcacccgggaagtgcaaggggttgggaaattccttcccctagccaagagaagccgtgagggactatgccatgaggaacagtgcactccggcccagatactacacttttcccactgtttttacaacccacagaccaggagattccctctagtgcctatgccaccagggccctgggtttcaagcacaaaagtaggtggcaatttgggcagacacctaactaggtcaggagatcgagaccaatctggcaaaatggtgaaatgccatttctactgaaaatacaaaaattagctgggtgtggtggcgcgtacatgtaatcccagctactcgggaggctgaggcaggagaatcacttgaaccaggcagtctgaggttgcagtgagccaagatcacaccacagcactccagcctggcaacagagctaggctccgtcaaacacacacacacacacacacacacacacacacacacacatcaggaaacaacagatgctggagaggatatggagaaataggaaagctttacactgttgatgggagttcgaccattgtggaagacagtgtggcaattcctcaaggatctagaactagaaataccatttgacccagcaatcccattactgggtatatacccaaaggattataaatcatgctactataaagacacattcacatgtatgtttactgcagcattattcacaatagcaaagacttggaaccaacccaaatgcccatcaatgataggctggataaagaaaatgtggcacatatataccatggaatactatgcggccataaaaaaggatgagttcatgtcctttgcagcgacatggatgaagctggaaaccatcattctcagcaaactaacacaggaacagaaaaccaaacaccgcatgttctcactcataagtggaagttgaacaatgagaacatatggacacagggaggggaacatcacacactggggcctgtcgaggtggggggcaaggggagggatagcattaggagaaatacctaatgtagatgagagattgatgggtgcagcaaactaccatgacacaggtatacccatgtaacaaacctgcacattctgcacgtttcccagaacttaaagtataatgaaaataaataaataaataaagctaaatttaaaaaaaagaataagatcatgtcctttgcagggatatggatggacctagaggccattatccttagcaaagtaacacaggaagagaaaaccaaataccatatgttctcacttataagtgggaactaagtgatgagaacacatggacacatacagcggaacaatacacactggagcctattggagggtggaaggtggtaggaaggagaggatcaggaaaaaaaaaactaatgggtactaagcttaatacctcggtgataaaataatatgtacaaacccccatgacataagtttagctatgtaacaaacctgcacatgtacccctgaacttaaaagaaaaaaaaaaacagtggaggcaattgcaaagacaataaatgatgtatttgattacattaaaaattgaaatatcaaaacattcccagaaaaattaaaaagaaagaaaaccaaagcagagtattcacacacaaaaaatataattttttaaaaaatctagattttataatttgacttaagaaacaacataacaaagactggtatggaagatgcaaaatttttaaatctaagtatgtcactgtttattaaagtagtaaaaataagagtaagtgaaatatacattaaaatgcacactagaatttggctgggtgcagtgaatcacgcctgtaatcccagcactttgggaggccaaggcaggcagatcatgaggtcaggagttcgagaccagcctgaccaacacggtgaaaccccgtctctactaaaaatacaaaaaaaaaattagccaggcgtggtggtgcacaactgtaatcccagctactcaggaggctgaggcaggagaatctcttgaacccgggaggcagaggttgcagtgagccaagatcgcaccactgccatccagcctgggtgacagagggagactctgtctcaaaaaaaaaaaaaaaaaaaatgcacactagaatttaagtttttattctctggttgcttttatttcaattactaatgttagaagctattttttagcaaatcctcacaactttgtacttttccaggcaatggccatcaatatcttcctttctctaaactggccaagaaatcttgataacaaattattttgacctcatgatattatatcagctacctctaagtgctttctctagtttatagcctagcaggcagaaactctgccttaattattcacatagtatctgatttaagtaacctattatatgcatatacttaattataataaattgtatcagggtctctcaacaaaatgaacttctattattgtaagcctacagatatagggaaagacttttgtctcaagcacgacaaaatctagaggttcacctaaaatagagattaaagaaaaagacctttcagttcctatggctattgtttcattaattttagcatacatgtaatttaccaataatctaatgtagtctattttttaaatgatttttaagtataactttgtctccattatgaatatatttttacaagttacttctaaaactaagtctatttctaaaaccacattttggaatggcaagtcatcttttctctcagaatgaaatctacaacataacgttaatcttttaaggatagagaggaagagaggattaataaagcaaatcttattccagtacaaataggaatctgtatgtggctggagaggtacctttatgctgaataattttcaagttatatgtaactttattctgcggttttctattcctgtgggactgtgagagcaggtgaaatatttgtcaccaaccataaaaaattatgaactaaagtaataacactacaataactaagctcgtctctaacagatgtattctgtggaaatttcccaagacaacagccttagaaaatggagtagtgttaatttcaactaaagttctccatattgaactatgtcttacaggtctaaagttctgatgcatctttaaataatgggttttgaaaaaagcttcatacatcttgataactttctcggctttaattgtgttgattctaacaatcctaatgagaaaaattaatgcctaaagccaatggtgataccagaaagatattaaaatacagctggcactctttatccatgggttccacgtctgcagacaagaagggtcaactaaggaacttgagcatccatggatttcagtatcctttgggttcctgcaaccaaccccctgcagatactgaaagatgactatatctggaacatacagattaaatgagatattgggaataacaaaagagggagaaatgaaggggaaaggtttcaagtgaattaattcttacttaaaaaattcatactaatagattaatttctcctttttgagagtcaatcacatgataagtcaatgtaatatttttcaatatacactaaatagtatagaatttggtgaggcacaaattccctgaactggatcaacagaagtttcttatttaaagtacaagaccatcattaaaagtttcacttacaactgtaaaccccaagaaagaacagatgctctgaagcattcttcacactgtccttaagtccctatgtccacctcttcctctgcattcagattaacttctgaaggaaatcctgaaatcaagcaaatataacactacagctacaggcattctttttttactctgcttagttcctctttcttcagtactaaaattaaagctatacaactgccttagcagcctgaataaatgttctatctttgaaggattagaaacctgcaaatggaaaaggcgttacaaacaaaacagtaacttaaaaagatacttcaggccaggtgcggtggctcatgcctgtaatcccagcactttgggaggctgaggcaggcagatcacctgaggtcagaagtttgagactagcctgactaacatggtgaaaccctgtctctattaaaaatacaaaaattagctgggcgtggtggcacatgcctgtaatcccagctactcaggaggctgaggcaggagaattgcttgaacccgggagatggaggttgcagtgagccaagattgcgccactgcactccagcctaggtgacagagtgagactctgtctcaaaaaaaaaaaaaaaaaaaaaaaaaatcagtagtatctttaggagcccaagaagccatcctaacgaaaaaaacacaaatgcttattaaggggatcctgatgaaaagactcaggatgttcaaagtcttaaatttgttttaaaaaccttcaaagtataaatagctattctaatatctaattcaataaacaaagagaataaggaaacataacataactgatcactgtaattgtgcataagtgcacatgcataaagaaccaatgattaaagacagaagtaacagtgatgttaagaaacattgatgttgcaacataacaaactaatgagaagcataagaacagtaaacattgggcaaatttgtctcaagctcatcttcatcagatttcagcttacagtatcctatctactcggaagtccttaatagtatataaaaatatctctaagcacttcaaaaaacaacattaagaagagcaaaatatggtggttttattcatgtggcttctcatttattgaaaattcagggtctccatgcttgcaatttgcaaacaactacaaacagcagcctcaattttctatcttatcacttgggaaaaagcactaaaatcatttttaatggtttattttgtaagcacaaattgtaagcatcagattgtgaaagtatcttgatgctataaacaaacagtaaaattacaatttacaatttaattaagaaaacaaaaaatataacctgtcattttattatttttaaaaatctaattgatttaaattaaatgccatgtttcatttgtcatataagaaaatataaattcacctttcatattaataattatacttcaattatattttatgatacaatatttaactactgatctaaaatatatattttcttatttttaaaatacattccataaataaaagacaatgattttctaaatatttaatggtgttcaaaaaaacagaaagaaccacattaataggagttcatgagccatatacggttggaaaaatatgctcttagataagcctgattattcccactctaccagtaataacaaaaagactcagttatgtaagtaatttgtgtccaagtttacataactggtgagcagcaacactagggtttaaaccagggccgtgtaactctcagcttattctatgaaatcatgatatcaatgaacaaatgaatgaattttatttccccaaggtttctgaataagaagctatttccacacactgttaggtggcttcattgtgccatcaataataacacagatacaattaaggaaataattcagtgtaacaaatattttctctagtccctatccaagtgtttagtactcaaaaatgaaatgctcatgtattagcaatctggctatcaaccaattcaaattaaaattccatttaccaatgtcatcaattacttcctaatgtcaactcttttgcagttttcattgcttgtggcctcagcagtcagtcattttccctcaaatattctcatttagttcctgttatgttacattaccctgaattttttctacctcttcattcccttgcttctatacaatcattgtaatgacataagtacaaatattaacaaaagtatatcagtgcaacaaaaaatatgacagagtaagtaacattaactaggacagagagaggtataaacttctagatcccaaaattctcactaagggatggatggctgtaaatgactgtattggaaagtcacatcagttcagacctcaggaggcagtattgtcccatctgggcatagtcttacatacagaagcaatccagcctgcatctgagacaggtgtatttttttctaacttcaagttgtataacatgtaacatgactgcaagagtactatacataacacattcaagcagttttttaaatccttaatcctcaccctcagactctctctagtctgataaagcctagtccctataaattactaaattcagtgtcatggaactggaactacaaatccctgggagtcatgctatataatctattctaatttctttcatataccccatattccctatattcttcacactcccaaaaatgggacccttcaaaggctcaggtctgaacccctttctcctccttcaatatatcaagcttatacctttgtgtttataattccacaatcaaatctcttgccctaaaagctttcccaagctcctttttcaaacctccccctgctaggcatcaccaccttggaattttgcagtcacctcaaggttaacatgtttgaaactaaacttatcctctttctaacacagccagtttcccttcttgttttctgagttgcagaagagagtgatccctggtttcctctcttctccctctctcctgcaacctatagccaccaagtcttgtaaattcagccttcataagtttccttcctgaccaccccaatcctcatctcagccctttttcccagagaaatgcaactgtttcctaactgatttctacacaaactgtctcttcctctccctctgctcaaactatatttcacacttcacttcctgttaaaaaatctttaatggatccccattgcctataaaatatctttcatactatttatccaattatttaaaattcttgttggatccctgtctctataacctcttctctctcttctcctatacatcagtcatccaatccagtcaaattgctccaaataaaacatgcagtcccacttacgtgatgttggttggaaatttctcacgcctagaatgctctcctttctctcctacacttaactaagccctacctttcaaaattggattgctatctcaaatctctcttattaaacacatgtgaaaaatgaaccattttctcataatccttgccaaaaaacaacatctaaactcctaaagaatccatccaaaagaaacacatgagtacacctaaaatctgaaagtcaggagaagaagaataatgtatgaatgcaaatttctttttccttctatattgaagcacttttggcctcatgtgttcactttctattcttaaaggtagagacttaattctattttctacagctcttaaaggctgataatgcagttattatgattgcgactagctagctcatcttgttagagaaagtatcatggtactgggttaagtttaaatatccatatggaatagaaaacttcatttatttgggtgccacaaattgcaaccctgacccttcccagaagtctattaatatctaccatgaacaccaagataatgtttgtggccagatgaaagtaaaaacagcctaaagtgaacacccaactgattttatttccttaaaatggatttgaaatagaatattttattattagttactttgaatattattgatatttacaaaaacatacttcaagtaaatctgcctaaaattggcttgagaactatctgaagagatttttttttttagattttcagaaaaatattcctcatggaatatctttccaattttgcagcataaaaaaatagaaaacattattttgtttcttatcaaactaatttttcaattttcattcatttaacaaataatactgagtatatacttatgccagaatttttctagacaccagtaatacagcaataaactaagtagataaagctgctgctctcaagtttacattctagtggaaggagatagaaaataaacaagcaaatatataatacgttgaatcgtggtaagttctctgaagaaagataaaacagggtaatggaaatagagaacactaagaaggaaaacagagaagactttattgacaaggtgatatctggacagatattttaaggattatagctattcataaaatatggaataccagcatagccaaaattcaggtaatactgtgatgtagtaacctaatgtttcctagttacattacttaaatattctgtcctactgaattaacaaatcctgggagtaaaatatttgtaaaagcctaggctgcaaccaccctcaatcatctgatatagacactatagttttctaagctccctccatcagcaaaatattcgttactcaaagctgatttgtactgaccctgtgggacacaagcccatttcaaggctgctggctatagcttgaaaagaaccactgagatgtaactgaacatttctgttcaagtagggctggccctacccctacctcctataagctttgacctggatacataatccggggctaattaatcaatacatccatctctttgacaactgagattggctcagcagtcaaaatgtgatcaaacttagaaatcttgcttgaatttggggaaagaagcgcttttggccaggattattaagcaaagaacacaatgaaccttgggctacttatatcccttgccaccatatgggaaaagctggcctgagaacaaaaccagtgtagaggaaaatccagctgaccaatggggaaaggcagattccagattacattgtttgagtactaggatccataaaagcctagatttttcatttatatgcgctaacacattccttttctgcataaatcagtttgaattggttttgaagagatacatggaaaatcagaaaataagatatggcagaaattttctcttcccattttcaacactgaactggtatattctaaatatggatatatgggtgttacctctttgatggaagtaaacaaggttttatcaccggacctaaagtctgaacacaaggccatttcaaaggaataaaatctaattttccttaagggagtcaatataaacaaaagaaggtccagggctatattggtgaccatcagaagctagtgcttcagaaagagtgtctcagggtttaaagattctggcatatgaaaaatattactttgagggaaaatccagtacacaaaataaaaggaattctaaagcaaatcaaatgaaagcaaatatagttcactgtcagaaaagataaagaaaaaaacgaaaaatagtacaaccagatatatagttgtataatccaagttttagctaggattcttaaaagtaattgctgacttgtccaccagacagtacaaataatcaataacattctatctcacagttgaattttgtaatcacaaaaagaacaagatctcaaattctctctcaagcatattagaattactgattttatttctttaaatatgtaaatttgtgagtgaggcacttataatttataactttttatgtgagtgaatgcatcaaaaattatgtgtaagtgttcaagataaccactctaaacagaagtaaaagacccgctatatatataataagcaaatgcttagaggtcactataatattcctaggaaaaaagtaaaacttgaaattgcattgcataaaggtctaattgttgctatataaacatatttcacaattttacctaggaagattttaattaataaattcatgtttatactactacctataactataggaaaagcttgtataaatgagaactacaaaaatcaacatgtatatggagaaaaattatttaaattataaaagatattgtatagccaattctacttagctttttaacaaacctgttttctctacttcttgggcacttagctaaaccatatttcctagtcttgcagtttgggacagccatgtgattgtatgactgagtactagtcagtggaagataagtggaaatgatgtctactgtttccaggcccatcccctttaacctcctacctcacctgtatcttccatcatctttacccataccaccttttgacagataagccaagtgaccttgaaaggttgtgctcaaaagggcagagtcaatagatgggagaaatctgaactccccctttgaggagagccacctgctgatccagaatacctgttttagactttaaattgttaagaaataaacttccattatatttgattcattatataatttttattttttaaaatagctagtattaccttaactaatatagcttatgattatatcactaatatgtgatcattgatattcatgattcattttatttttccactaattttaagtttttaatatccctagaactcagtacaaatgcattaacttcaaattataaaatattttaatattcataagtagtctacatcttcagtaaaactattttttgaaatttatttctttgcttaatcccagattctaaactttctttaacatttaattaacataattaaacttattcatggctttagtaatcaattagatctttctttaaaaagatttaattggccaaaagatttaattgtaattcttttttgaaatcaggataatgtaacctcttattaaaataaacaaaaaataaataaaaatcagtatgatacatcagttttgccatattcctataaagcatctcgaaagtaacaaaatgcttcaagaaaactaccataaaataacattaaaatatttaaaagaagaatggtcccgccagcatagctcttattcagtaagaatgaatgtgcagtccttctgaagaaacagatgaaaacaaaaaagaactaccccaggcaagactgaactaaaaatttttctcaatttccagtcaaactgtgttcacttttctaacatctacccatccacccacccattcattcttcttttgttcattgattcaaaaattgcatattggtattatgtggcaggccccataccaggattctgtgatatcacaaagatgaaatatatagataatgccctcaaggggttcacagtctaatatattcaagaacaagaaacaatcagaatttataactacttactacaattacaaccaccataagtactattacaggacattgggactctatattataaaaggcactgggagaaagcctaatacaaattggaatgaaggttcaaaaatgagctaagattagaagtaatgttttgatggaggaggaaaagtaaaaataatgaaattggtttggggcagaggagagtgtgagaactcaggtatagttatacatgctgaaagactggtgaaagagagtttggtaaatttatagaattataaataatggggaaaatgatgagagatgacaacacagccctaaataggagcaagttcatgacatgccttcattttccctattccataatcagatgattgttattatcacactttttcctgtgcctttcacctcatattcaaacaggacagaatcacttttcattttcactgattaaaatatagctatttctttttttaacacacttttataagagagctactatctgtcaggcaacatcccagactctcagatatactgttcttcctaactttctacaacaccttatactatcatttactggactgcttgcttggtaatacactttaccaccctgtatttcaattatttggtaatatatctgttttacctgccaaactccaagctccataaaacatggaaatgcctcagtcgttttttttgtctgccataaaacagtagctagtacgtaatataggtataacgaatgtttactgagtggatgaactaaagcaatgaagaaaaatggattagctttaaaataagagactatcattttagttttctcattacgcaataagattttttaaatatacaaaatatcataatgtgtattttatgtttatatttttatgttttgtaggatattgatactatttattggtaagtaataatattttattattgcagtaccccttcacaatatacccttatatatacaacttataattctgatagtttctgaaaacacattactattggaatgctgctaaaaatatgactagaattcattttttcatccatataaaaatgtttattgagtagttactatttgtaggacactatgtgaattgcttagcttttatatttcattgccattaaatacaataatgtaagaggtaaaatatgtcaaattaacttccctttgtacttagtcatagtcataccctgaggcaaaggaacaatgtcattcaacctcctttcataaataatatactttgaaacaatgactgattcattgttaaactgcatgattatatagtataaagattataaattcagttgaagttcaggtgttttttattatgagatactgtacttttaaattctggaatttccaattaatgtttttaatagatctcatttctcttctgagagtctccatctgttcaaagaaaaagaaaaagtctgagctggagtaagtaaggaggtttctatataaagaaagacttgaactacacctcataagatgaacaagatttaaacaaacagcaaagatgagagaatgaaacaatgagcaaacacaccatgcaagaaatgcctatgatatttttagacaaataacaaaggaataagctatactggtggcaggaaggagaacagaaagaaatatcattggataaggaggggtagtaacagaatcggaagatcttgacattcttgaactccaagaagaggaaggggccacgataatttagttaaaataaggctcaatattgtatcactgctctgtatacttcaatgtgtttttgtagtggctggtaacagtctttccttttcatatttagtgcttccttcagaagctcttgtaaggcaggtctggtggtaacaaactccctcagcatttgcttgtctgaaaaggatcttatttctcttttgcctatgaggacagagtcaaatctacacatatcaataccagccttaaatgtaaataagctaaataccacaattaaaagacacaaagtagggtgggcacggtggctcacacctgtaatactagcactttgggaggccaaggtgggtggatcacctgaggtcaggagttcgagatcaacctggccaacatagtgaaaccccatctcttctaaaaatacaaaaaatcagccgggcatggtgctgggcacctgtaatcccagcaactcaggaggttgaggcaggagaattgattgaacccaggaggcagaggttacagtgagccaagatcacaccattgcactccagcctgggcaacaagagcaaaactccatctcaaaaataaaataaaataaaataaaagacacaaagtggcaagctagataaagaaccaagatccattggtatgctgtttgcaagagactcatctcacatgtaatgacacacataggctcaaaataaagggacagagaaaaatctaccatgctaatggaaaacaaaccaaaaaaagcaagggttgctattcttatttcagacaaaacagactttaaactaacaaagatcaaaaaagacaaaagagggcattacataatcataaagggttcaattaagaagatctaactatcctaaatatatatgcacccaacacaggaggaagcagattcttaaatcaagttcttagagactttcaaaaagacttagacttccagagaataacagtgggaaactttaatactccactgacaatatgagaaagatcactgagacagtaaattaacaaaggtattcaggacctgaactcagcaatggatcacatgaacccagcagatatttacagaactctcccccagaatatacattcttctcattgccacatggcacatactctaaaattgatcacataatttaaagtaaaacacaccttggcaaatgcaaaagaactgaaaatcataacaaacagtctctcagaccacagtgcaattaaattggaaatcaagactaagaaattcactcaaagccatacaactacatgcaaactgaataacctgctcctgaatgacttttgtgtaaataatgaaattaaggcagcaatcaataagttatttggaattaatgagaacaaagatacaacataccagaatctctgggacacagctcaggcactgttaagaaggaaatttatagcactaaatgcccacgtcaaaaagttagaaagagctcaagttaacaacctaacatcacaactaaaagaactatacaaccaagagcaaacaaatcccaaagctagtagagtacaaaacataaccaaaatcagagctgaatttaaggagattgagacacgacaaaaaaaatccaaaagattaacaaatccaggagctgctttttaaaaaaaaaaattaataacatagaacaaatagctaagctaataaagaagaaaagagggaagattcaaataaacacaatcagaaataacaatggggatattaccccgaccccatagaaatgcaaacaaccatcaaagaatattatgaacacctctatgcacataaactagaaaatctagaagaaatgaataaattcctggacacatataccctcccaagactgaaccaggaagaaattgattctctgagcaaaccaaacctctgaaattgaagcaataataaacagcctaccaaccagaaaaagcccaggaccagaaagattcacgactaaattctaccagatgtacaaagaagaaccagtaccattcctactgaaactattccaaaaaattgaaaaggagggactcctccctaactcattctatgaggccaacatcatcctgataccaaaacctggcaaagataccacaaaaaaagaaaaattcacaccaatatccttcaggaaaatggatgcaaaaatcctcaaaaaaaaaaaaaaaaaaactgacaagctgaatctggcagcaaatgaaaaaccctatccaccataatcaagcaggctctatccctgagatccaaggctggttcaacatacacaagtcaataaatgtgattcatcacattaacagaactaaagacaaaaatcacataattatcacaatagatgcagaaaaggcttttgataaaattcaacatccattcatgttaaaaactctcaataaacagactttaaaccaacaaagatcaaagaagggcattacataatggtaaagggatcatacctcaaaataataaggacataccttataatgtccttattttgaggacatacctcaaaataataagagccatatatgacaaacccacagccaacatcatactgaacgagcaaaagctgggggtgttcccactgaaaactggaacaagacaaggaagccctctctcaccacttctattcaacatagtactgaaagtcctggccagggcaaccaggcaagagaaggaaataaagagcatttgaataggaagagaggaagtaaaaccatccctgtttgcagatgacatgatccatatctagaaaaccacatagtcttagcccaaaagcttcttaagctgataaacaacttcagcaaagtctcaagatacaaaaccaatgtgcaaaaataactagcattcctacaacaggcaagtggagagtcaaatcaggaacatactcccattcacaatagccacaaaaagaataaaattcctaggaatacagctaactagggaggtaaaagatttctacaagaactacaaaacactgcacaaagaaatcagagatgacacaaacaaaaataaattccatgctaatggataggaagaatcaatatcgtgaaaatggtcacactgcccaaatcaatttagattcaatactattcctattaaactaacattgagactcttcaagaactagaaaaaaactactttaaaatgaatatggaaccaaaaaagaaccaaaatatccaaggcaattctaagcaaaaagaacaaagctggaggcatcatgctacccaatttcaaactatactatggggctacagcaaccaaaacagcatagtactggtacagaaacagatacacagaccaatggaacagtatagagaattcagaaataagaccacacaccagaaataagaccacacacctacaactatgtgatctttgacaaacctgacaaaaaacaagcaatggggaaaggattccctattcaataaatggtgcttgaataactggctagcaatatgcagaaaactgaaactgtaccccttcctcataccatatacaaaaattaactcaagatggattaaagacttaaatgtaatacccaaaactataaaaaaaatcctggaagacaacctaagtaataccattcaggacacaggaatgggcaaagatttcatgacaaagatgccaaaagcaactacaacaaaagcaaaaattgacaaatgggatctaattaaactaaagacttctgcacagccaaagaaactatcaacagagtaaacagaaaacctacatattgggagaaaatttttggaaactatgcatccaacaaaggtctaatagccagcatctttaaggaacttaaacaaatttacaagaaaaaaacgaccacataaaaaagtgggcaaagaacattaacaggcacttcaaaagaagacatacatgcagccaacaagcatatgaaaaaaatgtgcaacatcactgatcattagagaaacacaaaccaaaaccacaatgagatgccatctcacccaaatggctattaaaatgtaaaaaacataacagacgctggcaaggttatggaaaaaaaagcaatgtttatacactgttggtgggagtgtaaattagttcaaccattatagaagacagtacggtgattcctcaaagatctaaagacagaaataccattcaacacagcaatcccattactgggtatatacccaatggaataaaaatcattctattataaagacgaatgcacacatatgttcattacagcactattcacaatagcaaagagatggaatcaacctaaatgcctatcagtgatggactgaataaagaatatgtggtgcatatatatatactggaatactatgccaccataaaaaagaatgagatcatgccctttccaggaacatggatgaatctgaggccattatctttagcaagctaatgcaggaacagaaaaccaaataccacatattctcacttgtaagtgggagctaagtgatgagaacacacagacaaatagagaacagcacacactggggtctactgaagggttgtgggtgggagaagggagagtattgggaaaaacaaccaatgggtactagactaatagctgagttatgaaataatctatacaacaaacccccatggcacaagtttatctatgtaacaaacctgcacatgtaaccctgaacttaaaatagacgtaaaaaaagtaaggctctcattgatttttgaccgtgaagtcatgaaatacaaactccatttcagaaagtctcatctggcagtataatataggtgtgggttagaattaagagagactgattgcaaagaaaggaacaaaaacattggtttgacaccttctgtgtgtccaacacactgctaaatactttttacacaaagtatacttcaataggaaacagtgagagactaagacaaaatgggaaggttagctataattatggggtaacctttcagtgatacagagaaaaatacatataaatgattcaacaaataaaatagaaatgacaggctaccattcgtttagtgtgtaatctgtggtgagcactgtgttaggtactccatacttatcacctctatcctcacaacaatcctgcaaggtactattattcttattgctaccatttttcatattaaaaaaatctaaacatcagggaaatatttaccagggaaataatacctgcaagatactattactattactattgttaccatttttcagatgagaaatctaaagatcagtgaaatatctacctatggagtagaactggaattcaaacacaagtcttttgaactcaaattcctgttctctaccctataatgtcacatacaatacaaaaatatgttattgaagaaattagtgtaattctttaatgcaaggactctttaatgtaagttagtgaggatgataattactatgacagtaaaaacactttaatgtttgagaaaggggcaccaggctaggtaaaactaggattagagattcaagggcaaaaggaaatctttcaaagctggaatggatttatttcagtaacaaagaatagattataggaaaagatataacatgtcaatttttgtctcatttattctgagggcaggcaattttcactttaatgatcccgcttctcactagttcattttctttgttcattttaaagtctttatttcctgtcggatttattcccttgactaagcattctttctccaaattaagactttgcttctcattattaatgatttgatagcacagactggcagctatcacctaaatggaactgttaggaaactgtaaacaaacacaacttttcagctttaaaaagcatagatggcagatgcaagaattctggcaaagccatgtgaaaataacatcagttttaaaaatctaagcctgagattgaagcaggccacactgtatcttttacttacgattattgattctgattctatcatagagaatcccaattcttcagctgttagaggctgaatgaattccaatattctttagttgtggcccaaatggtctcctgataaaatatgttgaagcatgagcaatttcagcaattttttctgggttactagtctactattccatcagaattaatttgctcttcaaggtgaaaagcatttcctcggacacagagttaagtgattattgcaactgccatgtctctttaagctcaggctctcgcctgatttcctttggcattaggcagcaaaatggatttttttaaatactggcaagctgtccaaggtcttcactcaaaaagagagccaagaactcccaaatgtaaaccttgaaatagaattacaaattaggtacactatgacaaatgaacaaggtaaatgtgaaaagtgactaaaagttaacttcatcattatccagaatgtgaggttaaaagaaaggtgaattattactacattttcaggaaaacattacaattagctcataagtgtaaagtacagattctcaggaaaattctaacagctgagttcttctactagaaagtttaattcaagttagagattataaagagattagaaagaacaaaagtatcaaaacaaaaactggccaataatatatctgaagagtatataaaaatggtaacctcacaaatgtcataaagttcaaaacataaaaattaaaatattttagaaaggaagtttactgcccttaatagaatgctcataatatagatgcatattttaacatcaaacacattttaagcacatgcacaatgaaatactgtgcatcagtgaagtccataaaaatgtgcaagaatcattaacaattagaaaaaaacaggatgtcatcaaccaccaaatatacattcttatcacctgcacagggaacatactcaaagattgatgacatgctcagccataaagcgagtctcaataaattcaaaaaaatcaaaaccataccaaccatatttttggaccacagtggaataaaaatagaaatcaatgccataaacatatctcaaaaccatccctcaaatcttttcaatttcatgaaaactaaacaacttgctactgaatgagttttgggtacgcaatgaaattaaggcagatatcaaaaaaatctttgaaataaactaaaacagacgtaacataccaaaatctctgagatgcagcagaagcaatgttaagaggaaagtctatagtgctaaatgcctacctcaaaaaatttttaaagatctcaaattaataatctaacatcacacccagaggaactagaaaaacaagaacaaatcagaagaaaagaaataaataaaataaaataaaatcagtgcagaagtgaatgaaattaagacccaaaaattcatacaaaaaaatctataaaaccaaaagttggcatgaaaggataaataagatcaataggctggcagctacattaacaaagaaagaagagacaatatccaaataagcacaatcagaaatggcaaaggtgacattaaaaccaatcccaccgaaatacaaaaaaaaccctcagagactatgatgaacaccatatatatacaaactagaaaatctagaggaagtagataaattcctggaaatacaccatatcccagggttaaatcaggaagacattgaaaccctgaatagaccaataatgaattccgaaatggaatcagtaataaaaagcctaacaaccaaaaaaaaaaaaaaaaaaccctggaccagaaggatttacagctgaattctaccagacatacaaagaagagctggtattaattctgctgaaactattccaaaaaattgaggagaatgaactcctccctaactcatgaagccgccatcatcctaatatcaaaacctggcaaagacacacacacacacacacaaaagaaaactacaggccaatatacctgatgaacagagaagcaaatatcctcagcaaacaaactaaaagcagtagtgcatcaaaaacttacgacgatgaaggaggctttctccctgggatacagggttgattaaacatatacaaaccaataaatgggatttaccacataagcagatttaaaagcaaaatcaatatgatcatctcaatagatgcaataaagataccttcaataaaatccaacatcccttcatgataaaaaccttcaacaaattaggcatcaaagaaacacaactcaaaataataaaagccatctatgacaaactcacagccaacattataataaatgggcaaaaactagaagcattttccttaaggactagaacaagacaagtatggctactctcaccactcatatataacatagtactgaaagtcctagctggagccatcatgcaagaggaataaataaaaggcatccaaatggaaaacaaaaattcaaactatctgtcttcactaatgatacgattctatgcctagaaaaccctaaactccaacaaaaagctgttgaaacttataaatgacttcagcacattttcagaacataaaatctatatatgaagatcattataatttctatacatcaataacattcaatctgagaaccacagtaagaatgcaatcccatttacaataaacacacaaaaaacgaaataccaaggaatacagctaaccagggaggtgaaagatctctacaatgagaactacaaaacccactgttcaaagaaatcagagatgatacaaagaaatggaaaaacatgccatgttcatgggctggaagaatcaatatcaataaaatgtccacactacccaaagcaatctacagattgaatgtattcttattaaagtaccaatatcatttttcacacaattagaaaaaaactattctaaaattcacatggaatcaaaaacaagctcgaatagccaaagtaatcctaaaagaatgaagccagaggcatcacatttcccaacttccaactatactatacagctacaataacaaatacttcatggtactggtacaaaaacagaaacatagaacaaaggaacagaatagagaactcagaaataaagccacacaactacaaccatctaatcttccacaaaaataaacaatggggaaaggacaagctattcaataaatagtgctgggatacctggctagccatacgcagaatgaaactggacccttacctttcatcatacacaacaattaagaaaagatagattaaagatttagatgtaagacctcaaactctaagaatcttagaatgaaacctagaaaacaccattctggacataggtctgggcaaagatttcatgataaagacttcaagagcaattgcaacaaaaacaaaaattgacttaaaaccttctgcacagaaaaagaaactataaacacagtaaacagacaacttacagaatggtagaaaatattcacaatccatgcatctgacaaaggtctaatatccagaatctataaggaacttaaaaagtcaacaagcaaaaaacaaccccattaaaaaatgggtaaaggacatgaaaagaagatatacatgcagttaataagtatgtgaaaaaaatcctcaacattactaatcattagagaagtgcaaatcaaaaccattgaatgcaatctcacacctgtcacaatgactattattaaaaagttaaaaaaaaaacagatgttggtgaggttgtgtagaaaagggatcgcttaaacactatttgtgggaatgtcagttaattcagctactatagaaatagtttggagacttctcaatgaacttaaaacagaactaccatttgacccagcaatcccattactgggtgtatgaccacaggaacacaaatcattctaccattaagacacatccacgtatgctcattgcagcacttttcacaacagcaaagacatggaatcaatctagatatccatcaacggtggactagataaagaaaacgtggcacatatacaccatgggatactatgcagccataaaaaagaataaaactgtgtcctttgcagcaacatggatgcaggtggaggccattatcctaagcaaattaacacaggaacagataaccaaataccacttgttcttactcgtaagtgtgagttaaacactgaatacacatggaaacacacatggacacaaagaggggaactacagacaatggggcttacttgcgggtgtagcacgggaggagagtaaggatcaaaaagctacatattgggtactatgctcattacctgggagaataaatcatttgtacaccaaatcccagtgacacacagtttacccatgtaacaaacctgcatatgtacctcactgaacctaaaataaaagctggaaaaaaaaaaacaaaatagccccatctcaataatacagaaagaataacaaggattaattcaaaaatgtttatcacataaatatttaggaattcaaaaattaataatgtaatcagacatatttcctatattcatatactatatacttccttcgtatatgttatcaggaattaaacatggtatttgtaatacaggatatccttctcatcagtgagagtgatgtactattacctaagaaaaatataatttgacttaagatcctagcgatatattgtgaagtcaataatatagtttacaggggtattttatttcatcctcaaagaaactggcgaggtattcattatttgaaaaatcacccaacaggggaagttcttctcagatcataaatattccatgttagaatttttctcatatgcctacaccgaaatacaggttatcaaacagatgtttttatgcccatgacctgttctatcaattcaataaatgtttgctaagcatgtgagtgaggaactatgctaaggacaaatacatgcacacacacagattaatattttccctgtcttcaaggagcttataggcaaagtcaaaaaagatgattcatgcataattaatacaaagcagcataatgatgcaaatagttagatctaaatagaaggatcaaaaatagttttcaataagtagagatggtagggataatatatatagacaaaacatgaacgtggacaataagaaagacagacgtgtttgagagtaatccattttatttatttatttagagacagagtttcactcttgtcatccaggctggagtgcagtggagctatcttggctcactgcaacctccacctcccgggttcaagtgattctcctgcctcagcctcctgagtagctgggatgacaggtgcacaccaccaggcccagctagtttttgtatttttagtaaagatggagtttcaccatgttggccaggctggtctctaactcccgacctcaggtgatcctccagtctcagcctcccaaagtgctgagattacaggcatgcaccaccgtgcctggccaagaataatccattttactaaaatatatttatctaagacattactagcagataaagctggaaaaatatgatgaagctagaaatgaagggtcttgaatgcctgagttaaacgtttctatttaacatttgcagtgaggaccagggctagttttgagtaggaaaatgacatgaccagaatggcacttaaggcatactgacttggcagcattgctcagaataaatatgagcagatgaagaggagagactagaagtgggtggacagggtaggaggctcttgaaataactcaggtgaggggaaatgatggtctgaacccacaaactggcaggaatgatgaaaaggtgagaggtcaatctggaagacagtaatgaaagacagaatgatctacttgtaagacattggacatacattcagatccaagatttaccttttgggcaactgactttactcctgattcccacgttgaggataataaaacctacctcatgggattgttgtcaggaataaaggagataatgatttttaacatgtttacacaatgcctagcatgtagtgaaaatttagtacttaataaatgctagcttctagtgttacaattattttgagatattatagtttggtcactgtttactgatttttttagtagctacatctcactgctggttcacgtagcagttgtagtcatctatataccctaaaacttttgtgtgaactactctctgacattaaatctcccccaccttgtatttataccattgatttttaaggaatctaaatataagattttatactaactcccactgaattctatgtttttaccttgagccaagatttcagcctattgagataatttttcatataagttcaattatttgtcatatttgctattcctccctaacttctacaaagctgattagaatacatatggctttttccaagtaaaatattgactcagaccaatccaagaacaaaatatttcactttcactagagaaatcccctctacgttgacattttgtgactatttagaacgtctggacaaaattggacaaagtctgtgaaacataaaaatcaagatctcttcagcaacataaaagagaacaaaatagctcttttctatggctgacagaaagccagagtaaaatttttttaaccgatgcagaaactaaggcttggaaatatcaagcaacttccaaaggtcaccctgctagtaaattgcagaacagagttgtacaaccaaatctgtaggactcacaatctcatgctcttaactgctagactaagttatctccctaagaaagatggttgagattcccatcatgattgctgggaaaaacctccactttggtctctggaattcatctccaaataattaaatgcattttgcaatgataatggttcatttgcaagaacatatacacttttatatgcagtctttgcctttttatgcatttattcagtcaatgaactttcactgagagaccactacattcaaggcaccgtgtgaggcaggatgtgactacagagatcaatctaataatgaacctactgtcaaaggggtatataagaagtaatgcaaaacatatacacctacaaggcaaggcagaaagagatgtatcaagaatggtaaaaagcaagtgtgctagaagttcagaaaaatgactcttttattctactagccattttctcaaggacttcctagattccctaaggttacaaaaagttcttcctgaggtgagggtaggaacaaaaacttacccttctgattctggatttttccattaatgtacctacagtacatacgtgtggttaatggtattgttttcaatatataaatgcaggtcaacatgatcctagttctacattccctaattcttgcaaaacctgttaggagatttccaaccttagttgaatcaccttgagtcaccacatccaaaaggtctgttcaactacataagaaatagattgttcaggttagaatgttcttttgaacattgtataccactgcttaagatttagcaccactataaaaaattatacatgctaaagaatcagttatgttcctataataagcctctatttacatttcaaaaaatttgcctcccaagattctctaaatctgatggaaattgggtaagatagccacgaagctctctccaaattctgaaattgatgcattcctgataataagctctagaaattgggttagaatgtgtttgaaggtaaactttgtttcagaaacaccatttggtttttaggcaatctaatctgactctactgatctttaaaacttgatgaattttagaactaaattaagtatattttccaaaagtagggacctcactcccagagagtattctcaagaatagcttggcattaaaaaaaactgaaaatccttcaaggtaaatcttgaaatcttaaaatactaaaataaaatacctcacacttcagaaggctgacatgtaattaaatattttgcattggaaaagaaagtaaaataacagaaaagaggcatagttgctgaacaaaattgcacaaaacctgccaatgcaacccctttcaaaccaaaagctttagatgctgcttgtgtcaagagaaaaaaatacataacacgtttcatcccttaagcttcttatttacttcttaaagacatacgctgatgaggtaatgttctattacaaatgtttaaaaaaaaaacaaaaaaacttttcctggtacctggattctgaaatctgctctaatgatctttatcatcaaatttctctatggcatgctgtgttcacatttaagaattgtatagattgtttatacacatggaggaaaaaacatgaatataaggcttgggaaaacataaagagaatagaaaattttttcagatgatttcacattctttcgaaaacctaaatttcatgagttggtaaagaatgttaggatatttatatttcttcaaaatttacattctagattatataatgtcctaattcaacttagaaaatggtttcagatgcatattataagagtatataaaacagactgacttttgaattaaaatgtatgcaagacaaaatgcaattttaacttgagctagcctttatattacatgcaaaacctccaattgaatacattcaatcataataagaatttaatttttaacttatattagtaaaagtgttcaaactaccatattatagctaatattttaatagaaacaaaaatctccgattcaaaaataaaagttcttacataagatggctggttttgtatttgaaattactgaatcagagtgccctctattggaagaaaagagacaacaaaagctaaactgaactaagaatataggtaaaatacttccaaaactcaagccacatcattaatatgtaaaacacattaattaaaaatatggatgctacaaaacatatttccttacatttttatttctccaaaataacttttggaattacttgtcatatcacaatcagcaagttggatgtttcatatcctatgaaattaaattttaactgaacccaaatgctcatcatttaaccagtaatataaataacagacatacagaaatgttttccacatttaatagtccaatataacatagaaatgttataattgaggactgtggtttgactgcagtttggattttccttgatgataaactgaaagcctccttgctatgaacctcatgtcggtgtccccgccaagtttatatgttgaaatcctaaaccccaatgtgatggtattaaggagggggtgttgggaggtcatcagatgataaccccttatgatgtgctagtgttcatataagaaaacatcaggagggctgggcgcagtggctcacacctgtaatcccagcactttgggaagccgaggcaggcagatcacaaggtcgggagatcgagaccatcgtggccaacatggtgaaaccccgtgtctactaaaatacaaaaaattagccaggtgtggtggcacgtgcctgtagtcccagctactcaggaggctgaggcaggggaatcgcttgaaccccggaggcggaggttgcagtgagccgagattgtaccactgcactccagcctgcgacagagcacgactccgtctcagaaaaaaaaaaaaaaaaaaaaaaacacatcaggagaacctgcttttttcccctctgttctttgccacatgaagatacaaccagaagacagccctctgcaaaccaggaagcaggccttcaccagctaccagctctgctggtaccttcatcttgggcttctcggactccagaactgtgagaaataaatgcttttttttttttccaagccacccaatctacgctaatttgttatagcacagataatccctaattcaagagacttttagaagctcttacactggggaattgcagaagtaggctggacattaagatttacgagatttgttccatctcaaaaaattctagttttgtggtgttttcaagacctcagttctgactcatcatctcagacctgaattacctcagaaagatcttggctgatttttggctccctagaccagtagtatggatgttagacctgagaagcttttccaagagcaatgctcagagctacccaaaattattttgatttagttggtctggactggtatctgagggcatcagtatttattttttagagcctctctaggtaaatctaatatacaactatggctgagaaccattgtttgagcctctccccagatcaagcaacatacaactaccacttttattttccaaaaatgtcactttcaggagaactctcctacacaagaatttattctcaggatcaattttaaacttctggctagcctcccaatctacttagctgcctttgttctctgacaatagagttgagtggcaaggggttatggctccagctccagaatgtctgtgttcttggctctgtaattaccgcatgaaactgggaaagtcataaaagctccctgtatggagaaataatactatccttttcaaagggttattgtgaggattaaatcagttaatacaagtaaagtgttccataaattgaggtattatcattacttacccaactttatttcctactactttccaaaacaaactctcatcataaatcattctcaaattatgcactaattctcatctctgtgcttttgcacttactgtttcttcaggctggaatcctttctcaatcatttgtcccaacaaaagtgaaaagcacagctcccctttcaccaggacacagcttagtctctccctacctccacaaagacttcaatgagtatctgtaaatattcactggtctctcccttttaaaaattcctttggccacaaggtagcatactatgagaaatgtggctgagaattaaaaacactggctcagagtttgaatcctcactctgccacttggcagctaagtcattttctaaatccatattgttaggattacttaataagcgacttaaatcacgtaaagcattagagtagcaaatagcaaaaactgagtaagtgtcagttcttatttattcagtgttttatatgttagccttcagttatagtctacacactgtgactgaagtctccttaggataggtgttttgaaacacttgaaatcaagaaccatatctattataaatcccacaactcaaaacatggtaagaaccatctgtattaggtgacctatattaggtgacctgtacttgactaaactttttgcaacatgtaagagtataattgaagcaatattctggaaaaaaaacttttttgatgaatagaaacaaatattcaacaaaacatggaatgaattcaaataaaacaggctacagaaaagggtcaaagtaatttgattactttttaaacattcgctaacaggtttctatcagattcatcttctgaaaggtcagttccaatgatgtcttttatctgcccaaaatcctttagatttttctcatttcttaaaaaaaaaaccaaaattcttagcctgacattcataattatccatgacctgacctcaaactacacttctactctctcatctttcccctttgtaaactctattcttccaaataaacagaattatttgctcttactcatatataccatctgcttttctccctccacataatctttaatattttatagggaaatattttcaaagaacactattgtaaaggtttgtcacaggaacgaagagtggtgttagaaaagcatgagttcagatttcaaaaccttaacgctcaatttatgagcattaatttctttcttgccactatcacaatacagtctttggcttacaaaaaaaattgaacatcttttccccaaactattatcactctctcaaagtcaaaagcctttgccgtaacttcctgaaagatagaagcttgaatcatggtctccaagcagcacatacagaccccagggcatataagatattcattgggtaaacgaaaaataattagagcttctgttttacacttattctctaccttcctcaatttgaatttcttttgttgtgtatgtctcataatttacatcaaatattactagaaatgcagtctatatatatataatttacaaataatcagggatatttgctcaaaatttgtttactaatggtacgtacaacaaaaaagtttggaaaccctggtctaaaaaattagggctttcagaatatctgtggttttacaagtagaaggccagaagctgccagtttacataaatctttgaggatggatctaaaaatataaacactatgtgttgtttatatagcacaaatatgttttaagttctaactaactttcaaggaaatattaaaatgtaactgattggtaacctggagacagcatacacctatttcagattttttaacagaggattttgtcccaacattaaagttactattataaattatttcattaatataaaaatttcatttggtaaaacttacaggtatttacttcagtacatatacaactgttcatagttattcataaagaatttttattggggccaataataggatgtttttacaaaagagagtgaagcacaaaaacaaaatgaaacaaaaaaagcaggccaaggaggtaggactagccatggaactagattagcaagtgctatcccaggaaacagtgtcacagcttactttaagtaactaaattaagtaaatgttctcataatggacagtcactatacttagcaagtttttttttagttttcacaaataatatgacatacttaacacagttcactctattactggcttttgaataaagtatgatatatctgtaacaaattaagttctaaaagtgactacagatttcttatcagaataatgtatttcctttaataccagtatatactataagtccttcctctacaggacaaaaagtaggtttaaatatcttaatattaaactgatttattctctatagtttttcttgcttttgtgttcatataaaaatccaaatgagtgagaatcacccatggcctgacctcaatctatccttctaatcttatctcccctctttcttctttgtaaactctcattcctaataaatagaaatacttgctcttactcaactatatcatctgtttttctgcctcacataacctttaatattttatatggcaatattttcaaagaacactatcataaaggcgttgtcacaggaactaactcatgcttaagattctgagcttatcaaagagaaacctcttgggatttgcataatattataaaaatatgcagactgaactttccacatttctctcctactatgacttcaggaggaagtgaggaaactatacgtgtggctctgctctgttagtctgagttcatagagaaaatggggaagacagtcgaaaggaaggtttttgtctttttttgggaaccaacatcattatgcccagtaaaactaaaggaacacaacaacaacaacaacaacaaataccaaaaatccatgtttttaagaaagagtctaaaagtagagagaccatgaagtgatctgtcaaagcactccttcccctacacatgcactgcgagtaaaaccccaaagaacgtcaggaaaagagcaataaggaaactgacatcttagagtggcggaatctgataatgcaccacatcccatacctcttaagtgtacacactgaactggcaaagacagacacattatcttcattcccccccgccttacttactacactctggcttccatttttcccaagttcttcctctgaaatcttgctcaaattatctaagtagtggtctgatattgtgtggcacaagtcttcaaacgaataatccttttcttgacagagttttatttcatccaagagttttgataattctccagtgacggtttcacctatgagaataattttttcagaagtttcaagaaaggctattgttaaaacttaatgttaagcaataaaaatatgactgctatggtgatagaactcaaaatataacaagattaagcagtcagacactattctgctgaaaacaaggtactcaaccataattagtacaacaatattaatgggcaaaagagattataattttgcctatttttattctttttcaaaatagaaataattattgtaaggttatgtatacatagtacataaaagcatctggaattacaattcccaaagcttcacttattataggatttaatttccataatatttcattggtattttacttcactgacagaattcattagcaaatttgaaacggtgctgagaaacttcttcctaggttcaataaacagaaatagtacaagttatttaaacaaataataacataggtaatcagtaccttaagaattatggtatatgatataaagtaaaaacacaaaagaaacaaacaatatgcatcatctgtcaaacatgaagattttgtagattacatgaaaatatgcacatttctaaacagtctcagaaagataccttatacctgtaatttattctgaaaaaaatgcccagcagttacaatccagattttaatatttttattctgacataaaaacatatttaacatcagctgactatagatgcatggatttatttctggactttattctgttttattggtatatatgtctgttttcatgcctgtaccatactgttttgattactgtagctcttcacaaggtttccaagaacacaaaatgtggaaaagatagtctcttcaataaatagtgttgggaaagtggatagccacatgcaaaagcatgaaatatgacccttatctcatcccctatgtaaaaatcaatgcaaacagtataaagactggaacattaagacctgaaaatatgaaactcctaaaagaaaacatagggaaaaaacttgatatttgtttggacaatgatttcttggatatgaacaaaagcaaaaatgaacacgcaggattggatcaaactaagaagcttctgcactgcaaataaaacaatcaacacactaaaaagataacttaaggaatgggagaaaatatttgcaaaccatagatctggtaaggggttaatgtgcaaaatacataaggaattcacataactcaatagcaaaaacacaaataacctaattttaaaatgggctaaggactcgaatagacatttcttcaaaaaaggcacataaatgacccaaggtatatgaaaaggtgctcaatatcactaataatcaggcaaatgtaaatgaaagccacaatggggtatcatctcccatctattagaatggctattctcaaaaagacaaaagataggaggtgtttctgaggatgtggagaaagggaaccctgtatgctgtccatgggaatgtaaaatgttaaaggctctatggaaaacagtatggagattcctcaaaaaattaaaaatagaattaccatatgattcagtaatcccaccttggggtgcttattcacaggaaatgaaaccagtatcttggagagatatctgcacccttctgttcattgcaacattcttcagaacagccaagacatgaaaacaactgaagtatacactgtcagatggatggataaataaaatgcaatgtgtgtatacatttatatacacactacacaaacaatggactattattcagccttaaaaaaggagatcctgccatttgtaacaacatggatgaacctagaggatattatcctaagtgagatgaaccaggtacagaaagacaaatactgcatgatctcacatgtggaatctaaaaaagtcaaagtcataaaacagagagtagaatggtgaatgccaggggctggggagtggaggagatgggaaagtgttgatcaaagggtacaaaggttcagttatgggggattaataaattctggagatttaaaatacagcatggtgactatagttaataatattctattgtatacctgaaacttgctaagagagttgatcttaagtgttctctccaaaataaaaaataaaaaatactatgtgagatgatggctatgttaattagcttgattttggcaattattccacaaagtatatatcaagttgcacactgtaaatatatacaatttttatttgccaagtatacctcaataaagctggggaaaaacacatttaagaaaaaaacacatttaagaaacatatactccagataaacttcattacagcagggatagttttctgctttgctcactactgtatctcagggctgagaagccctaatcagtaacaggagctcttataaatggatgaaatatagagtataggatataacctattagacttgaaattttcacaactgtacatacaagtctagtatagattccagggctttataattaggtactcacttttggtcttttgggaaggagactcaacaggagatgaaatgtgtgtttcttgtgttgcatcttcctgtacaggctcttcgaggactgtagatcttcccacgccttctaaatactctgtgtgtatacatttttgagattacatacttgaattcatttattttaaaatcaataaattttaagttttacttctggtaatcagtttttcatttattttttcatatcctaaatatatcctaagttttcaaaagaacttcaaaaaaccaaacatatcaaaagaacgccatgatgagctatttaattaaagttgtaattaaaaaaagacactggattatttgggagaaactcttgaacccctttcttctaaaacctaaacttaaaacattctttccttaaaaataaattcacctattgaagatacaataaactccttggtctccttattttccatctgaagattttaaactgtctgaaagatgctttgaatagatttaatccccaaaacaggaatgtcaaattcagatggataccacaaccagccaggtaacataaacgaatgaaatggaataagttcatttcaaaatggtgctgtaatcttgtaacataagcataatttgcatattaactttatttccacaaagaaataatgttcattgccattattcttgaagtaatgtcctatactcagcctatttttcatttttctagttttgatacagatataatattaggaatagcagcttaaacttaaatattgcttactatggacccagcattgttctaagtgttttgtataaattaactcatgtaatccttacaaaactatgacacatgcactaaattttaaagattacaagtaaaggaggagtattattaacttgtccatgttcattcagctaataggtggcaaagccaaataaatataagacaagaaaacatctcacttttctcttaaccataaagaaaacagcatctgaatgtagaaataaatgttaaccaatattcagcctcacagaccatgttgaaccagagaacaaatgaccaatctaaagttcatccctgaaataaaacttcttttagagaaaccaaaactccagagtttgagctaaaatcctagggttttttttgtttctttttggttgtttgtttgtttgagatggattctcgctctgtcgcccaggctggagtgcagtggtgcaatcttgactcactgcaacctccgcctcccaggttcaaataattctcctgcctcagccccccaagctagctgagactacagatatgtgccaccacacccggctcatttttttttgtatttttagtagagacagggtttcaccatgttcgccaggctggtctggaactcctgaccttgtaatccgcccacctcggcctcccaaagtgctgggattacaagcgtgagccaccgcaccctgccaaattctagatttttaaatgttaacagctaattcaatttttatggaaacacaatgtgggctcaaaatatgtgatatatacaaagcatgtgtgctatctgccaaagcgttcagcccacaagtggctagtttgtagcctctgtataaagattaaatgaacagatcccttttcatacagagcatttgcttatacttctttattcaagaacctttttcttaaaatctaataaagaaaatttgtattctcatgccaaacaagtatgtcctcataccattcaaataatttctaccagggaaatccaggaatgcaaagaacagagatgacgtgttcacattctgaaatttgccagtaattagagaacttcaaagatgtactgtatgccctaccacaaattaacatacctaattaatcttgaccatttaggagagcaaagatagttactcccatgtaacaacatttcatcttatataaaccaatgcagtatgtttttaaaaagtccatggttatgtcacaccccattttctagtgggtgacatttattttgcttttcccaaaagacatattacacacatgcttcagttttgtttttttgtttgtttgtttgttttgtttggtttgtttgagacggagtctcgctctgttgctcaggctggagtgcagtggcgcgatctcggctcactgcaacctctgccttctgggttcacgccattctcctgcctcagcctcccaagtagctgggactacaggcgcccaccaccgcgcccggctaagtttttgtatttttagtagagacggggtttcaccgtgttagccgggatggtctagatctcctgacctcgtgatccacccacctcagcctcccaaagtgctgggattacaggcatgagccatcgcgcctggcccatgcttcagtttttaaaagttcagtgagaggcagccgggcacggtagctcacgcctgtaatcccagcattttgggaggccaaggcgggtggcccacaaagtcaggagatcaagaccatcctggctaacatcgtgaaactccgtctctactaaaaataccaaagaaattagctgggcatggtggcgggtgcctgtagtcccagctactcgggaggctgaggcaggagaatggtgtgaaccggggaggcagagcttgcagtgagcccagagggcgccactgcactccagcctgggtgacagagtgagactccctctcaaaaagaaaaaaaaagttcagtgagaggctgggcgctgtggctcatgcgtgtaatcccagcactttaagaggccaaggtggctggatcacctgcgttcaggagttggagaccagactggccaacatggtaaaaccccctctctactaaaaatacaaaaagtagccagacatggcggcaagtgcctataatcccagctacttgggagactgaggcaggagaatcacttgaacccgggaggcggaggctgcagtgagccaagattgcaccactgcactccagcctaggcaataagagcaaaactctttctcaaaaaaaaaaaaaaaaaaaaattcagtgagagtcaaaagtccaacatgaaatacaaagtgcatagagggagaagactaataaaaaatagtatgtgccactcttattttttagcttttattcaatttaattttaattttaatttatataaaaggctatgatgggatttttctctgattcatctctgcatgcatttgacttgtaattaacttctttattgataagaaaattgtaggggcatgaacttccctgaaatattttggaaatagagaagagagcataatggccacatatagtgcatctattccttttactcctccttggcctttgttgactattgtatctacatgttccctgcctgacttggttttaattcatttatctccctgcaaaacaatgctgttcttcagcttcccaactgacacctaataaaacctatctcaccaccctcctctatcatacttgcagccaatccataacaagtgtaggagataatcactgctgaacagggtaggagctaaaggagagaaaaacatctggggtttttaagtaacatgctacatgtcaggcctaatcaccaaacaggaagagaaagcatttaagtctaattttgttataaaacttttagttcaagtggagaagtatgcaagctgcaaataacaaaagtcgtacctagacagttgtcaaactttcaatagagctaatgactgccactaacaacaaatgcacttaaatgacttttaccaaaaactaaggctggtaagactgagttattttataccattggattaggaaggaaataatctgtattcttttggctaaatacaatttttgttattattgataatctagcatttagatacaagctctgccacttaagatacatgaatttgaacaaatcaaatctctcagagcctcagtttcccttatgtgcaaaagtaaaataatatctgacttatgttacttcatagggtcatagaaaccaaagtagtagcaaatccctgaaaatgctgaaagtattattcaaatgtgaaataacacttaatcatcactactttatagccttattaacttccagctcataactacatatttactacataaatatgaattttaaaaatatttctattatcaaatgagtaaataaataccttaacttctttaaaatacttactgagtagttgaaaaacaaaaataaaacattaaaaggtattattatttagtttaaaagtctaccagaaaaaaataaaactagtaagtttgttcaaaagtaaacactaactcaaaatccaaaagaaaactgtaacagttttaatctcatcttaactttaaggcaaactcatccatcattcaatactgtttaccttgtaagagtgttgcaatctggagagatttctgagatggatgttctttcagaatgtccaagacagttctacctaagctatcctttatgttggcatcaattcctgaaagaaaaagaaaaactcactagatatacaccactgaagtatcctcaaaagatactatcactatctaactgctgtaatttcagacatatacagaccaagcattgaaagtgatttttaaaaaattaagttctacacacacacatacacacacacatgcgcacacacacacacactcacacaagattttagcaagaaagaaggcaggggcctgttgctaccaaagattaggaacattcttgatcatcaattaactcttaaagggcactgacccaatgtttaagattgtttttcaggaccctatgatatctttttttttttgagacggagtctcactctgttgcccaggctggagtgcagtggcgcgatctcggctcactgcaagctccgcttcccaggttcacgccattctcctgcctcagactcctgagtagctgggactacaggtgcccaccaccatgcccaactaatttttttttttttgtatttttagtagagacggggtttcactgtgttagcaaggatggtctcgatatcctgacctcgtgatctgcccaccttggcctcccaaagtgctgggattacaggcttgagccaccacgcccggctgaccctatggtatctttgggttataactatttaactcaacagcacactatcacactgaaaaatattattgatttagaatgtgaattcctaaagtataatggtcatgtgatttatattctctgtacaatatggtaaaaatatttagtaaattataatcatgtaccatgtaagtaacataagaacagtcttagaacacttgaatattcacaaagttgaaaaagcatgattattttgaattgttgtccacaaagaatttatccaaatacaaggtcaaatactctatgatatttatttatgcaagattgtatttgtcagtcacactaatcatccacctgacgagcaaacttactgaagtgtgtaactaaaacacctgttattattttagttgtggaaatatatattgtaagaaagaacttattttaacacagcaaatagctttcactgccctaaaaatattatgaattttccaaacacataattgcaaaaaaaaaaaaaaaagccagtttacaggatctggtcccaaatgttagttcattgtaagattattaaatacatgtttaaatttgcataggaatgtgtaaccagcacatattaatatttaggtggtttcctcaaatcatttgttatatcaccacactgcatgacaaagttaaatataaatgaaattttaactttgttaaattgtgtacaaatacaatcacaatacaacagtctgccaatgtttttcatttttttttacagaggaaaataaacacactatagtccataacatgaaaaattccatcagttgtttacaagcatgaatttgtacccatgccttttgatctttaaaacaaatctgaccttaattctagctctatttcatctcaatcagaatgcacatatgaaaataaataagccaactttattgttccttcaaagcactccctttaaaaggttccctttaaaataagtttctgtagcctactaacaatagctactcagttaatgaactaactagaaggacaatttaccttaaagagagggaactcaaatctctgtttaccgtagtccacaatataaaacacagaaaaactattatgttcttcaataaatcaagcaattgtgaaaatttctcaaggatcaattcctctctcttacagaaggcagaaatttcctttttcttttggtagttcatctctaaagtacttaagtgcataaaattgtaataacaaagaggtttgtacttaaaacatctattgcataaaagaagttgcacattgatatcaatgttatctaaatactgaaactcagttctacataatatgaatacatatctgcattttagagtaaaggcaagagggtgatttgtgaagaaaactgtgtcattttcctttgtctattcccaaaatagaaatgttatctgtcaggataagctccatgcagaatcacaatagttacctgtttctaacagaactcgtacaacatccacctttccaaacaaagctgcttcatgaagtgcactccccttttctgtctggaaaaaaaaaagtaagaaaaaagaaagcacggttgcatttggaatgcttacaggttgaaataaaatgctcacattttacatattcatacatatttgctgtaatctcagctctccctaacagaaaggtcatgtggaataaagaagagattctaaaagcaaaatccatcggcttggggattgtaaaatacctctgcttctaaatagaaatttgggccagatgcagctgaggcggatggatcacctgaggtcaggagttcgagaccagcctggccaacatggcaaaaccccgtctctactaaaatacaaaaattagccacaggtggtggtatgtgcctgtaatcccagctactcaggaagctgaggcaggagaatcgcttgaactcaggaagcagaggttgcagtgagccaagatcatgccactgcactccaacctgggtgacagagtgggactccatctcaaaaataaataaataaatagccatttgactttcttatgtgagtatttcaccttctcttagctttagctctccttaagtataaaataagagaagtaatgcccacctcacaaggcttttgtgactatgcaagaagctcatttaatcagcatgcatttattaaacaccaattataggccaagagtagctgatggatattctgaggtatggaaatatcatcctggccctcatatattcacattctatttgaagagacagatgtataaacacagatgctccttgacttccaatagggttacctcctgataaagccaccataaactgagtatcccttaaattgaaaatgcatttaggctgggcgcagtggctcatgcctgtaatcccagcactttgggagccaaggcaggtggattgcctaaggccaggagttcaggaccagtctgaccaacatggtgaaaccccatctctactaaaaatacaaaaaaattagccaggcgtggtggcatgcacctgtaatcccagctactcaggaggctgagacaggggaattgcttgaaccagaaaggtggaggttgcagtgagccgagatcgcaccactgcactccagcctgggtgacagagtgagaatccatcgcaaaaaaaaaaaaaaagaaaagaaaaagaaaagaaaatgcatttaaacacaggtaacctaccaccaaacatcatagcctagactagcctactttaaatatgctcagaacacttacattaacctagtgttgggcaaaatcatgtaacacaaagcctattttatgataaagcattgactatctcatatactgcatatcgctagcctgagaaaagatcaagattcaaaatttgaagcatatcaaaaatgcgacagtttcacaccattttaaagtcgagaaattgttaaattaaatcattgtaagttgggggctgtctgtaaatatttatgataaatgaaatctaaacaatttaatgtagccataaaaaagaataaaatcctgtcattcacagcaacatggatgagcctggagaatattatgttaagtgaaataagtcaggcacagaaagataaataccacatgttctcacatatgtgtgagctaaaaaagttggacccatagaagtagagagtaacattatggttatgagaggctgggcaggggagcagggagaggaggatagggagaggttggtgattgactgcgaaattacagctatataggaggaagaagttctagtattctttagtagggtgatgatagttaacaataattgattatatattttcaaatactggaagagaggattttttaatgttcccaacacaaataaatggcaaatgtttaaggtgatagatatgctaattaccctatcattatatactatatttcatgtatcaaaatatcactctgtacccctaaatatgtacaattatgacatgcaattaaaaataaaaataaatttaaaagccaaaaaaaatttaatgtggcttaagaaacccagatgatattttctccctgctttcctctccgtcccatcctttgcccatcacaaccctcttccaaacctcataccctatgctccaggcatactgaactttctttttttttttttttttttttgagacggagtctcgctctgtggcgcaggctggagtgcagtggcacgatctcagctcactgcaagctccgcctccagggttcacaccattcccctgtctcagcctcccgagaagctgggactacaggctcctgccaccacacccagctaatttttttgtatttttagtagagatggggtttcatcatgttagccaggatggtctcgatctcctgacctcatgatccacccgtcttggcctcccaaagtgctgggattacaggcgtgagccaccgcgcctggcccctgaacactttcataatcatttcatattgctttcttccacagggggtctccaaggctggtctctctgcctggcaggatctaactcctagcactcttaatctagccatctagatatacctaccactagttaattttcagcatgaataagaaccatgtggagaaactgtcttaaaaacatacttctgggccccatccccagagtttctgattcagtcgcctgagattaggccatagaatttccatttctaacaaattcccctgtgattctgtaggtctaaagagtatgctttaagaaccataaacatgtacgatatctcgaatcttagcttaaaataattgcatttataaagacatccctgacccctgaagtttagtgtttttcctggatgttccacatcaatctatattttccttatcacagcactcatataccacattataattttatgtaattgtctggttcccataataaactgtaagttcagcggaaatgtaggccacatctattttttcaccattgtatccccaatgcctagcaaagtactttgaaaatatagatgtttaggaatttttctgagggcaagaagtggagggagggaagaacacaggatgaaaaactaggacaatttgtgagtagtgcaggataagactgattctgccttcaggaagctcaaggaagattccaaagatgaagctttttgagctacacgaatgttagttgtctcttttttttttttttcattctttttcttcttctctcaagaatctaacaagtatcagtaggtcgtgtgtgtgtgtgtgtgtgtgtgtctgtgtgtctgtgtgtgttttcaattgaatagtgtcaaggtagcaattttgttgccctatactaaatgtgatctctaaagtgggattctaatctcaacctgaaatagaaatatcactataaaataacatacaatgtaaaaactcttttttttttctgtttttcttttttgagatggagtcttgctctctcgcccaggctggagtgctgtggcatgatctcagctcactgcaacctccgtctcccaggtgcaagcgattctcctgcctcagcttcccaagtagctgagattaaggcatgcgccaccacgcccagctaatttttgtatgtttagtagagaggggctttcaccatgttgaccaggctggtcttgaactcctgacctcaaatgatccgcccacgtcagcctcccaaagtgctgggatcacaggcatgagccactgcgcctggccaaaactctttaataaaagtctattatataattaacccaatctaaagtagataagtacattattaagcaggcttgaggaacactgaatatcaatgtgatctgactgtatcttcaagatggaatgactgaaatgcccttgaattataatctgactggcatgatatgtagatactgaaaaaaatggaaacaaaaaaataatttgtaaatatacagcacagttttgaaggaaatgagaaactggaaactgattcggctcttaagaaaatatttcaatgtggggcatgaacattttattttttcccttccttaaaaatattccttgaaataatctaattttgctcattctcatgctgtttttcaaccagatttctgattactaatttgattcccttacacttttcacaaaattttggacttgatttcagataaatccttcctgatatagcatacttcagttcattctgaaaacaaaccaaagaatattttaattcaggattgcgaggggaaagaaatagaattccccacagccttagggaaaggcgaggacagaaagtatgaaccccagggggttagctttggaacaggtatttgttccagggagtctgtcaaccaatgctagactagtgcctggactttaaccagccactcaaggtacgagtggcagtggggcagaagacagtctgaagtctaagcaagctgaaagtttaaatgagggacccctacaaaactctaaaacttctaaagaacatcctcagtgaaaattaaaacaacaacaacaacacattgcacagaaggggaaaggatgtctaactaggtcttagttgtagatagagtgaaaaaagtaaatccccctaagaatgcctaaccacaattctacactcacatggtaagtttaaggcaaaattgtacaatctctatgaactccagatcctcatccaaaatgtagaataaagtggtcctgggtttctagtaatacaggcagatataaatgcttagaaaaaagcagatataaatcccctctgtaaaagtacactttcaactcaggcctccaaatattccagcagatgaagctctaagaaatacaaattcaaaattataaattactgaatgtgaaaggaagcatcccaccatgaacaaggattagtaaataaaaatacaaaagaataaaactcacaaaaatttcacatattgaaatggtcaggtatagaatataatacatatgtgataaataagatgaaagaactagaacaaaagaataattatcaaaattgaccagatgtgaaaatgaatcaaatagcattctagaaatagaaaatataatatttaaaatcaatggcttaataacatataaatagctattgaaggggtattaaactggatgatagatttttttaagtacataattgatagggtttggctatgtccccatccaaatctcatcttgaattttagttcccataatcttcatgtgtcatgggagagaccggctgggaggtaatttactcatgggggcaattaccctcatgctgttctcatgatagtgagttctcacaagatctaatggttttataaggagcttttcctcctttggctcggcacttcctcttgcctgccaccatgtaagatgtgactttgctcctccttcaccttccaccatgattgtgaagcctccccagccatgtgaaactataagtcaattaaacctctttcctttataaattacaacctcaggtatgtctttattaggagacatactaataggagacttaattaggagaacagactaatacaataatgcaataaaaagaataagagatgaaggacagagcaaaattgcagaatataagcctacatcatttgtcttccccactggaacaccgaatattaacaactatctgcacacagaagagcattgtcacaagaaccaaaaatcaagtgaacaatcacagtatctggttttaacttcctactgctgaaatagacactgaggagggtggaagagaaagtcttgaatcacgggcgctgcccctctcccattccatggcagtggccatgctgtgcagatagaaaatctgtgcattttaggaagggagaaagcagtgactgaggaactttacattgaactcagtgctgctttgccagagtggacaataaagctgtgtggggttccgccagtgcccacacattgaggggacatttgcaccagcccagccagaagggaatcacccatggaatgtgagtctctcaacaagcctcaccactgcactgcaggctgaagtgctctgggatcctcagtaaacttgaaaggcagtctaggacacaaggactgcaattcctaggcaaatcctagtgctaggctaggcttagagccagtagacaagattggcgcatgacctagggagacagcggcagatatggctaacgaagtgcctatgccattcctccaccaacctcaggcagtgcaagtgcaattcacaacaacaaaagtaacttttcccttctatttaaggagaggagagtgaagagtaaagaggactttgtcttgcatcttagatgtcagctcagccatagtaggacagggcactgggcagagttgtgaagccctaaatcctggacatttctagatgtaccttgggccaaaagggaacccactgccttgaaggaaagaacccagtcctggcaggattcatcacctgctgactaaagagctcttggagcctaaataagcagcagcaataactgggagtacaccatgggccttgttgtctgagaaatgctggcttcaagggtcatccagcacagtcccagctgtggtggctacggtgaacaacttcttctgtttgaaaacagcagagggaaaagtaaaggggcctttgccttgcacctaaggtaccacttcggccacagtaggaaaaaacaagcaggcacacggggtctctgcgttcaggcctaggctcttggacaacatttctgaatctgtcctggaccagaggggagcctactgccctatagggtgagtctgaggcctggcaggactcaccataagctgacaaaagagcccttgggctttaagtaaacattggcagtgacctagaagaaccctcgtggaccagaagtggtggtggccacagggagagtctcctctgcctgtggaaaagggaagaaagagtaagaaggactttgtaatgaagtgtgagtgccaatttagctgcagtaaattagaacatcaggtaaactgctaaggtttttgactctaatccttggcttccagacagctactctggacatgcccagggtctgggggaactcactgccctgaagattaggatacagtgctgagctggcttcaggtctgacccaacacaatcccagtggtggtttccgaaggggtgtttgcatcaccacacccccaggtacaggtggctcagcacagaaagacagactctgtttctttgagagaaaggagaaagaagagtctctgcctagtaatacatagaattcttccacatcttatccaagaccaccaaggcaatacctctatgagtctgcaaaaaccacagtgttagtgggtttggggcccaagtcccttcaaatgcctggaaagtcttcctaagaaggacagatacaaacaggtccagactgtgaagactacagtcaatatctaactcttcaatgcccaaacatcaagaccatccaagaaaacatgacctcaccgaatgaattacataaggcaccagggacaagtcctggaaaaaaaatagatatatgatctttcagacagagaattcaaaatagctgttttgaggaaactcaaagaaattcaagataacacagagaaggaattcagaattctatcagataaatttaacaaagagattgaaataattaaaaagaatcaagcaaaagttctagagttgaaaattgcaattgatgtaatgaagaatgcattagagtctcttaagagcagaattagtcaagaagaaaaaattaacgagcttgaagacaggtattcgaagacacactgagagtctacagccataccgccccaaacgcacccaatctcatctgaaaacacactgagaagacaaaataaaaaaagaataaaaagcaatgaaacctgctttcaagatctagacaacagtctcaagagggcaaatctaaaagttactggccttaaagaggaggttgagaaatagttaggggtagaaggtttattcaaagtgataatattggagaacttcccaaacccagagaaagatattaacattcaaagacaggaaggttatagagcaccaagcagatgtaacccaaagaaggctacttcaaggcatttaagaatcaaactcccaaaggtcaaagataaataaataatcctaaaagcagtaagagaaaataaacaaataacatacaatggagctccaatatatctggcagcagacttttcaatggaaatcttacaggtcaggagagagtggcatgacatatttaaagtgctgaaggaagaaaacttttaccctaaaatggtatatctggcaaaaatatccttcaagcatgaaagagaaataaagaccttcccatacgagcaaaatctgagggatttcatcaacaccaggcctgtcttgcaagaaatgctaaagggagttcttcaatctgaaagaaaaggaaattaataagcaataagaaatcatttgaaggtgcaaaactcactggtaatagcccacagaaaatccagaataaccctgtaattacggtgtgaaaactacttttatcttaagtagaaacactaaacaatgaaccaaaaaataatgactacaatgaattttcaagacacagagaatgaaataagacataaagagaaacaacaaaaagttaaaaagttaggtggcaaagttaaactgtatagtttttattagttttctttttgtgtgtttgtttgtttatgcaatcagtgtcatcatcagtttaaagtaatgggttataaggtagtatttgcaagcctcatggtagcttcaaataaaaaaacatacaatgggtacgcaaaaaaattaaaaagcatgaaattaaagcctactgccagagaaaatcaccttcactaaaaggaagacaggaagaaaggaaaaaaggaagagcagaccgccaaaaaaagagagcgagagaaaaaaataacaaaatgacaggagtaagtccttacttatcaacaataacattaaatgtatatggagtaaactctccaatcaaaagacatagagtggctgaatagataaaaaacaaaacccaatgatctgatgcctacaggaagcacatgttacctataacgatacacacagattaaaaataagtggatgaaaaaagtattccatgtcaacagaaaccaaaaaaccacaagagtagctatacttatattaggcaaaataggttttaagataaaaattgtaggaaaagacaaagaaggtcattatataatgacaaaggggtcaattcagcaagaggatattacaattgtaaatatatatgcaccaaacactggagtacccagatatataaagcaaatattattagtgctaaagggaaagatagacctaaatacaataatagctggagacttcaactccccactttcagcattggatagatcttccagacagaaaatcaacagataaacattggtcttaatctgcactttagaaaaaatggaacattttatctgatggctgcaaaatacatattcttctcctcagcacatggatcattctcaaggacagaccacatgttaggtcacaaaacaaatttttaaacattttttaaaaatgaaaaaatatcaagcatcatccctgaccacaatggaataaaactagaaatcaataacaagagaaattttggaaactatgcaaacagacaaaaattaaacaatatgctcctgaataagtgggtcaatgaagaaatcagaaagaaaatttaaaaattccttgaaataagttcatggaaacacagcataccaaaacctatgggacacagcaaaagcagtactaagaagaaactttatagccatcaatgcctacatcaaaaaggaagaaaaacttaaaataaataatctaatgatgcatcttaaagaatttaaaaagcaagagcaagctgaatgcaaaattaagagaagaaaagaaataataaggatcagagcagacataaatgaatttgaaatgattaaaaaaagacaacagatcaacaaaacaagaagttgttttgaaaagaaaaacacaattgacaaacctttagccagactaacacaagagagaagacccaaataaatgaaatcagaaatgaaaaaggagacattacaactaatatcacagaaattcaaaggatcatgagtggctgatatgaacaactacataccaataaatggaaaaatctagaagaaatggataaattcctacatacatacaatctactaaaattgaaccattaacaattccaaagcccaaacagacgaataacaagtaacaagatcgaagccataataaaaagtctcccagtaaagaaaagtgcaggaccgatgactttgctgatgaattctaccaaacatttaaaaaactaataccaatcctattcaaactgttctgaaaaataggggaagatggaatacttacaaacccattctacaaggccagtattaatctgatactataccccaagacacaccaaaaaaagaaaactataggccaatatctctgattactattgatgtaaaaatcctcaacaaaactccaacaaaccaaattcaacaacaaattaggatttatccctgtgatgcaaggatggttcaacatatgcaaatcaatcaatgtgataccctgtatcaacagaatgaaggacaaaaaacattatcattttgactaatgctgaaaacatatttgatgcagtccaacatcccttcctgttttaaaaaaaaatagtcaaaacacctcaatgtaataaaatccatatatgacagactcacgactagtatcatactgaatgggggaaaactgaaagcctttcctctaagacctggaatacaacaagaacacccactttcaccactgttactcaaaatagaactggaagtcctagctagagcaattaaacaagagaaagacataaagggcatccaaattggaaaggaagaagtcaaattatccttgtttgcagataatacaatcttatatttggaaaaacctaaagactccactgaaaaactattagaactgataaacaaatgtagcaacgttgcaggatacaaaatcaacatacaaaaatcagcagcatttctatatgccaacagtaaacaatgtgaaaaagaaaattttaaaaatcccatttacagtagccacacataaaactaaatacctaggaattaaccaaataaatgaaaaatctctacaatgaaaactgtaaaatactgatgaaagaaattgaagatgacatcaaaaatggaaagatattccatgctcatgaattggaagaatcaatattgttaaaatgtccatactaaccaaagcaatctacagattcaatgcaatacctatcaacataccaatgacatttttcacagaaatggaaaaccaatcccaaaatttatacagaatcaccaaatacccagaatagccaaagcaaacctgagcaaaaagaataaaactgaaggaataacattacctgacttcaaattatactacaaatcagaatggtactggcataaaatcagacacatagaccaatggaacaaaatagaaaacctagaaacaaatctacacacctacagtgaactcattttcgacaaaagagccaagaacatacactggtgaaaagacagtcttcaataaatggtgctggtaaaactaaatatccatatgcagaacaatgaaactagactcctatctctcacaatatacaaaaatcaaatcaaaatggattaaacatttgaatctaaggcttcaaactctgaaactgctaccaaaaaactttgagaaaaatctccaggatattggtctcggcaaagatttcttgagtaataccccacaagtacaaacaaccaaagcaaaaatggacaaatgggatcatatcaagttaaaaagcttctgcacagcaaaagaaacaatcaacaaagtgaagagacaacccacggaataggagaaaatatttgcaaactactcatctgacaagagattaataaccagaatatataaggaacaaaaaaactttacaggaaaacatctaataatacaattaaaatattggcaaaacatttgaatagacatttctcaaaagaagacacataaatggcaaacaggtatatgaaaaggtgttcagcatcattgatcatcggagaaatgcaaatcaaaactgcaaagaaatgtcacctcaccccagttaaaatggcttttatccaaatgttaagcaataacaaatgctggtgaggatgtgaaaacaagggaatcctatatactgtaggtgggaatgtgaattagtacaaccactatgaagaacagtttggaggttcctcaagaaactaaaaatagagctaccaaatgatccagcaatcccactgctggatatctaccccaaagaaaggaaatcagtattttgaagagatatttacaatctcatgtttgttgtggcactgttcacaatagccaagatttggaagcaacctaagtgtccatcaacagatgaaaggataaagaaaatgtggtacacacacacacacacacacacacacacacattttcttggagtactatacagccacaaaaaagaataagattctgtcatttgcaacaacatggatggaactggagatcattatattaagtgaaataagccaggctcagaaagacagacatcacatgttctcagttatttgtgagatctaaaaatcaaaacaattgaactcacagagataaagaagggtggttaccagaggctgggaagggtagtgggggcacaggggttagagggaggtggggatggttaaagcgtacaaaaaatagaaagaatgaataagacctagtatttgatagcacaacaggggcactataatcaataataattcaattgtacatttaaaaataaataattgtaacacaaaagataaatgcttgaggggatggatactcaattttccatgatgtgattattgtacattgcatacatgtaccaaaatatctcatgaacccataaatatatatacctactatgtatccacaaaaattttacatttaaaattttttaaatgactacagaaacaaataagcaaagaaggtaaaaaagaaataagagatggaaaatatgaaagatagaataaaataagaggattcaacatatgtctaatcaattttagaggaagaagatagaggtaaataatagtcagtggctaagaactttacataattgataagacactaagttccaggaccagcaagcaagataaatgaaaagaatacatcctggacatatcacagtaaaactacaaaactactaagataataactttaagacactctgagggaaaaaattgcctaaaaagaaataataattagatcaatagcggacttcacaacaaaaataaataataaagtcagaagaaagtataataccttcatgtgacaagagaaaaaaaatctatcaacctagcattctacattcagtcaaactaccttctaaaaatgagagtaaaataaaaacattttcagacagactaaaaatgagtggttacttacaactcttactgaaagaacttctataggatataattcagaaaaggaactgagatgcaagaagtaatgataaataaagagaatggttaatatgaggctaaatctaaacaaatatttaaaaatatgatagtgtctacttttggcactgatttggcttcacagatactttgataaaggatgatgcacactgtagacacggaaaaggtcccactttatacacagggaatatattccaagcaccccagtggatgtctaaaaccaaagatagtactgaacccgaatgccatcaatcagaattcatttctgttcatgtcttccatccacaaattcaaggccttttccatcttaactaagcacttaccgtgcactatagctgtaacttctgtagtttgaggtgcaacagcaaaactagtacaaatttctttttctttcttctcaacttcagatagaggattcattcttaccatagatcttagcaacctctgtgtacaagtttttcttttctttagtaagtcaagaactttcaccttttcacttagaggaagcactttacagcttctctttggaatatgcaaattgtcagcatcactgctcttgtgctttggggccattattaagtaaaatatgggtgacttgaacccaagcagtgcaataccagaacagtcgatctgataatcaagagggctaccaataggcaagtagtgtctacagcacagagatgctggacaaagggatgattcatgtcccaggcaggacaaagtatgatggtgagagttttcatcatgctactcagaatggcatggaatttaaaacttataagttgtttatttctataattttccttttaatgttttcagaccatggttgactgcaggtatctgaaacagcagaaaactaaacatcagataaaggttgggtgggcggcaggggtagggggaactattatattctagacaatgaaaatacataatctccaccataaataaacaaatctctttctggaaaaagcagatggagcaaacctgggttccagtggcagcttggcttttagtatctctgaaaattcatatatcctatgagaaacatattaaaaacctaacagatacatccatgttgtgtgggaaaaattaaaaataaaatacaaattttaaaaacctaatatggttattgggaaggttaaataagataaacatacaacaaataagattttttaagtgttttattaaactataaagtaatgacaagtattatcaataatatttctattaaaaaagcaattagaaaacctattttaaaagtaacctcaattatgttaatattaattacatacatgtatatcctttacattattccaagataaaaatgctatgttaagtagaactaatgttttcatacaataagaagacacagaattcttcaataaaaacagaaaaggttagtagatgataaacatatttttagcctgtaaaaatgaatctgtttttacaaattcaaggttgctgtaattagcttctttggtaagagaacatgagaactgtcaaatggaatggattggtctcataattctaaggtaaacaatggtaccaagaactatttactgctatcacaatgttgtcacatagtgtacagaatgtaaatatgtcaaacccatggacttttcaaaatatagattaattttgtaataatttccttcttttcatcagagattagaaaaatttaagaatattttgccaaggtgtaaagtaagatttaaaaaaaaatcaagtgccttgtggcttatcacaccctagacagagtccgtgtctaattgtctaatattctcactcaaatgagcactattctgtacatctcagcattctgccccaaatctacaacccataaccggccagaccttgaaaaattctattcttgtgaaatatttagtccaaaacattttacaagaaagtaggaagtctacaaagaaacaacactgaacaaggtgaacccaaaggctcccatccctggagatttcagtcctgcttttcttatggatcaaaattctccattttatttaaattaatcatttaaaaaaaacaaaatttccaaaatcgataatcatgcagtttataacacagtgacatttcaaaacttatccagtaaccacacataaagcactcataacatctcagcaccttttaggggaaaaaaaaaagacaaacctctgaacacagtgatgaaaacagctgagcgaaaagtactgaaatgatatatatgttaacatcaataactgaattgttgatgaaagcaaaagaaattctctcattgattggaaatgcctgttaaagtcaagccttggtagcaccaaagctgagaaaaacaagataagtcgcaagcaaaagggagagaagatgacgttcatgtttacagccctgggtttcagcttcccttctttttggcgttatatatttctgtgacttccatggaagctcagttgtgcatttaaagggatgtttgttatattttatccaaaatttctagatgttttaaagtcgtttttaggttatctattctaccagagtgccaaaacagcagatggaaaagggatgcaaagatgtcagagcttagctgcactggtttccccttccaaatttagcactccaaccataattatcctgaagcctgcgaaagagaataatgagataaagaccgattcttgattaaaggagaaaataaagataacaattatgataagcaataatgattgtggtgacgatcagcagagaaaatagcacagatagcataaaactgtgagaagcaagacccacaactattgtaacaactggtaaataaagataaccttactggagatgaagaaaaaacaactagaatggcatttaactcagaaataaaattccctagtaccctgtttggtacttagccacgtgggcacctcttggaattaaaaaaaaaaaaaaaaaaaacaaaagataacaactcaacttagtgtttgacaacaaacatatgatgtctgaacaagttggaaggcagcagctcttttgcattatctagaccatatctagaggagtatgttcaattgtgggtatctaacttttaggaccaatgacagaatacaatgtgtccagagaagagagtgccaaagaataaaggacctagaaaaacatcgtgtgaagaataaaggttataagaatgtttaaactgggaggaaaatggcacaagagaaatatgacatgtcttcaaataattcagaataccattgttgctattcaaaagaagaaatctccctctattaaactagggacttcaagtcttggtctttactcattctctcttccttcacttcatatcaaaggaagcacccttcttttcattaacattatttctccacttgtgctctttattctatcactttctgctgcttcttgaattttgatcatctctgcctcttgcatcttcaaggcaatctttctccataaacatacacacctttccactatttaaaaacaaaacaaacaaccaaagaaacttcctgtgaacctgctttcacttcaagcttctatccgctatcttacttttctttattccacgctttatgaaaagtcatcttccctcttttaggcacaatttttgcctagttttgttactgctatatcctctggcacatagtaggcactcaataaatatatgataaatgaattgattacatgaaattgtgctgtcttggcattcctcttttaactgcttctttacagacctttttccagaaactccctgaatattctttaatcagcctcttctgtctccctacattctgtttcttgtaagcccttctatctcatggcttcatctcttactcctctgaggctagcctcttagaaagttagcctcatttaaggagcacatccaaagagagacctctctgacccttccgtctcaatcacagcacccagtttgtttccattatagcactcactgcaatttatcatttttatgttgtttatgtgcttattttctgtcatccctactagtctataactccatgggagcaggaaacaaattttcttcctcctggagcatagtgcctggtagcatggcatgagaagtcaggaggggctagggtatcctcatagggaagccagggttcagttaaaagtgaaagaaagggagttgcttgggtagtgagtaaggtaagtaaaggaaggcctcactattaaggtgacattggagaagacacctgaggaaagaagggggaagaaagtcatgagggttagtaaggcagaggcctggaggtaggagtgtacataatgtgttccaacaagaacaacaaggtcactgtggatgaagctaagtgaagaagggcaaagaagagtaggtggtagctttagagagacagtgaaactaagtaatataaaaccctatcagacactataaggactctggcttttcctctgagtgaaatggaaaaccaatagaagtgtttttgagtaggaaaatgaaattacctgactgaatgggatcacttctggctgtttgactgaaaatagactgaagggaatatgttatggattgaatatctgtgtgccccaaaactcacatgctaaggccctaacctccagtgtgactgtatttggatatatggcctttctggaagtagttaaggttaaattgggtcataagggtgtggccctaatccaatggaactggtgtccttataagggaaagaggaaacatcagggaactctctctccattcacgcacagaagaaaggccgtgtgaggatataacaagaaggcagccatctaacaagccaggaagaaagccctcactcaggaatggaattggccggaacttgatcttggactttgtagcctccagaattgtgagaaaataaatttctgttgcttaagccactcagcctataatattttgctgtggcaacctaagcagacaatacagaagccaaaaaaaaaaaaaaaaaaaacggaggaaaactagtcaggaagcaagagatgattaggtcttggactatggtgttaatcttgaagataatgtaaagtagtgaaattctggatacaatttgagcacagaaccaataggatttgctgaagaactgaatgtaaaatctgaaagaaaccgtaaaattctgggccaaacaactagaaggatggcactgccttttgacaaaatgggaaagacttggtgatatgcaaatttttgaagaaaggggtacagatgctagattttcagctttggaaatgctgagtttgagaagcctattagtcatctgatagatatgtccagtagggaattacatacacaaatttagagttagggtggagtctgagatgaagaaatagacttggtaattgtcagataaagatgatattggaactcaagagattggatgaggtcaatgaggaagtaggtatagacagagatgaaaagatgtttgagtactaagccctgggacactccgatgcttagagatcaagaagatgagggcagttaactatggaatagggacacgatagattacattattggcctctccttttatatgctctttgccgtatgactttgtacttctttccacttatatgagttgagtatatttctcttcctctttatttgaggcttggttttgtgacctgatttagccaatggatggtaaccaacatgatgcaagcagaggcccaaactgtgcttgcatgattgagctttctctcttatgcacaatcaatgcccccctgcctagtcccaggaggaagataatagacacgtgcagcagagattcccaggctaacttacagcatcaaacatacttcccccagcttcttcaagaagtcaccagtgaactaaatgaaaaccaaaagacagtcgtatctcagaggtcaaaagaaaacggtggttcaaagaagagacagatactgactttgtcagtgctgatgatgaatcaagtaagaggagaagcaggaattgactgttggatctaaaagtatgtcagtcattagacaacttgacaaaggcaaaaacaaggacttttaaaagtgagggagttagagtggcctcaagagagaatggaggaaagaaattggatacaatgagtaaaaacaagcttttctaactacgttgctacaaaggggtcagagaaaggggatggtaaggagaaggaaatgtgagatcaagagagtttttaaaagatgagaaatattacatctttgcatccttatggaaatggtacagttgagaaagaaaaaacgtatggtattaaagacagaaaatatttgtcagagttcccacgtggacaagaaaggataggatccaatgaacaagtagagaggaattagccttagatacaaacctaaaaggttcatttaaagcaccaggaaggaaagtagacacaggtacattggcagatgtggtggtggaaatttgtgattgcttgtggtttcctcagtgaaataaaagcagtatcatgatcagagagggatgatagagaaggaggtgttgaagttttggaatagagatgtcgtgaaattatcatctagggaaatcagagagtaaatggattataatggataattatcgcctatgtacatatcttatttctggtgccactataagcctttgagagcaaaagctgtatcttacttagttttgcatcttaacagctcttagcatggaaacttgtactttttattattaactttctgtaattttactttcatttcctttaatagtcacataaagtctaattggcttaaggttgtactagttctttaactcttcaagtcttatgagagaaacttataagaaactcacacaatgaaagcactagcatgatatggcactatcgctatctggttacccaaaatcaagttcaaaattcataaaaataattgctaacttcaagagaaaactgcccattcaaccctactttcttaatatcttactttgactgattctctttattaaaaaaatatttaaagactaaagggtttataagtaaagatgatatgaaatttgcccaaagtattacttactattttaaatatgtgttataatttaaaattactcagagagtaatgatgcagaaaataaacttctagagcaaatattaacatcaatgctgcatttaaaaacatatgtaggtcaggtgcagtggttcaaatttgtaatcccagcactttggaaggccaagaaaggaggatcacttgagcccaggagttcgagaccaacctgggcaacatagtgagaccttttctctacaaaaactaaaaaaattagccgagcacatcagcacatgcctatagtcccacctactcaggaggctgaagcaggaggatcacttgagcttgggagttctaggccgaagtgagcatgattgcaccactgccctccagcctgggtggcagaataagaccctgcctttaaaaaaaaaaaaaaagtaaaataaaataaaatcacatgtaactactaggaaaagacaagatcctcaaaagccatctataagttttaaagatttattcataataacttgaatgtaattgaagtctaaaagtacaatactataatttaccaaatgggattacttttaatactaattcccaacaggttagctagagcagtttaatgaatattaaatctactgaaacaatttgaggctactagctacattgttcactctcagccagtgagaatatcaacaaacctacttgatattcaaaaattttgcactgagtctgatgggaaaaacttggtaacaattaatttgagtaataaaattaaatattcacccccccccaaaaaaaaaggcaatgagaccaaaaaaaaaaccaacatattttctatgaacaaagcaacaataacaaaagcaaaatatcaactaaggctaaatatattatggaagattcatttcattgagatatattttagaaagatgttgtcagttctacttcctagaattcttagaatgagtgtcaatagaagaggttatagcaacacagaagttgtccaccttactcagacatcaccccgatacttctgattaggtgttcaaagtgatctaagcatattgtctgcctttcttctgatatgtgaagaacaaatctaaatgtggtgaggaccaagcagacaatctaaaggaatgacaatggcaatgatataaaatggtagaatgaggtcggagccttggaaagcatttaccccatctaaaagcactcaaattcaatattttaaaatactctttagccaaataatgcacatatgcaagctaaaggccacctaaaattcaaagtcgtgttggactttcaaaggtccccttcaaatgtcacttccatcaatgacttctcatgttctccctcttaaaatccatattttcctcacccgtagatccacagctctttgttttagcatttattatatgtcatggatgggagttattcttgcaaattttttgtctcctccactaagcgtggggcagagatagttttggttttttattctccaaaagcacaaaatacagtgttttgcagaaaaaaaggacacatcatatacatttataaaattgaatttaaactctttcccttctggtcatgtcatctagtacaaaacatgaaaggatcttggtcagggataccaagaagcttactgacctcagtcagaggggaagtccttggttatattgcagtctgtgcaatcaagtttaaaaatattacagaagtgtgaaagcagtacatccagattagagaaattcaacatttatacaataaacatctagtttatcattaaacaacttttaggaaaataactttgtgagtcacctacaatagtaagcatacctacttattttcaatacccctttgaggagagagactgtttttccttaatatgactgttagaaaaaattcttatgcttttttgagaggctgccaaagttgaataaataagaaattgagaaaagatattacaaatatctaaactactaaataatgcaggcaaagctctaaagcaagctctggttcagggtgctagccttaaaactgagattggaaggcctgagatttttctaaattcaataaagaaaactctggaaatacaggattcaatctctgaacaattcctaggaaatataaccccatctgtgagcacgcattccacctggagtgtgtaattatttgcaacatttgccacatttagtccctctgggtattcacacccttttacaattcacgccctcttctaatacagaggtagactctattttccaactccttgaatatgggttgcctttatgacttgcttcagccaagcaaacatggcagaagtgaaggtgtactagttccaagcctaggcctcaagaagccttgtacaattctgttctctctctcagaaccatgcatgccatgtgagtaagcccaggctgacctgctgaatcatgacagagaagtggcagtctcacctatcaccctagacaacatccagccagcctctgaaacagaaacacataactgatttgcagttgatttcacacacaagagaacacagccaagaccagaagaaccatcagttgagcttagactaaattgccaatcacagaattatgagctaaataaagagttattgtgttaagctattaagttttgggatagtttgttgcacatcaatggcttactaataaggggagaaggtcacaatatgacagaaagcaaaaaagtctctggaagataagaatgctgccattaacttggaagccaagaaataaccatgaaaggaggaaaaggcaaaaaaaaaaaaaaaaaaaaaaaaagactaaccctggagttggggctaacttaagacaagatatcaaaagtaggctgtggccaggcccagtagcccacacctataatcccagaacttggggatgccaaggtggaaggattgcttgagcccaggagttcaagactagcctgagcaacagagcaagacctcatctctacaaaaaatacaaaacttagctgggtatggtggtgtgtacctgcggtcccaccagctactggagaggctgaggcaggaggatcacttgagcccaggaggtggaggctgcagtgagctgagatcacgccacccaccactgcactctagcctgggcaacagagcaagactctgtctgaaaataataataataataaaatatactaaattaaattaaactttttaaagtaggttgaccattccttgtggagaaacaaaacctatccaaatcctattcttcctacaaagctcacctcaaatcacaccttttccatttttttttttctgagtgtccttaggcatagtgatcattccttcattagttatgtataaacagtacattacggtggaaagaggcctggactttaatcagtaagtctaaattcacatcccggttttatcaactatgtgtccttagacaaatttcttaaatctttgaatctgattcctcatctcttaactgaaatttaatagttctcaatcccaaaggacagttgtgagaattgaattctaaatgtgtcaacatgctaaacacaaagtacatactcaacaatgttaaagtgaattttgttccattcattcattaaactctgactggattcctactgtatgttaggctgtgtgctagatattgggacaaaggaaacaattactaatgataccacacacaactgccatctactaacttctcatgtgtatagccctcaaattagaatgaggttagagattatgccttgtagctcttcatatttcccaaaagtaggtggcatagtaccttgaactcagtagttacaaaagtacttgtgaacaatttgattaaaagatttctacatacaggttttcacatttgaatcccaaagccaagcaacagcatcatcacttttaaagcatagctaaaagcacactcacttgacagctcacatccattcctgcctccagcagcacctgcacgactgctttgtggccattgcgcgcagcaaggtgaagtggcgtgtgcttgcgagtgttgcagctcattaagttaggatgtgcactgatgatcatttttaccactctaagccgtccgtagagtgccgccaagtccaaaggtgtttccagcttgctatttctaattgtcgggtcagtgagctcttctaggagaacagcaactacttctgagtgtccatattgagctgcacagtgtagggcagtttcattttcattgttctaagacaaagatttttaaaaaggcacattttcagaaattcaatttgttatcaaaatcttaacacagtaatttaaaacctgcaatgctttgaaatgtaagttaagatttatccattttaacaagtatgcctaatggaattttatatttgataaaagtatctaggattcattgaatcaaaaaaaaattttttatatcactttaatcgaaaacaatccaacatttccctaaatcatatatgccaacttccaaaaatgacaaatgatttagccatgtttgtcagaggccctcctgggtccagaaggacagtgatatctgcatggtgcatcacatctttagacatttattaataagagagatcaaaacaattataacagacttttaatagactggctttccaaaagacagataagaaggtaaattcttggtaacaaaaggtttatagaaaggtttcccaaattaagtttcattttattttccatgtaagtacaaatcattgcttcctttgcaaagaaaatgaaaagattttggccttaagatataaaagtacctttttgaaatgttatcatgggttgtgaggatggacctagatcagttcccagacaagttactaggagtatcacagtacaacatgtgcagcttataagggttcagttgaaaatcaatgagattttcctagaaatgtatcaagatttttaaaaatgttaagatacagaaaactgaacccagttgcaaggcagagggacccttcagactatttgagcaatataggtagatggtgtataggtatgtcaggaggtggaagggtcaggagaaaaatgaacaagaaattttagtaacaaaaatgcaataaccgtaaatgagggttctggaaagaaagagcagctgccaccatcagagttatcatcatagctaacactatgtactagacatagttgcattttatatatgtttactcatttaatcctcattatgagatagatactattatcattatctccattttacagatgagaaaactgaggcactgaatagttgaataactggccttccgttatacagccatttagtggtaggaccgggatttgaacacaagtagccaagacccaaagtgggtgttcttaaccatcacacataccaccttccaaaataggaactattactactactacttgttgagtgcctaaaaactatatatattgtctcatttaactcttacaacaattctccaaaatttatattaaaattgtctacttcatggacaagtaaactaaaatacaaaaaggttaaattacacatccaagtagaattaagatattttgcaagctggatctgacaaatccaaaacccatgctctttccactataccatgttgtctgccatgtgttgctatattgtcaaagaagagctgggaattagtgatctgaaagcagaatttctagaggttttgctcagaaaaataccaaccgagaatagggagtagctgtttagatagctgttctgatgaaaataaaaggataagaagtgttcagacccaaacaaatcttaatgttctagaaagtaactcaagtttgccctggatgatagaagaatgcaagtaagttgagagtctagagggaagatttgaaaatttaaaaaggagtagagtgacaaggggaaaacagcactaggaaaggcttcttactactttaccttgcaaataagtatcaagagagagcatttgaaggtcaaacccacagggaaaaatctactctttcaagacaatcaatgaaaagttaagacctgttagatggggaatccagctgagggtactgtttcttccatcatttgtcaggagtccttctttacttggtttgaaagtattactataatctacttcttcataaacaatgatcacatacaggtttagactccctggtcttcttatctgtttttcttatcaggcttataaaacagccaatcttattacttcacaccatgaaaacattatacagatatatacctcctgaccaacccaaatttccccctggtctgaaagggattcaatctcagttttcaaaatacagtatctctttgagaaaagagaaaggccagttatgaaataatgattcctcaaaggcctctctactggtccagagccctgagcctaggaaattacaagagcaaaatcgaaaaattttctagtaacaccaattagcactgttcagatctcaagggaaaatatatcaatcattcaagacctactcaggataaaaagttcacagattttatccatgatcatcacatacttggatcgtcacctcagtggacgccacaacggtggtacttttacgagagcatgattgtgtatttgtgtatgctcacaagtgatctaaaataatctaatttgaaataaataggctgtgatgaggcactgattaataattcctagtatggctatgcagaatattcttaaaagttttttaattccttcttttttaccaaatgggtattctctgaaacattaggacccttccagataatggatgatagaacaaaactggctaacaaaagccatttaccaaaaactcttggttcagagtaaaacatctaacaagagttggattcgagtttcggtgaatggcaaaggcaatgtgtttttcagataaggcccctctgggttttgccctaatgttaaaataaagaaaaaaaaaaagaggaagagaaggtaaagggaagaaaggattaatgaaatttaaagaaattgaaaattttcaatttaaaggaaatttaaattgcaaaaaggaaataatcagatgataaaagagaaggatgtggcaattataaaaaccataatccgggtagagtccactttgtttagaatggtgaacaagacctaggttgaagtgttaccatgtaaattacttcatctctccaaacctatcttatctgtataatgagaatattattttccctataaaccttataatatagtttataaaccaaaagagataacatatttttaaaatgcattgtaaactttaaatattaaaatgtagaatagaattatttttaaagaaagctgtattagaaaccaaagataactttcagaaatcagaatgaagccctgactataatgcataattttaacataacataaatgtattactggttgagagcttaggctttggatcagaaaaacctgcgttcaaacactggctgcatttcttagtagctgtgatgttacggtcaatctactctatctctctaaggctgtaactccatatatatagtagcaacagtaatctagggcttagtaagataacggggatgaagtattttgcacaatgcctggcacacagtaaacaatccattaagtgataggatttaggatgacaataccaatgcgctgttgtgtaaaaggctctggagtcaaagtcctgagtctcagtctcagtttcagtcactcagtaacacgtggccttcgacaagttgtttagttttacagagcatgatttctcaactataaaatgcgagtgatattatcaattcagaggattattgtgagaattcattaaatcgtatttttgaggtgaaagtgtttagaacagtgcccgctttaccttatgtctcaataaatgctaattaccatttttatttcctttattgtttaaatacataaaagtttataattaacaagaagattctgtcctattcagaaggaaaaaagaaagctaaaattaaaagttatctataaaaataaaaatcctacatcaaaaaatttaggagaaatggcatagaatgggaaaactatgatcagcatcaaaagagtatacatataacaatgaaaaaatactaaaattatggtattaaaaatcgtaagaaagttgcaacttcttgccaatagaaaccgcaacacaaagcaacagaggtgaacaaaggactttgaatatggtctccttaaaaagacactttttgtaatttaattgatctattcaacattaccaaaaacaagtatttctctttaaaacatatagcaacttttcactttcaaatgtaagtgaatactatatgttatttcttattttcatgtcatttaaaaacatcttgtttgtaaaaactaacatcctcttgtttaaccttggattgtttttccattttattatttcaggtttgctttgcagtattcagacaattttaagaataaccaccagatggctcatctcataaatgatctaactgttggttttctgtggaagagaagagcattgtcataaatttccttttagcatgatatgatgataaagatagccatatctgtcatgttttaaagactgggtgcattcttattaaaatttctgcatttttgtaacctgtaaacatggaaatttttattgtgataaatattaataagatacttttccaattaataaaatgttttcctgattagtcctttcaacaactgcatatatattttcattgaaaaaatatgtatttttcttccctttgctatttacagcaattgttactttttatccttcagtctgaatttcaaagtccggcaaagtctgcatccatttgaacaatatgctaattgtgctttattagatatgcttgccctaaagtaacctacttgcattgatattggacaactgccaacctgcagcttaatgccgtgattgtaattcaattgttggactgtctgctggttttcaaatatagttttacaaaatgggaacagtagggggcatgcagagatcaacatgtttgttatcatactgtattaggggaccatattttactttctagaatctgtggtcctatctgtttagaatactgacactggttttctttttaaaatatgtccattatgtgtaatatagatattgtgtacttacaaatacattaactgtcagaatcatactgctgctgtgttttattcaacttattctgggcatatgtgtttgtgtttgtatatatatatatcaaaaaattttaacttaatatgtgacaagcaactgtatatgctatatttcacattttgattcacaagagtacttaaccatgaaagtgctaagtaaatggtaaagcattatgcaaatgataggcatatcattgttttagcattcaaaattgtattaagaaacattgtaattctcattacacatatgaattctgttctatctttaaatattcaatggctataaaatggctgattatataagacaggcaaaaatatttcagctacttcctttatgtaggattttcccattaacaaagtatctttacaaatgcccaacttagtccctgcatatcatatccaaacaccaaagaatttttcaaatttctccttttaggaaattcagcaatggaaaggcctttgggcaaggtaaagataaaaaaatcacattttcaatatggctttgccttgtaaaactagaaaaattacatcatgagcaaacatttggcaagtgcacctgttcattgaccctggaatgtgatggtccatgatgaataagaatcttcacaatttccacatctcctttccaggcagccaggtgaataggaaaataccctttgttgtctgctacatttgttgatgcctcatactgaagtagtttgagaactatgtccctaaaaaggaaaaaacaacaacaacaaaataggctgagcaagacaaactgtattaaataggtaattttaaaagaatactagatgctgggtgggaatttagagtaatcattcaaggtactaagatataaagttgggtttcaaagtttttgcctactcaacatttggctattttacttacctggaaaaccatcaccccatgccacacacacacacacacacacacacacacacacacacacacacacacagagagagagagagagagaaagagagcgagagcacacattgactaaccaattaaactacttaatagaattcatataagcaaaacttaacttatttcattaattagatgagctaagtaaaatgaagaggataccaactcccatttttttttttaaaaaaagagctctttccagatagcccatatctgagatttagtttgaaggaaaagttgaagttacaagtatattccttgtttacacacacacaaaaagttatcataataccaaggaggcatttataaaatttacacatcattcctacagataattggaataagagatttaaggggtatgtaaaagagaaagaaagtgcagtatgtaagggacccttgacaagctaactgtagtactagcccagggttaaaaaataataataaaaaaattttaataacttctcagtgatggcacacaacacactttgagtattccttgttcctacttctgtattccttcacctttcttctccaagcataaaaaattatttcaaaagggaaactcatttaaaagacaagttccaccattaatgcaatttcaacacatattcaatatatcctacctcaaaaattttgaacttaatccccaccaggttttcaaagtaaaaatcctgacctgcattactcaaccttagaaagaattaattaataattattagcataaattatatcaaaatatatgtcaacaatcaaaagcagtaattctaaacaaaactgtattttcatttggatgcatttaagaagcaaattctattaactcactaaatgaaatgctagtcagacacacataaataaaaatatatatataattacaatatataataaagttgtttcttacatacaacaaatcactaatggggagggtgaacataacagatttacatttaaacatttcataaaatcagactctagatgcaagtaacaaatgaaaacatttggaggaaattttaatagaaggaagattagaattttgatagctcacaagaaaaacagatatgatatgatacaaaattatggtaaatggtaaaacatactgtccagaatgtgtcctaaagtcacaacatttgacttaattgctaaatgtaagaaatcatgattttaaaaaaacaagaatatgttgtagaaatatttagaatccaaggagtcctaaattgtctaatgatataatttctgagaaattaagaattaaattttaacatttctctttgaaaaaccagcattattttacgaaatctgaatttagaagacttggatttgtgtcccagctatgcaaactacctgaggctgtgattccggagaaatgataatcacacaccacataatgataattcgatcaacaacagaccatccgcatatataatggttgttcaaaaagattatcatacctcatttttactgtaccttttctatgttttgatatgtttagatacataaatactttctgtatctattgtgttaaaattgcctacagtattcagtacagtaacatactgtgcaggcatgtaactcgggagcaacgggtcataccatgtagcctaggtgtgtgacaggctatatcacttagatttgtgtaagtgcactctatgatgttcacacaatgatgaaatcacgtaattagacatttctcagaatgtatccctgtcattaagaaacacatgactgtacttagtctcattttctttttcttcaggagatactataatgataatgtctactcaaaactggtaatagcattaaataagatcataaaaaagaattcactcaataaatagtaaagcactataccaataatagcacttgtcccaagtaaaaataaaatactttagaagtgaaatgaaatgcttatagaaagtcaccttcgaaaaacagaatcagaaaatcagaaggaaacttaaaggttatccagttcacacgcttctccccatttccctgccaagcaagggttgttatatagggtcttccattctgacataaataaatacataacttcagtgaggtaatgagaattcaatacctatgaataacaaaagcagataaggaaagatctgaagtcccaactctctactatttacaaacctggttaccttgaggaaattaagtaacctctgtctctctttcagatattgtgaaaatagaatttagagattacatcttggtgctagtttcaaacagttatggtgtgaatcaaatgagaaacagatgtaattgtaaaattatatatacaatcaaaagttgttctcaaggcagattgttgcaatgttaaacaattccagtgattgctttttaaataaaatatttcagcatttaaaaggcaaaataatagcaaaagaagttagtcaaattaaatacctggatctaaaatgtagaatttagcctactacaaaatagacttctccaagttactgtcaaagacaactgtgagaagagaaaaatttcatttcttaatacctaaggaaataaaaaatatattctgaaacaacttctcctataaagcatttcctttcaaggggtaaagacgaaaaaaagattgatgggatcatcaattctatttccttttactcttgctccaatcacttagaatttcatttgttctttggctcaaattttactgacattttctaataatgtaagtgatatacattcattcttcatttatcaggaagatttatgacaagtgaaaaaacgtctattttgaaaactgacttactaatcatttgtattttctagtattaccaccatctaatatctaaatcagaaaagaataatctgtaagtttgtaaaattgcctttggaaaacactaagatcctaactacacattatttacacattatttttaagttttgaaaaatgtatttattttaataaataaatattttgttaaatgtgcttatttttttcttttttaattttatttcaatagtttttgggacacaggtggtttttggttccatggatgggtaacactttagtggtaaattctgagattttagtgcactcatcatccaagtagtgcacaatgtttccagcgtgttgtgttttatccttcactcccctccaaacctccctccaccagtccccacagtccattatatcactctgtatgttttggcatccacatagcttagctcccacttagaagtgagaacgcatggtatttggttttccattccctagtcacttcacttagaataacggcttccagttccatccaagttgccacaaaagacattatttccttctttttatggctgagtagtattccatggtgtatatatataccacattttatttatccactcattggcacttaggttggttccatatccttgcaaatgcaaattgtgctactatacacatgtgtgcatgtgtctttttcatataatgacttcttttccttcgggtagatacccagtagtgggactgacggatctaatgatagatctgcttttagttctttaaggaatctccatactgttttctatagcagttgtgctaagttacagtcccaccagcagcgtaaaagtgttcccttttcaccacattcccaccaacttctattgttttctttttttactttttaattatggccattcttgcaggagtaaagtggtagctcattgtggttttaatttttatttccctgatgattagtgacgttgagcactgtttcacatgtttgttggctgtctgcatatcttcttttgagaaatgtctattcatcccctttgcctactttttgatgggattatttgttttttttcttgcttatttgtttaagttctttgtagattctggatactagccctaatttgcaaatattttctcccactctgtgggttgtctgtttactctgctgattatttcttttgctgtgcagaagctttttggtttaattaggtcccatttatttattttcgtttttgtttaaatgtgcttattttaaaattaaaattaaaattaaaatttattttcaaatttttgtttaaatcgagctttacatcttattcaaagataccagctaatgaattggttgagctcagatttctagtgttaaaacatatttgtgaaatataaagttgtatccctgatcaaataagtatctgtcagttttactaagttataagtagaataaagtgttaatcagcaaattatgattaatcattcttatgatatatccatatatatccaaagtaatatgaactaaataggccattttcatccaggctcattagaacaatttaaatttcatatataatatctaaattagaagagcagttaatatagtgtagtaccaacttagtatttttattgatacataatagttgtatatattttggggatgcatgtaatatttttatatatgcatacaatgtgtaatgactaaatcaggataattggggtatccattacctcaaaggtttatcttttttttgtgttgggaacatcacaattcctctcttctagctattttgaactatacaatattggtaactttagtcagtctactgtactatcaaacactagatcttattccttctaactgtatttttgtattttaatcaaatctcttctcccccccccctttccttcaaagcctcctataaataccaattaactttctacttccatgagatccccttttttttagctcccacatatgagtgagagcatgtgatgtctgtcttcctgtgcctggctcatttcactttacaaaatgatctcatgtccatccatgttgctgcaagtgacaggatttcattcttttttatggttgaataatattctattgtgtatatgtgccacatttactttatctgttcacttgttaataagtaggttgatcccatatcttagctattgggaatagtgctgcaataaactggggaatgcagatatcactttgataccctgatttcctttttttttttggatatgtacccagcaggggcattgtgaaatcatatagtaattctatttttagttttttaaggaacctccatacttgtcgtccattgtcattgtactaatttacattcccatcaatggtgtacctgcattccccttcctctgcatccttgccagtagctattatatttgtcttttcagtaaaaatcgttttaactgaggtgagatgatactgtgattttgatttgcatttccctgatgattagtgaggttaagcattttttcatatgcctgttggtcatttgtaagtcttctttcgagaaatgtctataatcgtttgcccatttttaatgaaattatttggttttttgctattgggttttttagttccttatatgttctggctattaatctgttgctagatagatagtctgcaaatatttttttcccattctgtcagttgttgaagctgggaaaactggataaccatattcagcagaatgaaactagacctctgtgtctcaacaaatacaaaaattcagtgaaaatggattaaatatttacatctaagacctaaaactatgaaactagtaggggaaaacacctcaggacattggtctggacaaataatatttgggtaagacctcaaaaacataggcaacaaatgcaaaaatagacaaatgggattacatcaagcttaaaagcttctacacagtatttctttaaatattatttaggttgagccttatagcttactttaaggtatccacaaaggaacacatcgcctgtgcttggtcaactggcatgaaatattcagtcattgattgatgagcatttgggttggttccacgattttgcagctgtgaattctgctgctataaacatgcgtgttcaagtacatttactaatgtaaccaaatatcacctggaccacaataacttattgaaaaattaatgttaaaaaattcattgggactgtgaaaaaagaaatattaagttacattgctaatcaatatctgtaaaatagcaagcagcaaaataatccctatgtcttaaatgtaaagtagcattttctgatatccagcatttgacaaataacaaatactctaaaatcctaaagcaaatgtggttgacaagaaaatagaaaaaatattttggaaaatggaaatagaaatggaaaaatactttccatttcccaaaaacaaagtaaaacatcaaattaaatttaataatatccaatgtaaatagctgcaatattttgcagctttaagctaatacatgtaagttcagttaaaaacaggaattctagaagtattgacttttgctgctatatttaattcacatccattttctgaaagatataaatacacatctgattaataaaaaatgtatttcggtaagttcagcatatgctctgagcaaaattaaataaattgggaagagtcaaccttcaaatttctttgcctcaacagcaagattccctgtaattaaatcacaaccaaagatgtttatttcataccatcctctcttgcttgttgattgagtccaaagaatttcaaaataaatgcaaatcatcttcatatggatgcagaattaacatctaatgaaactctcaaatttaataaggtccttttgatttcagattttcttgacacttttacttctctttaatgggaataaagttgcagatgtgttcaagatggtcaaaagatttcaggacaatacgtcccattttctaactgaagtttctttacatgttgaattcactctcatagatttctagattacagagtgaataaaggcaaattttaagtagtctgtatccttatccaggaaaaaaagcaagatgactaaagatgtttctagttattcaaagagcaacttcagagaccagattatacaatttttagaggaggtatgcctcttttattagaaaacctaagaaagatcaaatcatacagatagcttattatatggattctagatccaatttgatacgcaatctggattacagataatgagatctagcatgcattaaatactttaaaaggtagaagaatagaaaatatcttatgtgtatataaaacaatatacatatttcagaaatacaataacgatctgctgatatttttcaaaacagcatgcaagtgtcacaatataccaaatatagtttaataacattaaacttaagaagaaaataaggaactatttgttaagtagagaagaaaaattgaattgaaatatgagtatacaggtttaatataacctcacagggaaagataagattattactaaaaataatggatgaaaagaagagaggagaaaagtcagaaagaaggaaaagtaaaggaaaaaggaatgaggggactaaggaaagcagaggagaacaagaaaaaaagggatgagaagaagtgggaggcagggaaggaaggtagagaggaaggcaggtagtcaggccagccaattgcttttcagaggagaattaagggatttgaatttgcagtagaaatacatgtgacaatgaatcctccatattttaaaaagagaaaaagatacaaagaaatagctctctactctatctatggaaataatttataatacttgcagtaaattttgttttattaaccatgattttttcctatcatttgatggtaataattttctaatctgtgattacaaataacccaagaaatcaccagtagagtacattttccattgtgtcctgatctggctaattgaagatgaatatgaaataatgcatttcaggtacaaaatgctgcttcatttgtggattaactagcattgataaacaatggctcccaatgaaaatgtacaaaattggggaaactggtttaattttcagtatgaaggctttagattttatgttgggggtagggggacagtttgtgttcaaagcaaaagaataaactatatgatcccgaaacattactgctggctttatgattctatgaactttagcctaccaattataatgtttatggaaaaaatctagagcagatggatacaacaacagcgacaaacatggaaatgatgtgtttctgtgcagactgctaaggcttgcttgggaagaatacaatataatcattgttagttacctctgctaagtgagaatgcaaataaaagaaataaccttcttctctggctctgagatacagtctatgacattattttctccctcaaatatcttttaagccaatattaaaattagcattccatgtaaacatatgacaaatgattatgggaggcaggccagaaatatataatgtgacagagaagagccagggagagtttaacaacaaaggggagataatgcagagtactggtaaaagcatagacttagaaccagaacacttaagctctagacacaaccccactttaatatctatgtggccattaagtcacttaactaaatgggcattgtttctccatctataaaatgagggagctgaggggtgtcaggtagaaaaagtgatctctaactgtacaagttcatagattatttaaacttgcaaaatcaagaaacatacactctatatgaaattcccaatttcagaactgtagcatcatagtgcataactgagccataaataataccaacacagtgtatcattcaatgttatcattgtaagaaacaatggagaatatcaagccaatctattcaagctattgaactgaggcctacagatgttaagtaaatggttcaaggtcacacaactagcagagatggggagatggggttagaatcttcctgctttttccaatgcctataggatgacactgaaaattaaaaagaaaagataaatgagatctttcagacaaaagcacagacatataattcccacagactatctgtaattaaagggatctttaaaaatagctaatcaaattatctgtttgtgagaatcttaatgattgctattcaatttgcttaaattatctttattttctaaatcaccaaaaaaaaaaaaaattatgccatgggccatagaaaaacatatctcaacagttagaacttcatagactgtcatgtataaatcagcatttactaaatacttcactgaaaatgaaggagggatatgaatgctaatccattttgggacaatattactttaagaagtgcttacctaccaatgccaatctgagaaagaacaagaaaagtagtatgcctcaaatgaaaggtcaggcccaagatatcctgcccattagatgtaatagagtttatcttcccaattagaactaaaaaatatgatagtagcctgaatccataattcagatagccaagaagccatcaggattatattacttgggctgatttgtctttgttcctggtgactcaggtaaaaaaagaataacaacattctcctttaaaatatttagatatctggacatactttccattctataaaggaagagaaaaaattagaagatatggcaaaatatttctaaatgagatgatataagacaatatagaataggaactgaataaaaataaatacaatttgggaattccaattctaaaaatctaaataatgaaacaaagtttataatagtttatgtaactcaaatgattctctaaacaggctgatggcattaaatttatacattttaagagaaaaatgtcagtgatcaataatgacaaaaaaaatgtcttgcattaagagctttatgaccaccaaacctaagattaagtatgaagaagacccttgagtcaccattcacagaataaaagaaatgttaggtgaaaaaacaaaaggtaactaccatttctactttttaaaaaataatttcaacttttattttagattcaggggacacatgtgcaacttttattttagattcaggggatatattgtatgatgctgaggtttgggatacaatttatcccatcaccttgatactgaggatagtacccaatagtttttcaaccctccctaccccctctagtggtctccagtttctatcattgccatctttatgtccacaagtagccagtattaagttcccacttataagtgagaacatgcagtatttgatttgctgttcttccattaattcacttagaataatagcttctagctgcatctgttgttgcaaaggacacaatttcattcttttcatagctgcatagtattccatggtgcatatgtactacattttctttatccaatccaccactgattggcacttcaattgattccatgtctttgctattgtgaatagtgctgcaatgagcatgcaggtgcttgtgtctttttgatagaacaatttactttcttttggatttataccctgtaatgggaatgctgggtagaatggtagttctgttttaagttctttgagaaatctccaaactgctttccacagagactgaactaatttttacattcccaccaacagtgaataagcactctcttcactctataaaagatgccaacatttgtcattttttgactttttaataatagccattctgactggtgtgaaatggtttctctgtggttttgatttgcatttctctgacgattagtgatgttgagcattttttcatacacttgttggccacttgtatatcttcttttaagaagtgtctgttcacgtcttctgagtactttttaatgggattatttggtttttgcttgttgaattctttaaattccttatagattctgaatatttggcctttggtagatgcatagtttatgaatattttctcccattctatagtttgtttattgatagtttctcttgctgtgcagaagtgctttagtttaatgaaattaggtcccacttgtcaattttatctatttatttatttatttttgagacagtcacccaggctggagtgcagtcatgagatctctgctcgctgcaacctctgcctccagggttcaagcgattctcctgcctcagcctcctgagtagctgggattacaggcacatatcatcgtgcccagctaatttttgtaattttagtagagacagggttttgccacattggtcaggctggtctcaaacttctggcctcaagctatccacctgcttcggcctcccaaagtgctgggattacaggcatgagccactgcacctggcctcaatgtttctttctgttgcaattgcttttgaagtctctatcgtgaagtatttgcccagttctatgtccagaatggtgtttccaaggttttcctctaagattcttatagtttgagatcttacatttaaatcttcaatctaccttgagataatttttgtatatggtgaaaggttaaggtccagttccagtcttctgcatatggttatccagctatcctagcactatttattgaagagggagtcctttctccattgcttatttgttatcaattttgttgaataccagatggctataggtgtatggctttatttctgggttctctaacctgtttattggtctatgtgtctgtttttgtaccagtaccatgctgttttagttaatactgtagccttatggaatagtttgaaatctgctatcatgatgcctctggctttgctctttttgcttaggattgctttggctatttgagctctttttttaaattcaaaatgaattttagaatagttttttcctagttctgtgaaaaatgacattagtaatttgataggaatagtacggaatctgtagattgtaactagcacttttaaagcagtaattaccacatctaaaagactaaagtgagggccaggcgtggtagctcacaatcggcactttgggaggccaaggcgggcagatcacgaggtcaggagttgaagaccagcctgatcaacatggtgaaaccccgtctctactaaaaatacaaaaattggccaggcgtggtggtgggcatctgtaatcctagctactcaggaggcagaggcaggagaataacttgaatccaggaggcggaggttgcagtgagccacgattgtgccactgcactccagcctgggcgaaggagtgagactctgtctcaaaaaaaaaaaaaaagtgaaatgaaatgatacagatctgggaaaactaacttggatcattcacacaaagggaaaacagagacgagggggagataaaggaagagggtcattttttttctgtaggggaggacagaacatctgaatcatttggaggactcatcacactttaactctgtcactaaaccattaggatacctagctaaaatactggaaatagagattgttacggctacacactcttgcactctccataacatatactattacattatttgaaacagttttacttattaaaaaaatttagggttggcaaatctaaaactagaaagacaatcatgaatgacaaagataaaacattttagctaaataaggattctgaagtggttcatataagtgaccagggctcagaatagtgggagtcatgctaagtttacactcctagtaaacactcctatgttgggtgaatacaaggagacaccaaaaaaggtaaaggggtgttatcaagtggttttatcccattctctcccccaaagatacacatgactagcatggtcctgtcaatttttccattctcccagtgtgataggttgagtattttagagcatttctttcagcttacactctgcacgcaattatactcagcaacattcctaccaagtctaacttgtcagtgttgtcacctggtccctttccaaattcacctaagcccattggactcacagagacatgagaaaggtatcgtcaagacataattaacttcatcacatgtaactaaatacacacgattccgtccaaataagtggcacttacttatgtccatttaaggctgcgtggtgtaaagcagtgtaacccgaactgtctgtgcagttcacattggggcctcgccagatgctgcaaataaagcacaagcgcagagttaacagtgaagccagatcttgccttgaaaaacaaaaagaaggctggtagccccacagtcagcagcaggttgtagataaaaattttagccatgtggaaaatgattgccatcttctatgaattcccctcagaacatcaacttcatttatttgataaaaggaaactaatagagaatgcaactattaatatcttcagaaattattaacaaatgtgtgtccatggtcgtgcactgaagtttggatccaaaaattccctattactttctatcgttacttaaatattagaagcaactaacattcagctactatattccataccaaagaataaagatttatgagacctgcctcatgcctgttaacacactccttctgaggtgccggtgatttatataagttataagatatttttgcattgtgggaagaatataaagtctttttgctcttcaattgcaaccaggaaaatgtaatcaatatttcatacttgaaaataaaattgaagatttggactgttgtaaaccatgagaagatcctaacaattttgcagtcatcattgattttactatgcaatatattctggagataacatgtaactatataaaagagtctattttttttttgataactacaattaaggaaactctttttaacttttggaaaataaggcactgaaagacacttttccaaaaatagaacaaaaaattgctttatctgatggtcatagtgatatcaaaactatcaaagataaactagttcacacattcacaaaacatttattgtacaccaactgtatgtcacatattgagctaggcactgggagcacaaaatcgtaactcaaggtccttctttacaagaacatagtgtaatggaaaagatagacacacaagctaataattacaaagtggtaagataatcaaggtaccagacagcacacaggcatctctgaaaagagaatgaatagctattccaaacaaggggtcatggcagacttaaactaaggtgggtcaatgaaaatgaatggaatgtgcttatttgacagttaattaaaagaagaattaatgaaacacatggatcaattggaagaaggtgggaaactggaagcagtagtctagagatgactcagactttaggcttacatgactagaaaaaattacaatattaactaagatgtgaaataaaaaaagagcaaaatctgctgcagggaagacaatgcaggatggagagaaaacaatgactcctagtttgcagacgttaaatcttaagtctctgacttacttacattacataggttcaatgcaatccctatcaaaatcccaatggcattctttaggaaattgaaaaaaaattctaaaattcatatgaaaccataaaagaccccaaatagccaaaacaattctgagaaagaaaatcaaagttgtatgccaggctcagtgactcatgcctgtaatcccagcactttgggaggctgaggagggaggttcacttaagctcactagtttgagaccagccttggcaacataacaagactccatgtctgctaaaaataaagaataaaaaaaattagtcaggtgcggtggtgcacacttgtggtcccagctacccaggaggctgaggtagaagggttgcttcagcctgggaggtcgaggctgcagtgaaccataatcatgccactgcactccagcctgggcaacagagcaagaccctgccacccccacaacaaaaaaaagaaagaaagaaaaatggaggcatcacacatccagattccaaattcaggggatatatatacatacaataaaatattattcagccctaaaaaagaattatatctaaacattttctatgacatgaatgacccgggaagacattatgctaagtgaaataagccagacacaaaaagaaaaatattgcctgaaaatatacggaatctgaaaaaaaatcaaatatacagagatagagaacaaaagattggtagggggagtagaacgggggaaataaatatcagaggatacaaagtagcaaatatgtaggatgaacaagtgtagaggtctaaagtacaacatgaagactacaggtaccaaaattgcactgtatacgggatttcagctacgtgagtagattttagctgctcttgccacaaaaacaaaaaataaagggtaactctgtgagaggtggtcatttgtttcactgtagtaaacttttttttactatctatatgtatcccataacatgtgtataccacaaatatacacaataaaatttatttttttaaataccacaatgacatgctactatataactatcagaattgttatctttaaaaaggcttcacaaacctatattgacaaggatgtagatcaaccagaattcacacacacactgctaataggcatgcaaaatagtacaaccacttagtgaaacaatttggcagtttcttaaaaagttatatacaaataccacacataacttaccatcaaatcataccatacaaataacatacaaataccatataatccagtcattccactgtaggtatttagcccagagaaatgaaagcatatgtccataaaaagacttgtacatataatattaataacagctctataggtaatagcctaaaacagagacaacccaaatgtccattagctggtaaacagataaattgtgatatatccatacaatggaaataaaaagaattaaatactcagaaacaaaaggaattaaatactacgacattggttgaaaatctaaatcaattagattttctcaggaagaacagcagaatggctgcccttcaatctccccagcagaaagggagacattctctggcacagataaaatgcatgatctctggactagacccctgattggtagccttcatcaacttctgtgatgtaaatacttcaacttaacgcagtgataggaagagatgctaacaactgcacttcacaagcagacacaagccaatccagcacaccattcaaaggcctacaaccaacaagtcccaacactatgaactcagagcttcccatgagtttttgaaaacctccactctcaaatatgaacaaataaccaaagacatccaatcacttgaggaaagcctttactactaaagaaaccaaaacaaaaaattaggaacaaactacagaaaaaaaagaaacttagagaaaatttagactatgcatggagaagaaattttcaaaaacagttatcattaatatcatctcaatattagaaaagataatgaatgtaagaacaatgaaataaaaaagaaaatcagagataaaatcagtagaagaattaaaaataaagctgataaggccaggcatggtggttctcgcctgtaatcccagcactttgaaaggctgaagtgggcagattacctggtcaacatagtgaaactccatctctaccaaaaatacaaaaattagccaggtgtggtggcgcacgcctgtagtcccagctacttgggagggtgaggcaggagaatcgactgaacccaggaggcggaagttgaagtgagtcaagatcgcaccactgcactgcaacctgggtgacagaatgagactctgtctcaaaaataaaaagtaaaaaataaagctcatgaagtatctcagatacttagaaaaaaaaggcaaagatatagacaaatagaagggaaatcataagaaaagtaggacaccgatttagcagttccaatattgaaaaatagaggttcttaaagtcaaaacacagaaaacaggagaatgaaaacaatgaaagacatcattttaaaaattatcagaactgaaggacattaatttaccaaataaaatgtacatgggccagtcgcggtggctcacgcctgtaatcccagcactttaggagaccaaagtgggtggattacccgagtgaggtcaggagtttgagacaagcctggccgacaaggtgaagccttgtctctactaaaaatacaataattaggccgggcgcggtggctcacacctgtaatctcagcactttgggaggctgagtagggcggatcatgaggtcaggagatcgagaccatcctggctaacatggtgaaaccctgtctctactaaaaatacaaaaaaattagccaggcatggtagcgggtgcctgtagtcccagctactcgggaggctgaggcaggagaatggtgtgaacctgggaggcggagcttgcagtaagccgagatcgcaccactgcactccagactgggcgagagcgagactccgtctcaaaaacaaacaaacaaacaaaaaatacaataattagccaagcgtggtggtgcatgcctgtagtcccaactactcaggaggctgaggcaggagaaatgcttgaacctgggaggcagaggttgcagtgaggcgagatcacgccagtgcactccagcctgggcgacagagtgagattcggtctcaaaaaacaaaaacaaaaacaaaaaaggaccaggatagctttgataaaaaataaaaataaaaaaaagacaaagaaataactgaagtgagtccgatacggtcttttaaatttcaattaaacaaacaaaccaaattcctaaaacacccatccagggctattctcttaatttaaatttttcctctttcaactctagttacactaacaagtcttcactattcaggaaacctagaatgaagagaaattattcatacctattacttctacttcaatctgcaatcttcaattattaatggacactctccaagttctaagtccaagaaaatacaagtccaagaatcaaacaaaataatgaataagatatcatctcttcctccaaagagctgacaatctaatagagaaaaatatatacagataaattacaatataggcagtgaccatagttcctacagcacagaaaacacctaataattgtttgttatcaatcttcttgttcttattaaataaatgctacaatagaaaaatctttaactccctaaattaatacatctgttcaacaaaaatctctatggaatattttacggaaaactcaactaaaagttctaaatttgatttagaagaatttacgggaaaaaaaattgtgaaacaagaagtaataatgggatctacatactaccaattatgaaagcatatcataaaacaataccaaaaaatgttagtctagcaccagaatagagagctcaatgaatataagagaagccctagaaacaaaccagtcatacatataggaataaagctgacatctgaaagaagcaaaaaaaaaaaaaaaggaaaacatcattcaataaatagtcccgagaaatatgttttaattaatgggaaggaaaaaacaatttcaattccctaccccataccatttagcaaaatttaatccacatgatttgttcttgacttctcaaacctcattcctaccctctttttctcacacaccctgttcaaaccacacaggcctccttaaaaatataagtatgcttgcaccttatgactgttgcatttgaaattctctctgcctagaaagttttttcctcaatcatatggctcaatctttctgctcaaatgtcatctcttcggaaactctctccctaattattcagtcaaaaatagcaccctatcatcattctctttcctcttagttatgggacttatcaccatctggcattatattatttatttatatgcttactgtctgtctccccactagaatgaaagctccaccacactatctttgggtcttaaaacagtgactggaatattgtaggtgaccagtaaatatttgttaaatgaaatataaaaatgttgagtacatatatgaaaaatgtcaacctcactggcaatcaaagaaagcaaaaaaaaaaaaaaccaaacccataccattatatatttctttatcaaattgggaaaaaagtcaataatattcagtaatggttagcatgcagagcttataataagctggtggtgaaaatgtaaattggtacaatttttctggaaggcaatttgacattacatgtttaaaagctttcatagtgtgcaaatgtgttacctagaaattctccttaagaggaattattttaagaaattaattaatagtttgtacaaatatttagctataaaaatatttatcacagagtgagggtagtaaaaattatggattttgatatataatgccacttagaatagttattctctctttgctcttgtcagctagatttctaacactgcctgcctccagagcttagtactcatctttctctctagctttcttatatgagacccacagcatcagtgtcttatatggctccagtagcatatggcttgagctcctactgatcagggttttttttttttagcttatgtgaacctccctgggaggagaaagtctaccaacagagtagccagggatcctagagaggacgcaattcttcttagttttatacaatggctcaatatatgtgacagataaacagatatcactattctttaacataaaataaaaatctcacaacaaaatggaaaaacaggatattaacaggcaattcacagaaaaggaaatgtgaatggctaataaatatttgaaaatataattaacctcactgtggctagcaaagagcaaaataaaacagtggctgcctacttttctaccatcagatgggcacaaatttttaaagaaataattgataacaatcaatggaggcaaatatgtgaagaaatagtcactctcacagaatattcattgaagtgtaaattgctacaacattcttggaaagtaacatggcaatacataatcaaatttcaaatatgaatactcttagacccaacaactccacttttcaggattgatatctatgaaataaaaatattcatatgaagactgcagacacaaaaatatacactgtagaattttaatagtataaaagagaaagggtctggaatggtggctcatgcctattatctcagcactttgggtggctgaggcgggcggatcacctgaggtcaggagatcgagaccagcctgtccaacatggtgaaactctgtgtctactaaaaataccaaaaattagccaggggtagcggcgggtgcttgtaatcccagcactttgggaggccggggcaggtggattacttgaggtcaggagttcgaaaccagcctggccaacatggcaaaaaaaacactttactcaaaatacaaaaattagccaggcatggtggtgcatgcctgtaatcccagctactcaggaggctgaggcacaagaatcacttgaacccaggaggcagaggttgcagtgagccgagatcaggccactgtactccagcctggatgacagagagagactccatctttaaaaaaaaaagagagagagagagagagaaagctcataaatgcccagcaaaaaaaaaataaaaaattaattagtccaatagctgagaatggggcaaaaaaggaaaagttaattaggattcattcacactatgaaatgttatgcaactattaaaataaataactttgatctgaatgtattgactttgaaagtcagccaaaacatataaagtgaaaaacgtaaattgcagaatattgtgtgtgtctggagcattccaaatgctttatatgcattagcttatttatagccacacgactataagaaagttactattactattcccattgtatagatgaaaaatatttgcaataacatagaaaaatacatgcaaaaatacattattcattctgtgaatagtctgaatgttgaaattatcatgaatttctttaaggaaaagaaaagacaataaactacaaaggaagaaagataggtttgctccagattacgaagaacctcataatatattgaaaagcttggattttattctgcagcaacttggaactaaatggctttcagaaagataagtatgttcctcacatgatcagtcagtgttttagaataagagctcttgtaacaggtggaaggtaaacagagtgagagtcaggttaattgttttacagaccaggggagaaacaaagcaatttgaacaaatgcagatatagtggtagagagagagagggtgagaaaattcaaattgatatgtctaaaataaaacctatgggagatggtatccatatgaatagaataagaacaagagaatggctgaggtttcaaccatgaacgaaatgcatcaatgatgagatatctccactagaaaaagctgcaagggcagtagtatcttctggcaggagccaagtttcagttaaaactgattagaacactaggttgcttggagtacctcaggcaaaaaatggaaaagaaataggaaaatactgcaaattaactgtcatacattttttaaatttctgcatgttattagaccttacaaatattttgtaagagaagatatttataactaaaataagattcagggcctatagatttcaattacctataccaactcagttccccattatacaaaaattaattataatacacacatttttaataactccattgaatgtcgccttctcctagcaaaatggatatggatacatcttttttaaacaaggaggtttagaatggaaagttagcatatatctaaatatattcaactgcacctattgacagagcctctaggcacatatccacatatccatagaacatccaccgacacatctgaaacaccataaataagccagacccaaaccctccaactaaaaatttaatttaaaaaagaaaccttgatttctaaaaggttctgcttcattccaactttttatattgccttgccccctttactcaggcataatcttcaaatttagaaagagggcctagattaaaaacttgattaacttaagcttgtttcataaaatgcaagagtttctagacacatttaagaaatgtcttgaaaaagtataaaatgcttattacatatttattccaaaaaaagcaatttatagatccttggtcttagtctaatacacacccaaatcccatttcttatgcctacttgtcaatatcttaaattctgtatgtgagaattactgcccaaaatgaatgttctcagacaatatggggttgccaattaccaaaaatttaatttcctttgttatattatttgcactaatgtaacaaatcagattagtagattttagaataaatataaacaaaatagttttctaccaaactttcaaataaccaggacattcattagtcagaatattctattatctaagctttcacatattaaataagattattcttaaaccataagcctgagtttcttaggccaatatccatatgtacagcaaataagatttgaagcacaactactccacaaattgatcattattataccttccatcagtctatggggaaaatctatcagaaataacataaaactgtttcagtttttattgattcctatctgacccctgacacatgagatcacgccgaggcatcagatatggaaattcatacagaatgtgcatttaatgcctcaggcagggtcagagtatgtaggaatggtcttctgacagatcatatcatttcaagcaatgcaaaataaaccttattctcaatctgtgtcttaatagtttacttccatttttggatgaactggacatatgtacatatgctactgattactacaagtgaagttctcatcagtttagtgatggcacaattttattatcatgggctacaagtgtcccacatgggtcaaatgggtctatatcagcactgtcctttagaaatacaaggtgaggactgggcatggtggctcacacctgtaatcgcagcacttttggaggccaagacaggtggatcacttgagcccaggagtttgagatcagcctgggcaacaaggtgaaaccccatctctacaaaaaaaaaaaaaaaaaaacacaaaaagaaaaattagccaggcatggtggcatgcatctgtagtcccagctattcgggaagctgaggtgaggattgcttgagcctaggaggtggaggttgcagtgagctgacactgtgccactgcactccagcctggacaacagagcaagacccagtctcaaaaaataaaaagaaaaaaatatataatgtgagccatatatgtgaatttaaattttctagtagccacattaaaaagatgtgaaattagtttgaatatattttatttaacctagtatatcaaaaacattatttcaacatataatcaatataaaaagtattgagatgtttcacattcttttttgtactgttttcaatattggtgtttattttacacttatagcacatcacaattaggactagccacatttcaaatgcttaatatcctgatgtggacagtggctactatattgcacagcacagggcatttctatataattattccaaggggaaaaaagaaaattaactctaataatatgaaaaagctttctagtataaggaagagtagctaacggatgctggacttaatacctagaagatgggttgatctgtgttacaaaccaccatagcacacgtttacctatgtaacaaaactgcacatcctgcacatgtatcccagaacttaaaatattaataaaagttgatgaaaaataaataataaaaaagtattgtcacattggaacccacatactatcccatatgagtttattgaatgaatatttactgaaatgtgcaaaaccatctaagtaagatagatatacactataaagcttaaaaatgcagagaacaactatgaactggccttctgtgaagaatgagaacaagaatcagcaaactgtagaccatgagccacatccagtccactgtttgtttttgtaaataaagtttcatcgaaacacatacagacacatacacacacacacgcacaaaagctttctaaaaataactgcaaacgttggctttgtagtaaatacatgtctatttgagtcacaaacaatttcttaaagatatcttgcctttggagcaaaaataaataatagatctagtatacagtcatatcctagactgtaatgcacaattttacaaaaagcacatcaggagcatcatagtcaaaatcgtactaactaaacattttctgatgaataatgtgcaccttgaattacttgatgcaattctcaatacatgtatttttaccagcaaatgcgaattgaatgactatgagcaaaagtaactccttgagttataatcacacatataatacaattatgacctctcttcaatatatacagtatgtgccacaagatggaattttagaatatgaaaagaatttgtaaccacaccgagccataaacacagagtcaagagacatgagaggaaaactagagcatctattttaacctagttttaacttcatcacttgttctaaaagtgtaaaacattcctcccagcccatattttctcttctctgcatagatataattcctggaaaataaaccagcagacaaggcagattaatctctcattgtcacacgaacactgattttggtggcaattgtttttcctatcctcacattctcttcataggtaacaataattccagggtactatggtaggaaaaaataatggtacccccaagatgtatacgtcttaatctctggaacgtgtgcatattttgtattacacagcaagggagaattaaggttgcagatagacttacattgctaatcagctggctttatcccggattacccaggtgggccccatgtaattacaagtggagaagagggaaatggaagagtcagaatcaaaaagacggcacagtcaaaaagactcaactggccattgttggctctaaagatggaagagggtcatgaacctagaaacgtaagcagcctctagtagctggaaaaggcaagaaaacagattttcctagagccttcaggaaagaatgcagccctgcccacaccttgattttagcccagtgagaaccacagacctccaggactataggataacagatttgtgttattctaagccactacatttgtggtaacttgctacagcagcaatgggaaactaatacaggtgtgcttattgtaattaacacacccgaaatatgagacgttcagacctttccaaatacttgggaatttaaggtagcatgagaaagagagcatgaacaaaacattgactgcggacttgctacatactagaaactatgcaaaatgctttgtattgattacctaagttaatcttcataacaaccatgtgagacgggggcttttataacccctggatttttaaatgaagaactgaagagcagaaaagtaatttatcaaagatcacacagctagttcacattgcaggcaagatttggaaccaggctgcctgattccagagccaatgacattaaccactacattatacttcagtctcattgtttttatttacctttgattataataaagtggagacatttttacttgtataaatataaggggtccaagtgcagttttgttacagggatacattgcatagtggtgaattctgggcttttagtgtaatcatcacccaaataattacattgtaccttttaagtaacttttaatccctcaccgcccaaccccaaccctcccacctttcctagcctccaatgtctatcattccatcctctatgtccatgtgtacatattatttagctcccatttataagtgagaacatgtggtatttgactttctaagttctttcacttaagataatggcctccagctccatccaagttgccaaagacattatttcattctcttttacagctgtatagtatcccattgtgtatgtgcatatcacattttcttcatccaatcatctgttgatggacacttagattgattccatatctttgctattgtcaatagtgcaataaacatacaagtgcaagtatctttttgctacaattatttattttcatttggatagatacccagtcgtgggattcctggattaaatggtaattctttgagatatttccatgaagttttccaaagaggttatactaacttatattcccaccaatggtgtataagcattcctagaccttttatgtttcatgaccaatttcattttttctatgagtagcttgtttatattctttgcccagtttttgtattgagtttttcattatttttactgattttcatcattcttactgatttgaagaagccattttatatttatagatattaaccctttctaatgttgaaaatatttcccttatttcatctttcagccgaacttatggtgtactttgcctggccataatgtttactaaatcattctatctttctttaaatttattgtttctagccttggtaccattgaaagaaaggtcttcctgattacaagatgataacaatattctctagtatttcttcctatttctttttttgatgaaattttttaatttctctctattatgggtatatgatatgaggtatttcccaatggaataaactaattcaataccactttaaaataattaattgccatctaattaccccagtgaaatgcttcctttctcatatattatttttctgtacctgtatttcaaatctgtattttgactgttttgttacattcatctatcttctccaaagactaatattacattatttaatttctatagctttatagcatattttaatagctaaaaatagatctcttctgatatatatattcttaactgtttttatcatgggtttattcatctgtataatagatggtatagtcagaccaggcacagtagcatgtgcctatagtcccagttcctcagggggctgaggcaggaggatcacttgagcgtaggagtttcagtccagcctgggcaatacagcaatacctcatctttaaaataaaaaataataagtatagtcaaattgtcaaatttaaaaaaaagttttggctgtaattgcattaaacttatagaaaaagtaggaagaaatgagatctttgcaattctgtatttttccagctgaatctgatttccatctctacagctttggtaacagtcttaggcaaggtacttcacttcattagacctgagtttccccataggtaaaacccaaggataatcacagtaataacctcactgtattgtgagaagattaaagaaaaaatataagtattaaatatactacgcaatccacagaaggtacttattaaatgttatttaattggtctaacctttttatattttctttatagaactcttaaaaatattttaaaattattttctttaacatacttacatagtgaatactatgtgccagatatcattctaaatgttttctaaatattaactcaataaatcctcatagcaacgctatcaaatgagtactataattactacacttttcagattaaataactaaggtacagagtagtgaagtaccttggttcaggtcacatggcccctaccaggtgaagcagggattcaaaccacagcatgcctttaatcattatctattgccttgttattttaattcctaagtaatttagttctttattactattccacatgaagtcttatttttcatgtcttttaattactgctgctagttagaacactgtgtttttcaaattcattcactcattcaaaaaatagctattgagtatccactatatacaggcactgttctcattgttctagtcactgacaacacagcagttggagaaggctgtacagaaaaaagacaaaaattcctgccctcatggtctttacattctgatttagttagacaaacaatatacaaatgaatatataaatatatgaagcaagaagtggtatcaagaaaggcaagaggaacagagtgctgttttatgcagcatagtcgaggaagcctctgggataatagggcaactttggaagaacattttaggaagaaatgggcttaatgctgaggaacagccaggacagcagtgtggctggaatagggtaagcaaggaagagagcacagaaaagtgggtcagagatgtgtggctggatcatatagagccttgtggccattctgactttggccttgactgatatggaaagccatcggagagttttgaatggagaaatgacatgatctgacttgtattctgctgctctgctaagaatagtctgaaggggaaagggtagaagcaaggagatcagttaggaaattactatagtaatgcaggaaaagatgatgacggcttagagcaaaggggtagcatcatgtagagggaaaaaatgcttggattatgcatttaaaggtaaaggaaacagaatttgctgacaaattgtgacgtgcaaagaaaagaaacaggaaggactgcgagatttctgtcatgagcaactagaaaattggaattgccatttattaatttggataagtttgcagaagaggttctctattatttttaggtataataatcatgtatctcttcctttataatattcattccattttttctccttacacaaactgcattggctagaaccactaaaataataagaagataatctttgtcttgttgatgaatttaacggcatgcctggtagggcaccaccatttagtatgatgcttgctactggattctcatggataccttttcagcatattaaggaaacttttattccctcagtaaagaacaaaaaggtggaatagcataatggataaaagcacggactcaggattcaaactgtctggactaaaatgctgatcccctccctaactgcaccaccttgggaaaattacctaactactccgtgcctcagttctctcatctataaaatgaatataccagtaatagctagctcatagggttactgtaaagattaaattagatgtaaagtgctagcacaatgcctgacacataataatcatcctttctgtaggaaaagtttttatctagaatggctcttgtggtttgttaaatttatttaggatatctttcacgatggtcatacagcttttcccttttaatacattaacatatttaatgtcggatgagaagcatctctacactactggaagtaaatttatctacttatggtgtatttttttaatataatcctgaatttgatttgctctttgtaacaggattttgcattcacattcacatgtaaattgtctctggttttcttgtcttttttatttcagttttggaagcaggttacataaactgaagagtttggggccttttttctagtttccagaataattcaaccaacatagaaattgattatgttaattgaatatttgaaagagcaaatgtaaaatcatctaggattggcacttttgtggagtaaacccttaataaaattccagtgtcttctatggttactgacttactaatatagtcgactttttcttacattaattctgtcatttacatttctctaggaaataagttctttccatttaggctttctaatttattgactagaaatcatacatatttttaaatcggttgttattgtccatatttacagttctatcaccattgtaattcccagtgttctgtattatttttctctccttggttagtctaggtggggctagtttatcagcatattcagagatttagttagctttatttttatcaaatgtctattggatatgttatttattcattgtttatttactttttaattaactactctctgttcttaactataagaattcagttacctatttcacatttgagttgaatgcttcactcatttaattttattctttcttattcaaaggtaaaagcattataggctgtgacatttctacggaggttttgcccacatgacttaggttttgacgagttatttttcatttcaattattatatacacagcctgtaattcagtttttgtgtcctttttactctgaaaattatagttgttttttaaatttatcaatgcttagaatcattatatgtcttgctctatttctagtgttaccacattatagtcagaaaagaattcttcaacttctaataatttatttagaatttttttgaaaactagtatgtagtttttgttatgttacatgtgacaaaagttctttgattaaccaaattttagctggcctcctaaaacttctcctaggcccatctgtgtacttccttgtaaaatagcaagagctctgctcagtcagtttagcaagaacctccacccttgagatcttatcagattcctcatcctccaccatccctcaggtgatacctggtcaccatggcctgtcttcagctagacttttcgaagttggtttagccaaaaaccctcttacccatgtttcctcttggtaattttccatccactgacccctgccctgttccccggctatgaatttccacttgcccatgctatatttggcactgaccccaatctctctcccccactgcaaaatcccattgcagtggtccctatacctgtgatagtcctgaatattgtcttccttaccttgctttaacaagcatcattgaataatttttgttaatgcatgagcattgaaaagtatattctattttttagggagagatgtgtacttttcaagcttattaattgcataattcaaaccatcaataactatttagttcgtctacttcattcgcaaatttttggaaatgttaccatacacagtatatcactgtgattgaattattaccaaattttctttgtatttctaagtttgcttcatgtgttttgttgctgtagtttcttcagtttgtttgtttgtattaaggcttttttccaacttttaggttcaagggtagatatgcataacgtgcaggcttgttacacagggaaatgtgttcctacatcatttctgtcatttatgtttttctaggagataagttatttccatttaggttttctaatttgttgactagaaatcacacatatttttaaatctgttgttatcttctatatttacagctctattaccattgtaattcctaatgttctgtattatttttctctccttggttagcctaggtggggctagctgcacagatcatcccatcacctggctattaagcccagcatccattagctattcttcttgatgctctccctcctctcacccccaaccctccaacaggccctgtatgtgctgtccactccgtgtgtccatgggttctcatcatttgcctcccacttataagtgagaacatgtggtatttgattttctattcctgcattagtttgctgaggataatggcttccagatccatccatgtccctgcaaaggacatgatttttttcctttttatggctgcatagtattccacagtgtatatgtaccatattttctttatctagtctatcattgatgggcatttaggttgattccatgtctttgttttgtgaatgatgctgcaatgaacatacatgtgcatgtatctttataacagaataatatatattcctttaggtatatacccagtaataggattgctgggttgaatggtatttctgtctctaggtctttgagaaatcgccacactgtcttccacaatgttgaactaatttacacccccaccagcagtgtaaaagcattcctttttctccacaacctcgcatctgttgttttttaactttttaataacagtcattcttactggtgtgagatggtatctcatgtcgtttagatttgcatttctctaatgataggtgatgttgagctttttaaaagtttcttggccacatgtatgtcttattttgaaaagtgtctgttcatgtcctttgcccacttcttaatggggttgtttttttcttgtaaatttgttttaagttccttttagatgctggatattaggtgtttgtcagagagtagattgcaagaattttctcccattttgaaggttgtctgttcactctgatgatagtttcttttgctgtgcagaagctgtttaactcgatcctatttgtcaatttttgcttttgtggctattgcttttggaattttcatcatgaagtctttgtccatgcctatgtcctgaatgatattgcctaggttttcttccagggtttttctagttttaggctctacatttaagtctttaatatatcttgagttgatttttgtataaagtataaggaaggggtccagtttcaattttctgcatatagctagccagttctcccagcaccatttattaaatagggaatccttcccccattgcttttgtcaagtctgtcaaagaccagatggttgtaggtgtatgatgttatttctgggttctctattctgttccattggcctgtgtgtctgttttggtaccagtaccatgctgttttggttactatagtcttatagtacagtttgatgtcaggtagcatgatgcctccagctttgttctttttgcttaggattctctttgctatttgggctcttttttggttccttgtgaattttaaaatagttttttctaattctatgaagaatgtcaatggtagtttaataggaatggcattgaatctataaactgctttgggcagtatggccattttcatattaattcttcctttccatgagcatgaaatgtttttccatttgtttgtgtcatctctggtttctttgagcaggggtttgtagttctttttaaagaggtccttcacttcccttgttagctgtattcctaggtattttattctttttgtggcaattgtgaatgtgagttcattcataatttggctctcggcttgcctcttattgctgtataggaatgctaactatttttgcacaatgattttgcatcctgagactgctgaagttacttatcagcttaagaagcttttgggctgagatgtggggttttctacatataggatcacgttatctgcaaacaaagatagattgacttcctctcttcctatttgaatacctttatttctttcttttgccggattgccctggccagaacttccaatacttgaataggagtggtgagagagagcatctttgtcttgtgctggtttccaaggggaattcttccagcttttgctcactcagtataatattggctgtgggtttgtcttatatggctcttattattttgaggtatgttctttcaatacctagtttactgagagtttgtaatatgaagggatgctgaattttagcaaaggccttttctacatctattgagataatcatgtggtttctttacttctgattatgtaatgacttagtttattgatgtgtttatgttgaaccagccttgcatcccagggatgaagctgagttgatcgtggtagataagctttttgatgtgctgctggattcagttttctggtaatttgttgagaatttttgcagtgatgctcatcaaggatattggcctgaagttttctttttttgttgtatctctgccaggttttggtatcacaatgttgctggcctcatagaacgaggtagggaggagtacttccttttcgatttttttggaatagtttcaataggaataacaccaactcttctttgtatctctggtagaattcagatgtgaaactgtgtggtcctgggttttggttggtggctatttattactgcctcaatttcagaacaatattggtctctttaagtttttcagttaagcaaaagaatggcacatcatctttatgaattaaatgttttattattattttaaaaaattgactttgttccatatattgctctttaccttgaattatgccttgttattaatattactacatctgctctccttttgtttaacttaactagtagagttttgcctatccatttattttccttctatttctgtcattttatcttggctttatctcttgaaaatggcctatagctacagtttgcttttttgttttataatctgagcagctttgccttttaattcactaacatttgttattattcctgctgctaaattgtatgtaatgtttttattctcctttcctattcttttccctcctcttctctcttctctgttttcttgatcaagcgttcttcatttctttattcctttctagctatttttccttaacattttattcctaatagtcctttactttttgcaaatatattaaacctacatttcttactgacatcaataattacattgtaactatgtccatctttaacaaaacataacttgcatcttttcccacttttaacccaaggatttttgataaaacaaggtagaattttaatgctatagtgttactatttcctcttttatttcagaaatactttaataattatgttgtatttgacaaccatgttttcaatagcgacttaggtttactaatttcattgctcaccatagtttcttgaatatttaaaaagattatatgagatactgtgatattttgctgccttcaggttaccaaaaggcacagaatttacaaacatagtgccatgaccactaaagtcctatatactggaatatgattcatccaccccagagttgcaagcagtctttaggagatataaagatatgagaaatcttttgagagatatgaaaaaaggattagaactatgatgtggtcacattttgcggaatgcagtctttgtgtagacaggttatctgttctcctcccctcccataggtgtagaagaaaaaaacactcaactgggtttccttcccaaagttcacagaaagaagaaccaagaaaaacttgaagtgtgttgctgggcctcagaaagcaacaccctaaattatgatgttttggcacgctaagtactttgaactgaaggacagtggcagggcctcagaagcaaggtctctctcttttttctttcttttttttttttctttgagacagggtctcatcatgtcacccagtacacagtgcaatggcaatcatggctcactgcattctcaaactcctaggttcaaatgatcctcccacctcatcctcctgagtagctgggacaacaggtgcatgccaccatacttggttggaaatccttctgtccttctgagcttctttctcctgctcccctttcttccccaaggcaggccataaaaaatagaattcctcttccccaaggcaagtcatataaactagaaatattactctaaccttctccgacctttctgtgtacaacctggccatcaagaaattctctaacctactgtctgatagtaggtcataagaccctcattctagaaggagtcctgccctacacccagaaggaacaaatgcctcacagagaggtcaagaagaacctcaactgacaggccttgctgggtttccccactcagtctattaccattaagtcattccctttttgtctaatcacattcctatgtggccgtccattctcatcaaacctaaaaataaaaatgaacagttttcccttgggtctttacttctgaatgctcctgtgacatataaaactttgattaaataaatctgttattcttttttcttgttaacctatctttagttgtaggagtgttgaccctgacccttaagatgggttaggaaaggtatcacacccttctgcccctacagttgctgcatgaaggaataaccgacaaattcagtccatggttgaactttccctttgcttgacctaccccaaagcttaaggcagagtgggagtagaggaagagggacagggaaacattagactgaaatgacaaattgttcctggtgaaaaagaacagtttctagaatgtatggaacatgggtcctgcccagacccagggaagcctgaattggggcagcaaatggtgaatgagactgagagccacagtctggccatcaatcagtgcagcaggaggtaaacaagcaggagaggaagagagcctgaggctgactgcatggtgtgatagcatctatttgtgggaggctattgacaaacctgctttggagtaatgctgaagagaaaagggtcaaaaatactgtgggcagtcacagtgtatgaggcatcagttttcagtttcctccttgtccctcctccctgcaaagtggaagaatgggggccagggacagagggaacaggaaggggaggaaatagagagaaagaacagaccatgtattccctaccattctctaccataccaagttgcttttgcaaagagaaaaagcattaaatgaaatatgagatgaagttttcaagtggacaggaccaacaaagctggaagacttaaagtaccatatatcacgataatgtaaaagaacaactggcacagggatacataaatagatctatggaactgaatagaacccagaaacagaccctaatctatatagtcccttgatttatgacaaggatgacatggaagtgaggcacttcttattaaatgacgctgagtcaatttcatatctatatacaagaaatgaatctcaacccataccctgagccatatataaaaataaattctagacagattacaagcctaaatattaaagggcaaaacaataaaatttctagaagaaaaaaatttaaaggcacacagcccaataaaaaatgagcaacgtcaatggtggattgcatttaaaaaaaaaatgtggtacaatacaccatggaatactacacagccataaaaagaacaaaatcatgtcctttgcaacaatttggatgcagctggaagccactatcataagcaaactaacacagaaacagaaaaccaaataacacatgttctcacttgtaagtggagctaaacactgggtatacatgcacataaagatgggaataatagatactgggaaataaagagggggaaaggatgaagtgagacaagggttgacaaactacctattaggtgctatgctcactacctggatgatggattcattcatatcccaaacctcagaatcatgcaatatatctgcatatgtattccctgaatctaaaataacagttgaaaaaaacaaataagcaaatatttggacagatatttcaaaaagaatattcaaataccaaatatatatatgtgtgtgtgtatacatatatgtatatacacatatacacatagttgttcaacttccttagttgtcaggaaaaatgcaaattactatcacagtgagacaccactacatatccaccagaatgactgaaatcaaagacagatgaaaccaaatgttgctggggatatgaattctcataccctgctagtaaaatataaattggtgcaaacactggaaagttacttagtagtacttattaaaccttcaaatttgcatactctgtgaccagcaattcagaaattcttacctatgttcactaaaaaacatgtacaagcatgtacagcactgttcataatagtgcaaaactgtccatcaatagtagaaagaataaactgtagtacattcacaaagaatactacacagcaatgaaaagcaacaaaactattattactctccacacaaaaatgtgtcttacaaacataaaattgaacaaaagaagtcatatagaaaataacacatactgaatgattccatctgaacaagttgaaaaacgaaaacaggacagtaattacccttctgggggatagtaactagaacagggcacaactggggtttctgagatgctagcaatattctatttcttaatttggattctggatacatagatgtaatgacttcgtgaaaatacattgtgctgtaaacttatgatttacatacctctctgtgggtttatttaaacaaaatgacaaaaactaagtcttaatagctggaatgtgactgttttaataacagaaagtgaaaaattatagaattggatttagatgtcattagggagcatgttattcagcaggaatggagatttcattagataacagtggtaacagaaattggaaaaatacaattgttttatgtttattccttatgatctaagaattttcagtcatttcagttatattaatctttccttttcttgaaattgatgtgattcaaaacatgttatcccaaaatatggtatcttcgcatttgagaaaacagcagaagcaagaaagtctctctctctctctctctctctctctctctctctctcacctactctcccctttcttccctgaagcaggccacaaagcctagctgaccttatttattatttagttattagttatttatttttataaactcttttctcttaaatttaatctcttagtaacttgaaacttccatcctcttgctatagccttcattttatacatacagcttcaaagtaacccaaattctctatcttctaaaccaatttccaatgcacaaaacacatcaataattctaggtttctacaaatatatgatagctatttttgtcttccatttttatccctacaaactagttagatgcattttataatcccaagcagaaataccccaattatgttaagtgactcaagggatagagttaattttgtatgaaaagattaaatttgcttgattgctcttttttagtgaagactatgttaatgtcaagtttaagagtgatagtattttgcttttgacaaagacataagggaaaattcttctcagctagttcagtatactctaaatcagccacaaatataaatcctaactcaagtttctcacaactagaagaaatcagaagaatatgataaaaatcaaagaattcatatcatgaaaatgaaaggtacaagagaaattcaataacatgctcttcctattttttgtttgacttaccataaaaatctgcactaatgggggacatctatgttttcaattctaagcataagttttagatctccataacatgaaaatgaccacagattctgaatgagtagctgctctccaccaccatatttccaagctctagaaactcagtgctagagctaaactgagttgttgctattgttttatttagaccacttgaaaccctgaaaatcatcaaaatgcagaaaatcactatgttggttaggtttcctgtggcaggaatatttaaaacaatttaagaaaactcctaaccagaacatgttcagagaattattaacatttttattcagaagtttagatgccattttctgcctcatactccctcattccctccagttcaactcttcctaattaagttttctggccttgccctacccccacctgatcatcatgataaaactaggacataagtattaatacttattaaagcattacaagtattaatatgtctactgttccatttcatggatctactcctactaatgaaggaggagatactaaaaatctaaataagaaattgcttttaaccttgaaaatttagaacattacattatgatatccttgaggttatttgaggaaaaatattatttagtaaactggaaggagtgaaattttttttctaaaggtgtcacaaagaagcaagtaatattggtaataacaattttaataatgtactatctcttataatgaaagatgatgttggtaacccagacaagctaatgggcatatgtttcacactggggtaatacttcactaccagtcacaggaacaaaaagccttttgcaaaactatgtgacaaaattaactatgcagtatgtatcaaagaatactgtggtggttttcaaactatgctattcagaacccttcagagatttagggtaaagcagagtcacattttgaggtgttctgcttcattcggattgatatcttcattcatttatgcatacaataaatacttattaagctatctattacatgcatgcctgtggttgactagcactttctggtatcacacctgtaatatgatagaaacagtccctgctctcagaaagctcagtctagctaaaaataaacacatcaagcaaataatggtagaagtaattaattaatggtcaaaggtacaaacacaatagaaacatgtatagagtgctataaaagaagtctttggtaagtttccttcaccttacgggttttctcataagattttagctgaataaagggtacatgcttccaagtgaccaaaataatgtaagctaacctgacacttatggtattaattaccaaatctaagctctgatgccctattttattgtgtcactttgattcaaaagaaccatacattcaaacgttaaggtatcttaagaatctctgtataccagatactatgttagaagctttagggctataaatatgcattcacttaagaaaatatttcaaaatattggattgaatatttactatgctaggcactggggattaacatttccatgtaataattagtttccagcatttctcagaaaatgtatgtttttccaaatcccaagaaaaatcagtcaagaaatagagaaaaacaggagaaaaaatggcggataggaggtaggactaacttgcagctcccactcggatgtacagagcagcatgtggagactcacactgtgaacttttgctccaagaactaccataggaacatatcaggaaagccaagagaatgcacagaccctttgaagaaggtggattggcaccgcaggctgtgtgggacagcagaggaactgtaagtctactcgctttctcagctgggaggcttgtagcctgaggcaagttctccactctgctcaacggctgcctgaaaataaactcggttctattgggagggcacagtgtgagtgagactggcctttcaggctgtgagttgcgggggagctgggtgaggcctgtggctgccagctttcctccacttccctggcaacctgtgtgagcagcagaggcagccataatccccctgggaacataactccattggcctgggaaccaaactcctttcccccatagcagccacagcaagccacgcacaaggagtctgagctcatacacgcctatatctgccccaacctggtggtgtttctctacccacactggtagctaaaaaaaaggacaatctcttaggagcgctatggccccacccactcccagaccctagggcaagcttgtatcctacctatactactggagctgatgcgctcttgaaagtgccacctcctggtttttggagggcaaccaacacaaaaccagggcacttaaaaatacaaccaaggacccccatagagtccgctttgctcccctgctacacccacaagagcaggtgctggtattcacagctgagagacttgaaaacagatcacatcacaggactcttcgtagacactccccagtaccagcccagagcctggtagctctgctaggagactagattcagaagagaaataaccctcactgcagtttggctctcaggaatccccatcactaggggaagggggagagcaccacatcaagggagcaccctgtggtacaaaaaaatctgaacagcagccccttagtgtcccagatcctccctctgacgtagcttacccagaaaaacaatcctggtaatatggcaaaacaaagttctttaacacccccaaaagttcacactagctcaccagcaatggatccaaaccaagaagaaatctctgaattgtcagaaaaagaattcagaaggtcaattattaaggtaattaaggaggcaccagagaaaggtgatgtccaactaaaagaaataaaaaaaagatacaggatatgaatggaaaaatctccaatgaaataaatagcataaataaaaaacagtcaaaaacttctgaaaatgaaggacacgcttagagaaatgcaaaatgcaccggaaagaatcagcaacagaattgaacaagtagaaaaaaaaaacttcagagctcaaagacaagttttttgtttgtttgttttgttttgttttgttttgagacggagtctcgctctgtcgcccaggatggtgtgcagtggtgcgatctcggctcatgtgcaagctccgcctcctgggttcacgccattctcctgcctcagcctcccgagtagctgggactacaggtgcccaccaccgcgcccagctaatttttttgtatctttagtagagacggggtttcactgtgttagccaggatggcctcgatctcctgacctcatgatccacccatctcggcctcccaaagtgctgggattacaggtgggagccaccactcccggccaagacaaggtttttgaattaacccaatccaacaaagacagagagaaaagaatttttaaaaaggaacaaagcctccaataattttgggattatgttaaccaaacctacgaataattggtgttcccaaggaagaagagaaatctaaaagtttggaaaacatattagatagaaaaattgagaaaaatttccccagcctttctagagatctagacatctaaatacaggaagctcaaagaacacctgggaaattcatcgcaaaaagatcatcacgtaggtacacagtcctcagtttatctaaagtcaagacaaagaaaagaatcttaagagctgtgaggcaaaagcatcaggtaatctataaaggaaaacctatcagattaacatagatttctcagcagaaaccctataagctagaagagactggggttctatctttagcctccttaatcaaaacaattaacagccaagaattttgcatccagcaaaagtaagcttcataaatgaaggaaagatacagtctctttcagaaaaacaaacactgagagaattcaccactaccaagccagcactaaaagaagtgctaaaaggagctctaaatcttgaaacaaatcctctaaatacaccaaaatagaatctccttaaagcataaatctcacagaacctataaaacaataatacaattgaaaaaaaaacccaggtattcaggcaacaaatagcatgatgaataaaatagtacctcacatctcgatactaacattgaatgtaagtggcctaaatgttccacttaaaagatacagaattgcagaatggataagaattcaacaataaagtatctgctgtcttcaagagactcacctgacacataaggactcacataaacttaaggtgaaggggtagaaaaagatattccatgccaatggacaccaaaagtgaacaggagtaactaatatatattcttatattcaatatatattcttatattgcaacagcagtttaaaaacacaaaaagggacattatatattgataaaagaactagtccaacaggaaaacatcacaatcctaaatatatatgcacctaacactggagatcccaaatttatgaaaccattactactagacctaagaaatgagatagacagcaagtcaataacagtgggaaacttcaacactccactgacagcactagacaaaccattaagacaaaaagtcaacaaataaacaatggccttaaactataccctaaaacaaacggacttaacagatatttacagaacattctatgcaacaactgcaaaatatacattctattcatcagcacatggaacattctccaagataggccatatgatagaccacaaaacaagtctcaacaaatttaagaaaactgaaattatagcaagtactctctcaaaccacagtgaaataaaatggaaaatcaactccaaaaggaaccctcaaaaccatggaaatacatggaaattaaataacctgctcctgaatgatcattgtgtcaacaatgaaatcaagatggaaatttaacagttctttgaactgaatgataacagtgacacaacctatcaaaacctctgggatacagcaaaggcagtgctaagaggaaagttcatagcattaaatacctacatcaaaaagtctaaaggagcacaaatagacaatctaaggtcataccttaaggagctagagaaacaagaagcaaccaaaccaaacccagcagaagaaaggaaataaccaaggtcagagcagaactaaatgaaatggaaacaaaacaaaataaaaaatacaaaagataaatgagacaaaaagctggttctttgaaaagataaataaaattaatagaccattagcaagattaatcaagaagagagaagatccaaataagctaagttagaaatgaaatgggagatattacaactgataccacagaaatacaaaagatcatccaaggctactatgaacacctttatgcacataacatagaaaacctagtggacatggataaattcctggaaatatacagccctcctacattaaaccaagaagtagaaactctgaagagaccaataacaagcagtgagattgaaatgctaatttaaaagttaccaaaaaaaaagtccaggaccaatcagacatttaaagaattggtaccaatactactgacattattccaaaagagagaaaaagagggaatcctccataaatcattctatgaagccactatcaccctaacaccaaaaccagaaaaggaagtaacaaaaaaagaaaactacagaccaataaccctgatgaacacggacacaaaaatctgtaacaaaatactagcaaaccaaatccaaaagcatatcaaaaagataatccaccacaatcaagtgggtttcatacgagggatgcggggacggtttaacatatacaagtaaagaaatgtgacacaacacataaacagaattaaaaacaaaaatcacatgatcatctcaatagacacagaaaaagcatttgacaaattccaacatcactttatgactgaaaccctcaacaaaattggcgtaaaagggacataccttaaagtaatgaaagccatctattacaaacccacagccaacattatactgaacaggaaaatgttgaaagcattactgctaagaactggaacatgacaaggatgcccactctcaacacttctattcaacatagtattggaagtcctagccagagcaatcaaacaagagaaagaaataaaggggatccaaattggtaaagaggaagtcaaactgtcactgtttgctgaagacatgattgtatacctagaaaaccttaagactaatctagaaagctcctagaactggtaaatgaattcagcaaagtttctggatacaaaattaatgtacacaaatcagtagccctgctatacatcaacagtttccaagctgagaatcaaatcaagaactcaagcccttttacaatagctgcaaaaaaaataaaataaaatatttaggaatatatctaaccaaggaggtgaaagacttctacaaggaaaactacaaaacactgctgaaagaaatcatagacaacacaaacaaatggaaacatatcccatggtcatggatgggtagaatcaatattgtgaaaatgaccatacggccaatagcaatctacaaattcagtacaattcccatcaaaataccaccatcattcttcacagaactaaaagaaaatcctaaaattaacgtggaaccaaaaaagagcccacataaccaaagcaggactaagcaaaaagaacatacctggaggcatcacattacccaacctcaaactatactaaaaggcaatagtcaccaaaacaacatagtactggtataaaaataggtatataagccaatggaacagaatagagaacccagaaatacacccaaatacttacagccaactgatcttcaacaaatcaaaccaaaacataaataggagaaaagacaccttattcaacaaatggtgccgggataattgactagccacatgtaggagaatgaaactggatccttgtctctcaccttacacaaaaataagctcaagatggatcaaagacttatatctaacatctgaaaccataaaaattctagaagacacattggaaaaacccttctagacatcagcttaggcaaagctttcatgaccaagaacccaaaagcaaacacaacaaaacaaagacaaatagatgggacttaattaaaccaaaaagcttctgcacagcaaaaaagataatcatcagagaaaagtgacaacccacagagtgggagacaatcttcacaatctatacatccaacaaaggaccaatatccaaaatttacaaggaactcaagcaaatcagcaagaaaaaaacaaataatcccatcaaaaagtgggctaaggacataaacagacaattctcaaaagaagatatacaaatggccaacaaacatacaaaaaaatgctcaacatcactaatgaccagagaaatgcaaatcaataccaccttactcctgcaagaatggccataatcaaaaaatcaaaaaaataatagatggtggtgtggatgtggtaaaaatggaacacttttacactgttggtgggaatgtaaactagtacaagcactatggaaaacagtatggagattccttgaagaactaaaagtagctccaccatttgatccaggagtccaactcctgggtatctacccagagaaaaagaagtcattatacgaaaaagatacttgcacactgatgtttatagcagcacaatttgcagttgcaaaaatatagaattagctcaaatgcccatcagtcaacaagtggataaagaaaatgtggtaaatatatataccacggaatactactcagcaataaaagggaacaaaataatggcattcacagcaacctgaatggagttggagaccattattttaagtgaagtaactcaggaatgaaaaaccagacactatatgttctcattcataagtgggagctaagctatgaggaaacaaaggcctaagaatgatacaatggactttgggaactcggggaaagagggggcgggtgagggatataagactacacactgggtacagcgtacactcctccagtggtgggtgcgccaaaatctcagaaatctccactgaagaacttattcatgcacataaataaataaataataaaagaaatagggaaaaccagaaccagtaaaagtactataattctcttgtgaggattgaagcttaataacatggagacattactggttcaaaggaatatactgatgtaaagttgaaagcaagagcagataatattgacacatggagtagaacactgaagttccagtaaccaaggaaggtgaacataggagagaagttgtcacatttaatcagttagtcttattgtggctgttgcagagttatatgtgagtattcatggcattgcatgctgctaacagtgaagaactcttgcaagtaaaataaacattaacaagtttacacgcataatatactttatgcaaatccactgagtggtgttccaagaaatgacaagttttggaagcaaagtaagcccttacattgacaagtttgacatataattctttgaggtactgttagctttgctaggagatctgaatgttatgtaattcaaatactacccaatcacttttgactggtgttttctagtgtctgaatattcactacaggctacagttctctataactattattaaacttcatatttctcatatattaaacaaaatgttagatatttaaaataatgagcaaagcatataaaaactgttgaaagttttttgttttgtttttgtttttttttttgagacagagtcttgctctgtcacccaggctggagtgcagtggcacaatctcggctcactgcaacctctgcctcccaggttcaagcgattctcctgcctcagcctcctgagtagctgggattagaggtacctgccaccacgcctggctaatttttatatgttttagtagatacagggtttcatcatgttggccaggctggtcttgaactcctgacctcagatgaactgcctaccttggcctcccaaagtgctgggattacaggcatgggccaccgcgcccggccgaaagtatttttaaaacaacttacaatttcaggaattcccagaaattctcaagaattactacttctcatttctgaatcccaaagattaatatttattgggaattgggaaatactacttgagataaaagttgactaagagaacttccctgcctctttgaagtttaggagagagatgaaaacatggaaaccaaaaaaagtattaaaggtgttaagataaaattctatttaggacacagtgaagacacaaaggcaaaagacacagagcaattatgcccacagaggtctggagaaggctttacagcaaagaacatgagatcttgagtggtgtcctaaaaggcaaaaactaccttctagataaaataaagggagatatgagactgctaacaggccatacagagggaagactgctgaggctggggtcatgaaacatcatgggttgttcagcaaacatttagtagtttagggaggaaggtggagtttgatgggagacaggaagaacagaaagggatttaattcagggaagatcttctaatgaaaggaaaagtctcccaagaatcttaagtagttgactgacatgatcagatttatattttttagaaagatccctctggaggacacatggaggatgggttcaaagtgtgtgagactagagattagtactgcaacagttaggtgcatccctaaacaatacaactccatacattgttaaagacccacacatacccaacacactgcagggtagaaacctgtaagaggaattgggaatgaaagtgaatactaagtctaatgggtaaaataacaagattttaaaacagagagtaaggcagtcatgatgcttgttgattgtatcatgaactgaagagtataataaactcaagccactgtagctgaggtacctaggaacaaacaaatgaaaggatggctatatctttcctactgataaattaaactacatttgccccaaggctgcctccatactttgagtcctatgtaaagaactacaacccaaattagtacataaactcaggaaaagctaattagaagtatacttttgtaacaaatatctgagtctcagccaatcacagcagctgagctttagtctatcacaagcagccaactgatcagaccatgttcaaataaggcaaatgcctagctaaaataaatcaggctgttcctgtacctcgcttctgtgttctgtccataaatgcagcttgcccaggtctcagagcagaaccctctgaacctcttctggttctgagggctgcacaattataatgcaaatcattctttgctcaaattaactgttaaatgtaatttgtctaaagtttttcttttaacactattcttttcatataatcacatgaaataagagaagaaaatcaatggtagaaaaattcccttgtacagtaaatcaaattgttaagaagtgtaatttctttaaaaagatatatctagttactctatcactgactctcaaataatctgtagaactttattcattttctaaagagtcttgttaccctcatgatccgtatcaacctgcaattcaaaatatcatagaattgatagaattgttttgtctatcagtaattgtcttcatggttatatttttttcagattatatttgggaaaagctacttattagaggaatatctacgaataataatcagtctttcacaagcccaaaagctctgatatctccctccctcatgatcccattgctgttgatagtgttatgcagattttgtaaacaattaaatctgttcgcatgcaaacaattttggtttaaccatgaacaacaataaagaagttcatatacttcttttatgtaattcacgatctacccatgctccttttaaaagcatactaatatatcctattatgtattccaaagctgttatacgaaagtgaatgttcttttcaaaattctttttgacatgccactggagcagctccagaaaaaaattaacacttttggggaattttattgcatccctttcagtagccaaaaaggaagcgggtggggcgggggtggggggctgaagccaaagattaaaataaatgcataattcatttttaacatggtaggttttctctcattcttcattgtaatagctctagaactaattttactgttaacactgaatttttagaggggtgttgtataaaccattttttacaaagaaggagactaaaaagattttctgctcaccatcagtgcacaaaattgaacaagtgaaaatcttcacacacaatatgcttccaatgagcatgctcttatgcatcaaagaggaaacaaagcatttcaggattatgtttgtaaaaggattgtttttgaaaaaaataaaaaagcatagagcaaatttcagagtggaaaaacatcaaaggcttttcaatagtcaaactcatcactagatttaaggcaacatttaaagcaagacatctgtgttatttatataatatcaaaaagaaaaagcacaaaggtagactcaagacaaataaagaatccacctcctatgctataaaatacttcttatgtttgtctctctaacagtatgctattattctagcaaggcaaatatgttcttaaaagggtatcatgttttgtatgatgctgatgagcgcagctttttcatgtgtcttgcttaatgcagctaaatactacgaatgctattcagttatcaaagatacaaagaaccattcaagtttaggaaattactagactctttcttacagaaacacaaattattataatgtattgttttcatcttcctgcccaatatccaaactttataatccattctatttttctctcacattgtaccatgagacacttttactgcgagcagtaagtatgagaatgcaaaatctagggaggggtgaaaagaagtaaaagaacaacaatgtaaaggaggggaagctgacatggagaaggaaaaataggattcaacactcttggattcagttattaattcttaacaaatgtccccagggagctcacccagtatttctagaccagatggaaaaaacagtatgctacagcaactctatccctagacccagctgtcatgaggaatagagaggcaatcccagtaaggaactaacatctaacaccatacttcatgtgtgctgcgccattcatatacaggctgaccttaagatggtgactgttttgtttgttggttggtttttgttttgttttgctggcttcttatgtatgtgcctctgttttttatatcaatccttgacctctctccaaagtccaatcatgcatttccaggccctgccaatgatctcctttgtacctttaagtcaacattccccaaaaccattcattttctcctaaacctgaaaaaaagaaaaaaactccaccacttgactttttccctgtggctggcaacaccattctctcaatccttcaagcattacattttaaaatgataactgagttttccttctctctcttcatcatatcaagatcttgctggccaggcacagtggcccacacccgtaatcccagcactttgggaggccaaggcaggtggatcacgaagtcaggagattgagaccatcctggctaacacggtgaaatcccatttctactaagaatacaaaaaattagccgggcgtggtggcacacacctgtagtcccagctactcaagaggctgaggcaagagaattgcttgaacccaggagacagaggttgcagtgagccaagattgcaccactgcactccagcctgggtgacagagcaagacaccgtctcaaaaaaataaaaaaaaaaattcttgccaaattatatagcctaatagcaaaatatttgtcaaaagtcgatccccttggccaagcgtggtggctcacgcctgtaatcccagcactttgggatgccgaggctggaggatcacaaggtcaggagatagaaactatcctggccaacatagtgaaactccttctctactaaaatacagaaattagctgggcgtggtggcacatgcctatcatcccagctattcaggaggctgaggcaggagaatcacttgaaccagggagtcagaggttgagttggaggttgcagtgagccgagatcacgccagagcactccagcctggcaacagagcgagactacatctcaaaaaaaaaaaaaaaaaaaaaagtagaacccctcttttccaattttgttatgtaattccatcccaaagtttggattacccaggcctctcacttaaatggtcacaaacacctaactggtctccccaccttcaatctctttatccccaattcattatatccactgctattaaattaatattcctatggcacaactgtgatcctcctcctccaattctcaaaaatctttagtgaattcacaattattgaaaatatttaaaatcttttagccatgaaaatcaaaggttttcatgatctcacctcaatctcacttttcaaaatgatctcacacaatctccttcatatactccatgtttgaaccactggactacatattattaagtgaaatgtacctgagcttgcacatcttgtgtctttattcacactaatcttccctccttgtttgctgtgatagggactgtgctagatagtatgatacaaagatgaataatagatcttatataggttctaagcttcttagagaagcatgagctttggaattagataggactggggtctgaattcagattctgcaattgccagctgtctgatttggggcaagctcttaacctgagagacagctttttgagctgtgaaatgatataataacatctaccttggaaagttgccaggatataaattacatattttaaaagcatgatatggtgtcttccatttaggtaagtcttccttctgaaataccaacattagcttccccaagcagaatgcactgatgacaataatgagttagctgtcacctgcaaagatcctgagttagtacagacagagaacaattgcagctttcctctactccttttcttccttgcagagacaaatgagggtgacctcacagtttatgcctcgtaacgtttgcctagtgatcttttccattctccaacaccatccaggcaataagcatcaatgttaatgagctgctggacagctttgtgaaactgactgaaagagccagataggtattggtgtcctacacatgcaaataatatactttcccttcaaatgtactatttttatataagtttcaaaagttacatcctggtggaatgacagtacccaactgaaatatgttttccactctatgttactgcttacttcaacgggaaaagaatatatttacactttgccatattatgtaaacatggaaaactgagctaactagtgtcatgttattaattgactccagtgatattttagcatcctttatagattggccccctggactcgtaactgcccgtaatccaagtatgtatatgtgaaataacctcaggggtcggtgggagggggaaaggggttatttacacagtgtttgaagaagtgcaacacttgcagtttcaattccagaagtagtaggtaccgaggcatcctggatagactgtaaaagagtagtcaagaaatcctggcagttatcaatgactagaagccaagtaaaagctgcaagtcataattgctggaaatttgtttacatgcaacagtattttcaagggaaagtaagaagcagagggaaaagggcttgatatagagcagacatccgaacccaagtacttaatagtaggaggaaaaagaaggctgaaactagcttagaagccatctaaaaaagaaatatttagttggtctttatttacactaaattagaaaaaattttacttaaacctatgcctcagtctaaatttcccagtgaacatttgtggagatttggctatctagaatccatttcttccttctttgggcaacagcatccttatttcattttagagaattccctcctctctattgtatccagtcttggtggtgctacaagtcaacatgccctgtgctcctctaaccagtaatcatccaagctatgccagtaagactctccaaaatttaaatctaaagtggagtagcttaagaatggaaaaggataaagtcccagaaatagcgctccaacaaaactattgtgagtatcttgctgttcagaaaccgtaagcctggtcactagcttttaccttaattctgctgactacccaataatctttcaataaattcctttctgcttccttaactagacttggttcctattgttggcagcctaagaagccctgataaggaattaaagccattttgcctaactttgtccctggtctttccaaatgaaaactacaaatatttgaaaacaaaactaccctatagtttgttgaacggtgtttttatggctctattacagaagtatccagcatacttgcatttttcaagcacacaaaacttaaagggggcatttttgtttacttttcctacctcattttcagcagtattcactctattcccactgtttcctgccacgcttccccattacacgattttcttcataattgggccaaggtttactctagtaacattagctgtattgatttatttgtacatttgctgtctcgagaacttaagtaatttgagtagctcatattattgtttacatgttcaattatcttgtacttcttaacattttcaatgccattgcctttattctagtatcttttcacaaatatgcattactgtattaagtacaatgtgtccaaaattaattgttaaaggtatgataccagtatttgttcccccaggactcttcgatgaaataaatcagtaaaagaaaatctaaatgtataatttataaatttatagaaattgagaaatctgaaaaatgtagtgatcacctaatctaaggccataattttatagataagggaataggtctccctaggccattatccttgattccaacatctccattgatttattttgggttttatgtgttttctgtcattgcaaggggttcagggaaaaagatagcaactgtgtatgtccggtaatccctcttaaacaagaggaaaaagggaaataatctgacatcccaacttaaatcaggggcaccagtaatctcacagtaatttaaaggtcaaagtttacagttatcttaaatttttatttaaatctccttcctattcacctggccactgtaaagattaaatgaaagtaatttgtagactataaaatgttatatgagtcaagattttgttaatattgctattcttcatcctttcccttcccacggcacaaacatagagccattatggccttacatcaaaattataacacaaaccaataaagcccccatcccctccccattgcaacccatcctataagacaactttttgtactagactttcaattctttcaaacttttaagaaataaataacaccaattatatcagtctattttcacactgttgatgaagacatacccgagactgggaaatttataaagaaaaagaggtttaacggactcacagctccacgtggctaggaaggcctcacaatcatggtagagggcgaaaggcatgttgtcttacatggcagcaggcaagagagagaatgagagccaagcaaaaagagtttccccttataaaaccatcagatctcacaagacttactcactaccacgggaacagtatgtgggaaaccacccccatgattaaattctctcccaccgggtacctcacacaatacttgggaattatgggagctacaattcaagatgagacttgagtggggacacagccagatcataccaccaacattacacctactcttccagagaacaggaaaatataaaacacttccaaatgtgtgttgttgttgttgttgttgtttgaagccaggatagtattaatatcgcagcctcacaagaacattgcaaaaaagcaaagtcaaaagcaaatcctaatcgtgaacatgagtacaaaacacctgaacaaaatttcagcaaatcaaatcctgcgatatatagaaaggataataaaccatgatcaagctgggtctattctaataatgtaatatcatttactacagtaacaggatgagggagaaaaatcatatgattatctcaatagatgcagaaaaagcactctataaaattcaacaccaattaatgatttttaaaaaagaaactagcaaactggcaataaaatgaaactgccttggactgataaagcaaatccaaagaattcaaaagtcaggatagtggttgtcctttgggagtagtaaatggaatgagtaagaaaagagcttcagaagagctaatttctttatctgaatgcttaaaacccaaacgtggcaagttcatgagaatttactgagctgtacaaatacagtatgagcactttcttctatgtatattatacttcaacaataaaaaaacctatagcagtcatacttaattatgaaataataaaagttttcttcttgaaattggaaattacacaagcatgccactaacaccattgttcttcaacaatttattggagatcctaggcagtgcaataagaaaaagaaatagaagacatgaaggacgacaagaaagaaatttcatgcagaaaaccccaaaataatctatggataaagtattagaataaaaatacatagcaagattattggatttcaggtcaaaatagaaaatcaactgtttctatatatcagcagttaaaaaaaaagtttttaaatgacaccatttataacattaaaaatatccaacacttcggaaactaatggaagatatgcaaggtccttacagagaacactataaaacattattttaaaaatttaaggaagaggccgggtgtggtggctcaaacctgtaatcccagcattttgggaggccgaggcgggcagatcatttgagatcaggagttcgagaccagcctggccaacatggcgaaatcctgtctctactaacaatacaaaaatagccgggcatggtggcaggctcctgtaatcccagctacttgggaggctaaggcatgagaatagcttgaactcgggaggcagaggttgtagcgagtggagattgcgccactgcaatccagcctaggtaacaaaatgagagtctgtctcaaaaaataaataaataaattttaaggaagaaataaatggagagatatatcatgctgatgaaagagaaaatactgaaaatgtcaatttctccaaattgttctatagattcaatgtgattccaatcaaagtcccagcagaatttttgtggaaattgacaagatgattataaaaattaatataaaaaaatcaagagaattttgaagaagtgggaggaggtacaccatcagacaactagaataattaagacagtatggtattggcacaaagataaatgcatgaaccaatgaaacagaagagggtgcaaaatagactcatacatatattttaaaagattgggctgggcacggtggctcacgcctgtaatcccagcactttgggaggctgaggcaggaggatcacctgaggttgggagtttgagaccagcctgaccaacatggagaaacccatctctactaaaaataataataatacaaaattagccaggcgtgctggagcatgcctataatcccagctactcgggaggctgaggcaggagaatcacttgaacccgagaggcaaaggttgtggtgggccaagatcgcgccattgcactccagcctgggcaacaagagtgaaactttgtctcaaaaaaaaaaaaaaattgtactgcagagccacagagaaacaatgatcttttcaacaagtggtgctggttcaaataaatatcaatagcaaaaaatgaaaactgctatatgcctcacatcatataaaaaaagaactcctaatagatctatgaaaaaataataaaatatcttaaaagtttacataaatgaataactcatgacctttatataagcaaaattttctttttctgtcctttaatttcaacttttttttcttgctttttttataatttcaacttttattttagattcggggtagatgtacagatttattacacagatatattgtgtgatgttgagaattagggtacaactgatcctatcactcaggtagtgagcatagtattcgatagtttttcaactcttgctccgccgtcactcccctttctagtagtccccagtttctattgttgcaatctctacgtccatgagtacctaatgtttagctcccacctataagtgagaacctgtggtatttggttttctgctcctgcattaattcacttgggataatgtcctccagctacatccatgttgctgtaaaggacatgatttcaatcttttttatggctgtatagtattccactgtatatacgtatattttctttatccaatccaccattgacaggcacctcggttgattccatgtctttactattgtgaatactactgaaatgaacatatgattgcatgttctttttggtagaacaatttattttcttttggatatagacccagtaatgtgattgttgagtcaaatgatagttctaagatatttgagaaatatcccacctccacaatggttgaactaatttacattcctaccaacagtatgtaagtgttcccttttctccacagccttgccagcatctgttgttttttgacttcttaataacagccattctgagagatggtactcattgtggttttgatttgaatttctctgatgattagttatttgagcattttttcatatacttgttggtcacttgaatgtcttcttttgagaattgtctgttcttgtattttgctcactttttagaagggatatttggtttttgctttttgaaatgtttaagttccttatagattttggatattaaacatttgtcagatgtatagcttgtgaatattttctcccattccataggttgtctgtttactctgttgatagtttctcttgctgtgtagaagctctttagtttttaaattaggtcctactcgtcaatttttatttttgttgcaattgcttttgagacttagtcataaattctttcccaaggccaatgtccaagatactgtttccaatgttttcttctaatatttttatagtttgaggtcttacatttaaatctttaatctgtcttaatttttgtatatggtgaaaggtaggggtccagtttcattcttctgcatatagctagctggctatcccagcactatttgttgaatagggagtcctttccccattgcttatttttgttgaagatcagatggttgtaggtgtgtggcttcatttctgggttctctattctgtcccattggtctatgtgtctgtttttgttctagtaccatgctgtcttggttaccgtagacttatggtatagtgtgaactccaataatgtgatgactctggctttgttctttttgcttacgattgctttggctatttgggctctttttttagttccacatgaattttagaatagtcttttctaattctgtgaaaaatgacgttggtagtttgataggaatagtattgaatctgtagactgctttgggaagtatggccattttaataatattgattcttccaatccatgagcatggaatttttttccaatgtttgtgtcatctataatttctttcagcagtgtttagtagttctccttgtagaaatatttcacctccttgattagcagtattcctaggtattttgtttttgtgtgtgtagctattgtaagtgaaattgtgttcttgatttggccttcagcttgtacattattggtgtatagaaatgttactgatctttccacattgatttcatatcctgaaactataatgaagtcatttattaattccaggagccttggtgcagtcttacaatgttctaggtatagaatcatatcaccagcaaggagagacagtttgacttctttttttcctatttggataccttgtatttctttctcttgtctgactgttctaactaggacttcaaaattttcttaaattgaatacaaaaaacactaactacaaatgaaaagattgataacttgcattagctaaaattaacaactattattcgtcaaagacaacattagaaagtaataaggcaaaccacagatgggaaaaaacatatgtactaggatggctaaaattaaaaagattatcaataccaaatgttttggataagaactactcatgtatttccaggcggagtataaattttttacagccactctggaaaaatatgcatacactataacctagcaataccatttttagatataacagaaatgtgtatgtatgtgcatgtgtgtgtataccagttagaaagaagcatgagggtgtttcttagtactggtaatgttctgtttcttattctagatggtacttgcataggtcttttgcttcataataattcataaagctgtatacttacagtcagtgcccttttctgtatgtatgatatacttcaatttttttaatcaggggaaaaataaggagagaaaatcaccaatgtgaaacaaatatcagaaatgcccatccaggaacctgaaatcatttctcactggcacaaacactacccagtgataaaataaggacttgatatttagacaacaacaaaaacctgatgtttcagtttatctatacagccttagtaaatgtaagtatgtaatttcattaagctttctgaaatgctaaaaacaattttaaagattcttattgtttttgtgtacccttttgtattcacagatcccagattagaaattagtgccctagtctgaaaagaaggatcaccagacaaaaatattcagtaaatgttgcctcttctctttataatctatatgttaggtttacactgaaaactatctctttagggaaattatatagatacaccaatcctaagtaaacatttttaaataaaatgatgagggtcttattctcaattgtttccaacactagatacattataaaaagaagttttgtccctataacccccaaatctatgttctttgttaatcagtgtgtcacagttcaaatcttaatcacatccaaaattttgtgaccttgggcaaatttcttaatctgtgtttcaatttccatatctggagaatggggatgatgtgactaatacctacctcatagggctattgtgaagattaaatgcaataatgcatgtcaatcacttagcactgtgtctaaatgttaggctattattattatcaccatcatttttgcctatttatttattttttaaagtaaaacactaaattgctgattacaaatttgtgagcatgaggaagactgttgacataagggcttcattctcagtgatcatgttaggaagtaaccttgtactgggggatttctagatatcagtatatgaagtcttctttggagccactcgattctttcaaagaagaatacatttttctcctaacctggaaagtgctgtctagttgatgatgctgtgcaaaggaacaggaagaggagtttaactgctccatagatcaactttctacctatccctttgtttactgcttaaagactcattccctaccctcagctctacctcgtagttccaagcccttcaaatatttaaagatagccgttattttattctgagtcttctcttctccagttagacatacccatctcctttaactatttacagaccattctctttcatcatcagtatattcattcaaatctctgttattgtgatggttaattttatgtgtcaactgggctaggccacagtacccagatatttgatcaaagattccatgatggcaatttttaaatgagaataacactaaatcagtagactttaagtaaagcagattgccctctgcaatctaggtaggcctcgttcaatcagttgaaggccttaacagtctgacctccctaaaggaaaaggggattccaccagcagaccacctttggactggaactgcaagtcttccctgagtctcctgcatgctggtatgctctgcagattttggacttgccaaatctccataatcttgtgtgccaattccttaaaataaataaatctctctctctctctctctcacatatatatatatatatatcctgttggttctgtttctctggagaaccttgactaaaacagctatgcttcaggaatacaagtagaaaacactacctacctttgtggatatgccagtctaacctcactttattatatccaaataactcttaaaactgtttctaggtcacatggacctatgcaatcagaccaatgcaatttgaccataatatagaataaataaactgcaatttcacctccctaatataattattttaccgcaaccaaagagcaacctaatccacatcactgcttatattgagtttaccataataaaatccccaaaaacttcccacaagaactgttacagctcaccaattctgtatttgtgaattgttttggggggcctgcacataatacctaacattttttcctactaaattttatcctctgaaatttagtttttcattgactgctgtcaagatattttggattccagattctgtcatttcaatacatttacaaatactctcagctccatactaatgaaatattagtctttatcaaactaaaagaggcatagctaagatcaagagaagtctctgacatcatcaactataaacaaagcctgaattcaaataatactgacatacatatgctgctattaaaattctcagggagtattagatatgcaaggaaggtgggacatatgctgctccagacaggcctggtgtcaactgctgtctctaaacttacaagttttataactggacaatttgcttattcctcaaagagtttcaatttccttttcaataaaatggtaaagataaaacttacatcacaagactggtgtgatgttcaaaatacacataaagcacttgacagaatgcctaatacattgcaaatacttgacatgtgtctactttgaagcacgtattatagtaagaactcagcaaaggtgagatacattcctgcttcatcactttcccttggatcaactataacctaaataacttaacctctcctggccttggggtaaagaggtagacagagggggagagaggcagatggaagaataaagttgctgcatgaagttgctacctaaagagactattttaaaggctgagaatcctttaaaagatatcaaatagtttagaaagatgctttgacttgggctgttagaaaactgcagcttctagtcagaaaagaataaatgcagtgatgtttgggatttggttaaacatttaaattgcatttcaaaatgttggatttggcaaaatttaaaataaattttgccaagtccttaagttttttacttgcatgtattcaagggaaagccagcttgtagatttgaatcatttagatttaactcattaaaatgtatagagtgctttatcaagccacaaaaattgtgccccaaatcatttacagtttaacttagaaaaaaaaaagtcttatataaaccacagctcttgtacactaagttgctgagacttagaagaaaagattaactcagaaagacctcaagaaagaaagaaattttgaagaagtaatgaaaggagtggaatagcactgaatgcacaggaaatggaaaaccattccaaggatgcagacagaagtgatattacataatagctgacacagactatatgcaaatttcagtgattggattttgacttaaagatattttcctgaaatgtctggaagaacaatgggactttgggggcatccataaaattataatcaagatctattcagcagatgtttactgtgtgtctccacgtgcaaagctctctaacaagcactgagaaacaatgctgaatgggacagacatgtccttgccttttggaagcttacagtctattgacaaaatagacttttttatgtgaaaacagaaaataataagggctaggaagtatcaagatgtaggaagcagtcgcattatacacggattttaaggtgtaacataaaagaatcatacattttcaatttcttagggactttgaagttcatcagtccagtttttccaagaggaatccaagacagcaatatgtaaactgcttcgattgaggtagggggcaaaaggaaaagcaaagccagacctggacacaggtgtcctaactctatatcaaacatccattccttcattcaacttttacgtgatatttactatgattaggcactgtgctaagtgctgcagaaaaggtaaaaattaaaaacacctctccctaacatggtcctggaagagagataagtatgaaaataaacaatccccaaaagataaatgatgtaacagaaaaattgcacaaagttgtgcagcacccaaaagcaagaccctctctgcttaggaagacaatggtggctttacatcagccaaatcatataaaatgagtaggattttcccaggaacataaaaagaagagaattcaagaaagaagaaagaggccaggcgcagtggctcacgcctgtaatcctagcactttgggaggccgaggcaggcgtatcatttgaggtcaggagttcaaaaccagcctggccaatatggtgaaatctcgtctctactaaaaaatatatatacaaaaaaattagccgggagtggtggcgtgcctgtagtcccagctactcgggaggctgaggcaggagaattgcttgaacccgggaggcagaggttgcagtaagccaagatcatgccactacattccagactgggcgacagagtgacactgcttctcacaaaaaaaaaaaaagagagagagaggaaagaaactgtgcaaagaacactgtatgtttggaaaagtataagtataaaaagtatgagttcttttacttctgagctttttttcttaattagttttatcaaagtaatacatgcacatagtcagatggtgcaaaaagactcgaaacacagcagtcctgtggccacccttctgctggttacactaccatcaaggttctctcagtcccagatgcaaccatgttaaattggtttagctgctgcttctggcatttagcgccatgcttctaaatcacgtgtgtctatactgatatactggtatcctacacagtataagaactttcacctcatacccacttcacccccccaccccagtccccaatatggttgaaacataatgtggggtgatatccataattgtagttataatgactaagtaaatattgcttgctgattaaggtattatactctgactatatttcctctctgtgataccttttcctttttctaatgttgatttgcatgtacttgattgttctcttctactctctggtttaatcttcccccacattccaatggctctaaagccatttctaaataccatttttcttatagtcaaacctatcagataatctatttttccccatgattatgccccctagaaatctgcccctgtactcaccccttggcctgtcctaggaattccttctgtctatggtgtaaaccaagaaataggaagcctccaaatctaggaaacataggctctaacaatctcactttgatagaacccacattctactagcttcctgagaaagaatgcatgagaggtaaatttattttcatacatttgtcagtcatccttgactgatattttaacaatgtaaacaattcaaggttgaaaattgctttccttcataattattatcttctagtttctagcgttgatttgtggggcttttcggcttctcaaagtatgagttaggattgtgtttagttgtaggtaaaataaaatccaacaagttataacttagccaaatagggaacctgaccaggtgctgaccacacctgtaatcccaactctttgggaggccaaggtgagtggatctgctttgagcacaggagtttgagaccagcctgggcaacatggcgaaaccccatctctaccaaaaatacaaaaattagccagacattggtggcttgctcctgtagtcccagctacatggaaggctgaggctggacagtcatttgagcccaggaagtggagggtgcaatcagatcactccactgcactccagcctgggtgacagagtgagaccctgtctcaaaacaaacaaacaacaacaaacaaatagacaacctcccacccccaatgtaacaagaaatccagagacaggtagttgctgaaattgattcagcagttcaggtatatcagagctgagaactctgtgattctcatggtcgcaaaatactgtagctccagacatcttgttcaggtttcaaatgagaaaaagtagaagagaaaggagaagattcaacagatttccacttacattttatgggccagcactttaccacacttggtcatatctaactacaaaggaattgaaaaaagtaagcttttagctttccggcctctacaatgaagaaaagcaagggttgaaagagacaaactggaatatgagataacattacaatgtgctttggtgtgcgtcttttcaaaaatcttttgtgctgggcactctttgagtccttctaagtttgaaacacatattttcagtcctagcaattttccttttaaaatttagttgatagttttatcctttttgttttttcattctctctggagagctcctaaaagtcaaaggttgaacttctgatactgatcatctatcttttttctcctatttcccatctcattatctttcacttcttttttattttaagttccgggatacatgtgctgaatgtgcaggtttgttacattggtattattttttacttcttttttaggagacttcctcatctgcatttaacccttttattgaatattttatttcttaagtgctttcttactctcttattcttccttttctatagtattatgtttttattttatggttgcaaaatcttctcatctttctgagggtactgattataattccttgaagttttcttctttttcctgacagtctttcttctgagctttattttgttattgttattgtttatttctttgttagttttgatctcttttcctgttggagtttctccttaattgactggtgataattgattctgtgtcatatctaagaatgaggtactagaagggtgactagaagctgcgtgcatgtggccaaagcttaatgagtagtaagctttactaaaggacaatcaggaagcccgttagtttcctcatcagggaagcccacatgtcagtatctacagagtttttctctgaagcatgttatcccttcagagaaggatcacctatctgaagaggtgttaagagagaaaggcagttataagccttgctgctactgttgtagaactcagcacaggaaggcagctagaagtctcaccattatgcagatcacttaattcccctcactcctatcctccctactttgcagtctctcaggttcagttcttcacagattatacgtttcatatgcagcagagacagggaagtggcagttgttagtgcctagtagggatgactgaaaaatataattaattttaaacaattcttttgtttgtatgccacccacatcatctctccctcacaatcacactccaacttccataatacctaatttctgattcctaagcctatctcagattctgcaggatgaatcagtttgtttatcattggtatatccctctgcagataattagattttacattcttgctgctaagttatctacaattcttccatatgctttcaattttcctatactacagatgaaggttagagaaatctagttttcctaaagatggaaagtacctgttgcttttgtttgtttgtttgttttaagtgatttctagtaaagaagtactttttctgccattttgaaacaggtaagtctctaattatgaatttaaaacttgaagacattgatagatatgaacaaaatatgctccagagcaaaactctacccattaacaaccagatcatgcacgaccagattagaatggccattatattgttggttatccccattctggtaatatgacgtagcagctaagagcatgagctctgaggtcagattgcctagccttaaatcctgtctctaccactttacaagatgcataatcttgcacacattctgtttatattatcctcttgacctgaaaaaatgtagagtgatgatgaggattaagtgaacaaaatgcctggcacacaagtattcaatatatacaaactactattattaactccaacagatcaaattttccaaagtagtgagagtaatatgcactaagcgccttacagatattaacttactgaatcctgaaaacaatactatgaggtagggatatcaccgtgccaattttataaaagataaaactgatagatgaacaggttaaataacttgcccaaggtcacacggccaaaagtagataacagggattcaatctgaagaaatctggttccatcgtctttgatcttaaccacttacaatacacagcccaaggatagcatcattcaaatttgagtccccaggttctctctagctctcttatggaatgccaagtaagttatattcggtaccacagactaacttaaaggaagatttcaaaacgacactgcaaaatttggaccaaattatttctccatttaactgccttctatgtacaggtagtagtatagaatagttgtgtacatgtgatgctcatttccataatgagtaaaggacataaaacataaaaatatcatgcagtttttaggcctattgctcccaaatcattcactctgattatatcctttattacagggaaatgtgttttctaagtctatcttctttgcatggattgaaagatttgtgaaactgaaaactaaccttcctctgccaagagccccatcaagacagaagttcttaattaactaagcaattagtcataacaagtgaaagctaaaatggagcatgaatacataatttgctgattatttttctccactagaacccttagccagaatttaacaaaaagtgttctgtgggtgctagttttgggaaggatggtaaaacctggacagaatgcactgaacagctatttgagggctccaaagagtaaagaattgcagatggattggagaagaccagaattcaaagtatcagcagtgcgtttcttgtttttccttagtatcccccagtctggtgtctacacctggtacaccaaaaccaggagtagacaccagcatacaaacagagagatttccagagaagtcctctagctctggctcaacaggtaggaaaacaaagagatttctaacactcagagagagtgggggaaattccaggtttttctcttatatcatcattattacttatgttttctctctttcatgcctcagtctccaggccatcctgtggcagtggcagcagcaacaatggcaagcaatggagtgattcacaggtgcctgaaacttggatagaagtgtagtccacaagagagaggcaaactcctactgctttttctctctatctctgtttacctacctcttgaacctaaacatgggtacaactacaggatgtgtgtggcagagcaggataactaaaactccagtttgtggccaaggaaccaaaaaatactggggatattgcggagaaagggttgggatatgagcccgtcctgagctgcacatacagagatatgatcttgaacacctaacaaagacttgagaaatgaattaaactactgaccactacccagatctcagactggctgcttggttgcaaatatgtgggacagagcaaaagagcatcacagagcgtttgaaaacgaattgacactgaaaccacaagccactgaaggctgatcagaccttacaacctgaattctctgggttgattgcatgctaaaataaaaatatcaacattcaccataggatgtaaataagacccagagtctcataacatgatattcaaaatgttcagaatataatacaaaattactcagcattacaaagagccagaaaaatttcaaattacatagaggaagaaatttcacagacatcaatgccaagatgatacatatgttagaattacctgacaaagatgtcaaagcagctattaaaaacactcttgaaataaatagaaagtttcagcaaggaaatagaagacgtgaagaagaaccaaatggaaaatttagaactgaaaaatgcaatagcaaaactttgaaaactcactgaatgagttctgtaacagaataaaaatgacaaagtatcaataaacttgaaagcagatcagtataaattatccaatctaaacaacatagagaaaaatactttaaaaaataaataagagcctcaggacctgtaggacaatatcacaatgcctaatatgtatatcatcccagtcccagaaggagagaagagagagtatagtacaaagaaaaacaatgtaattgctaaaaactgaccaaatttgccaaatgacataaacccagaaattcaaaaagttcagtgaactccaaaaagaataaaccccaaaatacccatacctagacatatgataatcaaacttctaaaaattacagaaaataatgttggaaagtaaccaaagaaaaatgatgcattacttacagggaagcaatgatttcaaagtctgaggatccctcatcagaagtgggagctaagctatgaggaaacaaaggcataagagtgatataatggactatagagacttgcgggaaagggtggggaagggggtgaaggataaaagacaacacaatgggtgcagtgtacactgcttgggtgatgggtgcactaaaatctcagaaatcaccacctaaagaacttatccatgtaatcaaacaccacctgttcccccaaaactactgaaatcataagaagaaaaataattttttttaaaaaagaagtcatggaggccagaagaaagtgcactcatttttaaagcactgagaaaaaggaaccatgaaaccagaattctgtatctagcaaaaatactcttcaggactaacaatgagataaagacattcttacatgaagaaacactaagagaattttcattagcaacagacttctctacaagaatgactaaaagaaagttcttcagccagaagataatgatgccatatgcaaatgtggaacatcagaaaggaagagagaacaacaggaatggtaaatttctgggtaaatataatagactattctttcaccctgagtcatttagagtatgtttaacagttaagagcaaaaaacagagcattgtctgatgagattttcaatgtgcaaacagagtccaaaactaggcctacaaaagtatgatcaatgggtttttgacgaaggtacaaaggcaattcaatggagatatgatagttttttccataagaggtgttggaacaaatggacgtttcgaagcaaaaaaacaaacaaacaaaaaaagaacctcacgcattatacagaacttatcttaaaagagaacatagacataaacataaaacataaaactaatttaaaacatcaaatatagttttttgagtaataattggaaaaaatcttagtaacattagtttaggaaatgatacaccaaaagcatgattcataaaaaaaattttgataaattggacatcatcaaaataaaactcttgctctgccaaagaccctgtaaagaccatgaaaagacaaggcatagacttggggcaggggggaatctgcaaatcggccgggcacagtggctcacgcctgtaatcccagcactttgggaggccaaggcgggtggatcacgaggtcaggagttcaagaccagcctggccaacatggtgaaacctcgtctctattaaaactacaaaaattagccaggcgcattggcaggcacctgtaatcccagctacttgggaggctgaggcagaagaatcacttgaacctgggtggcagaggttgtagtgagctgacatcgtgccactgcactccagcctgggtgacagagtgagactctgtctcaaaaaatctgcaaatcatatatcaaacaaaagatttgtatctgactatatgaaaactccccaaacttaagaaaacaaacaactcattaaaaaaaataaatacatgatttgaaagaaaacttcaccaaagaagatacatagatactaggttggtgcaaaagtaattgcggtttttgtgattactcttaatgctgaaaaccacaattacttttgcaacaacttaatagtaaataagtacatgaaaagatgctcactgtcattagtcattagaaaatgtaaataaaaatccacaagaacatgctactacacacctattagaatgggggaaaaacagacaactgcaggtattagcaagtatgcagagccattggaactctgaaacattgctgatgggaatgtaatattacagccactttggaaaagtttggcagtttctgacaaaggtaaacattcatttaacttatgacccagtaattccactcttagttatttgcctaaaaggaatgagtatttgtttcacaaaagcacctgtacatgaatatttacagtagctttattcataaataaaaaatgcatatgtccttaaactggtgaatggatggaacaaaactaattgtggcacattcatacaacagaataccactctccagtaaaaatgaactattgatacacacaacaacatgggtgaatcacaaatgcactatgtaaagtcaaagatgacagatgtaaaacactatataccatataattccatttatatgacattctggaaaaagcaaaaaaacagggacagagaaaagatcagaggttgccaaggattagagctagggaaaaggctgactacaaaagagcagactgaaggcattttcagagacaatggaaccctttagtatgttcattgtgatggtggttacacgattacatatttgtccaaactcatagacctgtacaccaaaaacagtaaattttattgcattttaacgtttttaaattttaaaacaaatttacctatttaaaaaaaaaaacaaagacagcaacaacttaggatcccatattaccatcactatttaatgtgatcttagacaaatcacttaatatagagctttggttcccccaatttttaaaatgaaaaatatagtatttatatctcataggtctttataaaaaagttttttaaaggtttcaagatcctgccttttcacattctatttcttctgaaatgtttcttcccatcctctcttccctactttgcttggctaaatgctatttgattttcaggtctcagcttaaacgttattttttcataaaagcttctcctaactcacattttaaatcagggcctcagctatgcctttactgcccagtgtactcttatttcataacacttctcatgtccttttttttttttttttttgagacagagtcacccaggctggagtgcagtggcccgatcttggctcactgcaagctctgcctcccgggttcctgccattctcctgcttcagcctcccgagtagctgggactataggcacctgctaccatgcccagctaatttttttgtgtatttttggtagagacggggtttcaccatgttagccaggatggtctcaatctcctgacctcgtgatccgcccgcctgggcctcccaaagtgctgggattacaggcttgagccaccgcgcccggtctttttttttatttcaagagcttaggcgtacaagtagtttttggttacctggctgaattttgtagtggtgaagtctgaagttttagtgtacctgccacccgagcagtgtccattgtatccagtatgtagtttttttatcccttacccctcttctactctccttatttctgagtcttcaatgttcattatatcactctgtatgcctttgcacgcccatagcttagctcccacttataagtgagaacatatggtatttggttttccattcctgtgttacttcacttagaataatggcccccagttccatccaagttgctacaatggacattatttcattctttattttatggctgagtagtattccatggtgtatatataccacattttctgtatccattcatcagctgatggacatttaggttggttccttatcttttcaattatgaattgttctgtgataaacatatgcaagcacatgtattttttttatagagaggttgtactaacttacattcccaccagcagtgcacaagcattcccttttcaccacattcacgccaacatctttgttttttgattcttaaataatggccattctggcttgggtaagttggtatctcactgcagttttaatttgcatttccctgatgattagtgagtacatctataggtaaataattttatttaatgtctgtctctttcatgaaatggtaagctctgtgagggaagaaattgttatcagaatacaagcagtacaaagtgtctgaaacactggtgaatattctgtacatatttttaaacaaatgtgcaaaaacacaatggcatttcctattgtgtaattaattctttcttaatatctttacctttctcactatttatatgtatagacacatgtatcttaatgtttttatcttcctcaccctgtatatatacacatacatatatatgtatgtatgtgtatatactatgcataccatcaacaaagtttcttagcaaatgtccatcaaaagataacaaataatagattatgccttggttgacatacctgtttactaacttttcctcatttgtagtcattaacactaattgaacctgacaaaaataagatgtgacagacctactgtatatccacaagtcaaattaacaaattagttgaagaatcaatacatctacatatgagtctactaactgttgggcatacatccagacttacatgcagaaaagcacttaagaaccaaacctttttccctcttatataagctgtcaaaaatgttacagatgtgacatttaagaaactcagagcatgacttatagattaccttatgcataatggtaaaaattcctctagaacaaccagcaacattaataattagttggaactcaattacggatacttgccaaagcaaatccccagaaagctatcttgtatctttcaacctggccttgtagaaatgatctaatgtagcatcctacagtgtaggtacgtggggtattaatatcccaccctccttgatgggtcagtaactgaaacagtgaaaggctcaatgaagatcgcagcactaataaacgatgggacaggtattaatactgcaatgccgcactgtccaatatggtaaccactgagccacatgtagctacagagcacttcaaacgtggctaatccaaatcaagaagtgctgtaagtgtaaaatacacaccagatttcaatacttggtacaagataaagaatgtaaaattctcattatttgtttatactgaatacatgttgaaatgactatgggttggattaaataaaatcattattaaaattaatatcatctgtttcttttcacgtttcaaagtgtagttactacagatttttaaattatatatgtagcttgtattatatttccagcggcatcatgatagagcactcctggatcagtatggttgaataatagaagacatgtggaggcaaacatttaggtttacttcccagactctaccatatacacacagagtgactttgcagaagattattgtatatcactaagatgacttttcccacatttaaaatcagaacattaaatctatgatacagtactagtacgaggttaaataatacattaaaggtctaataatgtattctacaatgaatagccacttgatgttaatttctcttttcctcctttttcctaatccacttccctgttaatttaagctgcagttaaacttccatagtggacagattagtccccatgcctactattcccagtacctcggtctaggttaacacaacctccatgaccagaaaaccaggtacagaatggtggtcactgagtagcccaaagtaggtatgacacaagtatgacctgtctgtagtttggcatagtctaatacaatgggctcaaatagtgaaaaacagcatatctgctcccttcagaattcatccaagaaacagagacagactggttaataacaaaagggtaatggaagcagacgtagaaagagacatagaagtaacaagatggaaaagccattcatttgttcactccacaaatattaatgactgtctatttattacatgctatatgacctgagagaggaagtaacaggggaataattcccagagctttataagacccagacaacttccagttccagtccaaatgtctctttacaataaatattttttctttagatgaatagatgaaggctctgctccttgaaactaaaatgacctaactaacgtagcttcacaaaggaaggcacagaaaagtgcctttttgttagacactcacacacacaaagacaaaatatgtattgccctaggtaataaatcaaacaaaaagggttcttcctcaaagtgggccattcctttcctaaaaccagtaacagacagaacagaaaacaagtggagatagcaagggctactgacccttaatattcctttagaaagccactaccagaaatacacttttaagtgccttacctgcactgcatagaaatatgtaggcaaagagaaaaaagatcggccaactaaaactacagactataagtacttattaaagactactttcactaacataaatgggattcactacatcagagtcccctgatcactttttgcagggcagtctgtgggcctcactaaactaatttgcgatattaaggtaaggaaagaagaatttcctcattctaaatgtattattggacaggcttgaagtccaggtcttaagtatggttacataagggacaacaataactatttgtttcaaattgtatctctttcaataaaacaatatctcagtggtttcagcagggagtacaaaatctgatctcttaaccctaaaattccaaccctggaaaaatggctcaccttcgccaaaacacacacacacacacacacacacacacacaactagagactgattttccacacaaaatttatgtacttattaaaaaggaatttactttataattatgtgcaagaattatcatggtgagaagtgaatgttggttttaatcattgccagtagatcctcccatcagccacataatcatattcactttatggaggaagcactattactccgtaccaagcatcttatataatatagctctttgttttcatccctgtgacaaaccatgtgagatggctgtgtgacccttgttttaaaaacaaggaaactgactgctggaaaggtaagtaacataattatccaagatctccaacctaacaaatgtcaaagtatgggagctgaccttgggcttttatgctcttgtccacaataatccagagcacccagaacatttatatctctaagaagttaagtttagaaaaatgcatctttttttgcatatatgtcaccaacttcgggtatttcttattacaagagacctttttgcttaaagattccaaatcaatcacccatcatttttctaacactataaattctaaatgcaaatgtcaactaagaaaggtctatgaacattttaaaaactcattttccccaaatccatatgagtctgaatgctgagaaattccacactaaaggtagaatacttaacaaaacaccaacatttcccttcagaaataacaaagggaaatataagtttgtgctcactttttcataatgtcatggcatgttaaaagatgaaaacctagtaacaaagtcaattaatagaatctacaatctttttaaaatattttagtagcttaagaagcatattaaaactagaacctaaatattaggctggaatcgtggtacatctttagctcttccagaatcatactcacagtggggctcacactgtattttaataagcttctaggtgggcccattcatctagcagcttaaaacctccccaggtgattccaatgtgaactccaggctgagaactgtcatagttgaaaaccactggactggcacatgagagcctgatttctgctgaatgtcctttctttgagctcttctcccccagtcctatgaaaagcatggtcgctgattaactcagagttaggtgaagaaaatcaaacttggagagataattataatagataccgtgatggttaattttgtgtgtcaacttgactaggctatggtgcccagttgtttggtcaaacatagcctccatgttgctgtgagggtatttttaaatgtaattaacatttaaatcagtagacttttagtaaattagattaccctccctaatgtagatgaggctcatacaatcagtcaaaatcttaagagcaaaggctaaggtttccagaagaggaaggaattctgcttcccaaatgcaacactgaaactctacctggctttccagcctgcctggcatgtgctgtagatttcagacaggactgcaacatcaactctttcctgaatttccaggctcccagcttgccttacagattgtgaacttgccagctcccataatcacatgagcgtattccttaaaataagtctctttctcactcgcattcatggtgtgtgtgtgtgtgtgtgtgtgtgtgtgtgtgtgtgtgtgtgtgtgtgtgtgtattctcttgtttcaatttctccaggggaccctaatgctagataccattatttaaacacagactatgtactagaaaccatgctaaattattcacatacattttctgagttagcctttacacaacccaattaaacagttgaataagcaagctataaagagaagatgtgaccagagatagggaagcttcctttagtggctgtggagagcaagcagtacagaagttagcactaggtgagccaagaaaaagccaaggacaaaagaagataaggtgttcattgaaaaaaacaaaagacaaaagggaaaggggaaacctatagatttaaaaatacagtgcccaccataggaaaccattcttctactttctgcttttattgctttgacttttatggacattacacttaagtggaatcacacaacacgtagtcttgcatctgactcctttaaagaagcataatgtttttgaagtttattcattttgtagcgtgcatcaatagatcactcctaaaacttcttgaatatagaagtggaatcatgtagtagtaggtctatgtttaaacttcaggaaactgtgaaagcagttttccaaagtggttgcaccattttatattcttaccagcaatgaaggttccacgttctccatatcaatgccaaaatttattattgctaactttttaaattataaacaattgagagtgtgtgtgtatgtgtgtgtgtgtttgtgtgtgtgcagtgtgtactatatagaggttgtttatatctcattgtgatttttttaaaatagagacagagtcttgctatgttgcccaggctggtcttgaactcctgggctcaagcaatccatctgattctgactcccaaaatgccaggataacaggtgtgagccaccatgcccggccctcgttgtgattttaatttgcatttgtctaatgactatttatgttgagcatattttcatgtgtttattagccatttgtagatcttcttcagtgaaatgtctattagaatctttgactattttaataaactttggatattggtacttattttaataaaccaactgtaaaatatgtttatgataaaattgtggaaatttaaacattcaaaggatacttgatattaaggatttattagggttgttttgggtttgataatgctattgcagttatgcttttagaaaaaaatctttaccttttaatgtgacacactgaataatttatagatgaaataatgtgaggtctgtgatttgctataaaataatccagaggaggtaggggaatttatataaaagattggccatatgttgacaactgatagttcttggagctgagaaaaggattcatggggactcataatactatgtttgaaatttccataataggtttttttgtttgtttgtttgagatgcagtctcgctctgtcacccaggctggagtgcagtggcatgatctcggctcactgcaacctccgcctcccaggttcaagcaattctcctgcctcagcctcccaagtaactgggactacaggtgtgtaccaccatgcccggctaattttttgtatttttagtagagacggggtttcaccgtgttagccaggatggtcttgatctcctgacctcgtgatctgcccacctctgcctcccaaagcgctaggattacaggcatgagccaccatgcccagcccacaataggttttaagaaataaaagctgacacaccgaatgcatgcattaacctacatatacactctctcaaaatctactaaatacaccgtaaagggattttttaaggcataagcaacaagaagaaaaggaatgggaatgaagacaacagcaacaaaactttggaagctagaaagtatatggatgaacatgaaccaacttgagaaacctgaatccccaaccagaagtggaaaaagccaagaaaacaacctgatttacacaacaaaaatcttcaaagggtttaggaataggtggcatcaggtacatctctggagataagtttgaaggtggaactgaacaccaaggaataactgaaagtagatttaagaaaatgaacctccagatattttactacactctacacagccaaccaaccacccctctcctactccagcaaatgactttggcttattttctgcagagtcaaagagaggttctctgcgatgaagaatccaagctacggttgagggtggggacaaaatactaaaatgaagaaaataagtaaaagtctacagattgaatatagagacttcttcctcagttcagctcccagaatgcttatagagaggctaaaagattagaagaatctggatgtccaacaagaaagactaaaagatgctgacattagaggaccccccaccatgtctgctcactccacagtaataagcttcacccacgcacacagagttcgcactagctttacagagcccaaccttttcttctgagtcattaattggtagagataacttattggggttcagggggttgatttaaaaattgagaactataggccgggtgcagtggctcacaactgtaatcctagcactttgggaggccgaggcgggcagatcacaaggtcaggagatcgagaccatcctggataacacagtgaaaccccgtctctactaaaaatacaaaaaaattagccgggtgtggtggcgggagcctgtagtcccagccactcaggaggctgaggcaggagaatggcatgaacccaggaggcagagcttgcagtgagccgagatcgcgccactgcactccagcctgggagacagagcgagactccatctcaaaaaaaaaaaaaaaaaaattgagaactacagaaaaagttacagatttatgactatatgaggaagtaatgaaaagccatttcatgaagcagtggtgaatcaagtttttactatatgttacctcttgggagaatagtttatactaaattacttgttttattaaaaaaagaaactatgccaaaaaagaaaaacaatataaatggtcaaatctaatatatttttggctttctttttgacaaactgtctgtaaaaatggtgtctattgttcccatatttatgaccatgtgtatccaatgtttagcacctatttataagcgagaacatgtgttatttggttttctgtttctgcgttaattcacttagaataatcgtttccagctgcaaccatgttgcctcaaaggatattattttgtccttttttatggctgtgtagtattccatggtgaatatataccacattttccttatccaatccaccactgacgggcacctgggttgatctcatgtcttcgctcctgtgaatagcactatgatggacatacggagcccaacttttaaatacaaatggacaaccaaggatcacaggacattttagaaaagccccaaacatgaaaaatgaaggctgaaaagtgaaaacctgaagagatttgtaaaataaacctaagtgttagataaactgacaaaatttcccagaaagtaaagtaaaaagatttttaaaggtacaaatggacgagcgcagtgactcacacctataatctcaccaatttgggaggtcaaggtgggaggattacttgagccctggagtttgagaccagcttgggcaacatagggagacccccatctcgaaagaaagaaaggaaagaaaggaaggaaggaaggaagggagggagggagggagggagggagggagggagggagggaaagaaaagaaaagaaaagaaaaaagaaaattagccaggtgtggtagtgcacgcctgtagtcccagctactcaggaggctgagacaggaggactgattgagtctgggaggtcaaggctgcagtgagccatggccatgccaccgcactccagcctgagcaacagagcgggaccctgtctcaaaaaaaaaaaaaaaaaaaaaacaaggtacaaatcgtgcttgatttaccatggttcaacttacaatttttcaactttaacttggtgcaaaagtgagaggccttcaacagaaactatacctatacaaccattttgtttcagtacactattcaataaattacataagatattccatactttattataaaatagtctttgtgttagattatttcaccccactctgtgatccaacaattcattatatccaacaatttattataaatatataataataataatatatccaacaatatattgttggatataataaatatccaacaatttattataaaataggctttgtgttagatgattttggctaatgtaagagttctgaacatgtttaaggtaggctagactgagctacaatagtcagtaggttaggtgtactgaatgcatttttgaattatgatgttttcagtttacaatgggtttatcaggacataatcccatcacaaatcaaggaccatttgtataatagttaattttatatgtcaatttggctgatccacagtgcccagatatttggtcaaacatgattctgcatgtttcttggcaaacatgtttttcgatgagattaacatttaaatctgtggattttgagtaaagctgattattctccataatgtgggcaggtctcatccaatcagtcaaagaccttagtagaacaaaaaatgaccacccagaagcaagaaggaattttgtcatcagactgaaatatgtattagtcagggttctccagagaaacagaaccaacgggatagagaaatctagaaaaataattactataagttacctagaggctgagaagtcccatgtggcgaaatctccacaaacacatgaaccaattccttaaaatcaatccatcaacccccaacccgtgtgtgtgtgtgtgtcctttcgattctatttctctggagaaccttagtaatataggatagtaagaaataaagcatttaaaaaaggaaagtcaaagccaggaggtcaacatcttaacaggatatccagaaagacagaacagaaaaaacaaacttgactaaatcaaataaataattcaaaaaactaccccagaactgaagaacatgactttctggattgaaagggcccacagagtaccaaccacaaaaaaaacagaaatagatccacatgaactacctgcttaacacaccagcacacctccctctaagaaggccaaaacccttactcagagtaattggcctacaatttcagcctcttttctatggagtccttcggttctggaaaatactcctgagattgatgaatagaaaagaaacaagagcaggcaggactctgggccatctgcccctgcttcatttatagaagccctgcttttacgtttcatattctagatttttggataagtttttttttactttgcatttttgcattggctattttttaattgtatctctttaaggtatataacatgatgttttgatatatatacacatagtgaaatgattactgtaatcaagccaattaacatatccatcatctcacactgttactctttgtatgtgtgtggtacaagtacctaaaatctactctcttagcacatttccagtatacaatattattaactacagtcctcatgctatacagtaaatctctgtgcttacgtgtcctacataactgaaattttatactctcgttgacctccatctgcccatttctcccacacccttcattcctggtaaccactcttctattctctgtttccatgtacttgaagtttcatttcgttttgttttgtttagatcctacaaataagtgagatcatatagtatttttctatgtttggcttatttcacttagtatcatgtcctctacttccattcatgttgttacaaatggcagtaactccttctttaaggctgaataatactccattgtgaatagagacaccacaatttctttatccattcatctatcaatggacacttgggttgtttcattatcttggatattgtgaagaaaacctctttctttttgctctttaaatatataaagagccatctctggtgcaaattccaaaagaaccgcccatgaccaagactattcctgctggatcacacctcatcctttccctagctcccaacaatgacatctagaatattatactgaattacatttcaggcctttgtggtctagcctagaacttaaatgtgccttaagatccaaacaagcagcttttaaacaaacttttggaaaatgctctctattcataaatggaagctctctgtgcctacggaatagaagcaaattcatttattaatagtccctaggtcactcataattagtgcaaaactagtctgttaactaggcaacccctgaggcttcaggaagtaattcatttatgtgtttgtttttcttcaatatttatagttgttgtcttgcacaaaaatctatctcacagagatgtctgaaatctcttcactggtcattaactactctgataaacattatttacttttctcttaaaacatataagagaactagagaaattctgaaagtaaatgagatagcacaaaaaaaagatgaaagaacactgaagataactttggtatattttataaatcttcccagagtctcggcttatagctgggtttaatgccttgacacatacatatttatcaaaattggcagagtaataaaatcaggtgagataaaaactgacatgaacactacaaatacaaacttactatagcttttttcaaaattatattcaaaatggaagcatctaactgaaaattgttactttcattgtacacaaaatgagtatatgtgtatatgggtatatgtgtgtatctctcaaatgcatcatactagcaaatttgagcaatgtttttcacattctcatttaaacataactaaagtcatcctcagtggctacctaatcagcctaattactctgggaattactattaaactagtgaaagccacacaaaagattggtgtaaactattccagattcaaataaaacatatcatttctatttttccattcacagctgccgaggaacaactacacagtcagcagctactagaataaaatcttacagtccattcaaatctaaaaagcaacactgtgcttatttaacaaacaagtatgctatttatctaccatactagtgcttagaacaaggacggggagccattttggctataaagtttagacagcttcaagatgaaggtctgagctaagccttaaaagataggtagggatatagaaaggagagggaagaggagttctaaacgaggacataaagtttgaaaattaaaagttaaaaaaaaaaaaaaaaaccctgaaaactaccatccagcaaacagttttcccaaatgcagagttcttagaagagaatgatgggaaataagattaagtaggtgaaacttacactgagaaataacagaaatatttagatagaagtacaatgatggaaggcataattttttcagtgtacatgtgcatattaaatagcaacacatataaagctcttagcacagtatctggcccataaggctaaacaaatatttgctattattgttgttattattattaactgaaaatttcaaatagtattttctgtagtttggacaactagtaaatatgactaccccgatttttaaaatctagaattaaacatttctatgtacttcttaattttatatacatgatctcaccacaaagccctcaatattactcaaaaggcacatctttatttccctgtacttcaaatcaatttctatctaaacagaaattcagcttggtctttccccaggcaatgataaccttctctgacactctctaatgctgatgtcctccaaacaggactttctgtcctccaaaaagaaaaaaccttccccaaggaacagcaagaaagaaggaagctttataatagatgaatttataggcaagtctgtctcttatctaacttctgtgagtgtccagccctgatcctgtgtctttggtttaaaagaaaaaaagccctgggtaagccaagctcagccctaggcatcctcctcttcttcctattttggccctggcttccatgaccctatctgttttctgtaatttgctacatataatgggtaaatatggaacaacgatgaagaaagcaaagattggaggggggaggttgccaaactgctctccgctttagccccgactttgatataagaaggcaggagagccaaggattaatatcagaggtggtttttcatttttcataacatttcagagcctgaaagactgtaacaagatggtgatgatgatgatgatgatgatgacgacaacaacaacaacatttcacatttatttaggctttcactacataatcgcaaaaacactatctcatattaacaagaataacagctacctggagatcaatgagtctagtcctctcattttataggttagacaacttaatgaagtcagagagattaataactttgccaagactacaaattagtggcattggtgataataacagtgatgataataatgatggtgatggtggcagtgattacgttaataacccactaaattctttgtgtgccttgtctcatttaatccttacagcagccctaggagggaagtactatatttatcttaattttaagctgaagcaactaagaatttaaaagatcaaaaaacttgcccaaagtcacacagcaaataagtggcagaactgagattcaaaaagcagatggactcaaaaatctgtcaagttaaaacactaaactacacttcctgtagttaaaattacaactcgattcttctgactctgatcctagtttaatattgtttccctcatagcctgtctcctaaatttagtgaggtatgtgttgaaatagaaatctaatacgtattgcatttattttctaatatattatctgttacccctacaagtttaatgttacagaatatagatccatctctagctgtaaaaatatactaatatatattattaagtaattagcaatagtattcattttatcaatatgacatttaatcaattttagtttttataagtcagatgcacatagtttatttcaagaggaaaaaaagtcatctcactgttatattcttgcagaagattgccctgtcctaaaatcaggattatttgtagacaatacaaagcagctaaactagcttctcttagaatttccactgtaggaaataaataacaatatacactaagttaaaaataataatgcccttgttatttataatctaccctcagggaattttaaagcacttttcatgtcgtaacagtcttaaaatgtttccaggatatggattggcaaaccaaagtactgtaaaaagaattgtgattttttttttttcttttagatggaatctcgctttgtcgcccaggctggagtgcagtggcacgatctcggctcactgcaacctccgcttcccgggttcaagcgattctcctgcctcagcctcccaagtagctgggactacaggcacctgccatcatgcccggctaatttttgtacttttagtagagatggggttgcaccatgttgaccaggctggtctcaaactcctgacctcaggtgatccacctgccttggcctcccaaagtgctgggataataggcatgagccaccactcctggcataacagtgatctaaaaatcttctatatggccatgtgctgtggctcacgcctgtaatcccagcactttgggaggccgaggcaggtggatcacaaggtcaggtgttcgagaacagcctggctaccatggcaaaaccctgtctctactaaaaatacaaaaattagccaggtatggttgcaggtgcctgtagtcccagctactcaggaggctgaggcaggagaatcacttgaacccgggaggcggaggttgcagtgagccaagatagtgccactgcactccagcctgggcgacagagtgagactccatctcaaaaaaaaaaaaaaaaaaaaaaactatgtgaagtagctccttgcacacaatagtgacaaaaatatttagcatttattcaaagagctataatttccagaactctttcaattcttaccctaatcctgagaagcaagcagggaagattacattatccccacattaaagttaaggaagaactatgattcataatggatacttgtctcagccaaaatcacagtcaccaagaggcagagccaggattagaaccttggtcttctgactcgtgagtcctatatacttgctactctacttgatctttatttcttatataaaagaatgttcagttaatgtttgacaaatgaacgtatgcaatgcatgagcaaatcacatttcatcagaaagaaatgctgaatttctaaatttcagaccagcattttgccattatataattttttctctgtaactatactttttgtttctgaagaatgaggctgtcccctcaacaagtataattatcctctagaaaagcaaattgtctttgagctgataagctgataaacagctaacacacaaaatcactaaatttttctagataaaaatcacgagttaaaaaaatagatatatcttcttagaaatataccaagaaaaccaaatgctataacttttaaccctagtttatagcatagctaaagaacaattactatataaactagacacagttttggaatgaatgaatgaagactcatttataccaagaaggaagaaaagaatcacaacacagttcacccatgatttcacatctattaagtagaaaatattatcatattctcacaactgtcagcctgtgctgccagacttcacatttagcaattatctcaacgccagctgtccccacaatttcgtttcaaatttaatatgccctagaaaatattacatttcaaaatttctagcaatttgcaaaagatagagacagaagaggcagcctctgtagcaaaggcatgtgtaggctctctgcacactgtgggaacacactggaatcctatagtggacatttgttatgtgccccccaaccctctccaggattattctgggtcttctggtacaactccaaaacctcatttagataacacccctcccccattctcagtccatgtagactggatgaggtctccttactccactcaacaaagccaaaaatgaacataagactgctgatgccaacatcagtgctttctactacattatgcttcatattacagtgacatttattgttttgtctgcctaacacaacattcccttcttatggaatggcaactaatggctatgtgatcaagctgcctgggtttgaaacctgttcccaccacttcctacccatgtgacttgatccatttatttaactgctctaagcctccatttcctcatctgtaaaacaaagattcattcacatattcaacaaatatttattgaacacttattatgatccatgcttgtgcaagtgctgagataagaatagtgaataagatagaaaaggtcaatatcctcatggagctcagatatggcagtaaacaacaataaaccaacaagagaggtgcagattataagcgccataaaagaaataaataatgggagaagatagtaaaagagtgattctagatccacttacatagaatgtgcagaatttcaggataaagaggctttcagtataaagcctctctgaggaggtgacattttagctgaaatataaaaagaaagaataagccaaccactcaaagagaactggaagatcattccaggaagagggaaagccagaggaagaaaagagcttggcacaaaaggacatctagataactgaagcatggcaagtgagaagggggtaaaataacacaagacgacatcagaaagctaaacagaagccagactgtgctgagccttgcaggtatgggaagaaattgagatttcattctaggagcgagcaacggaaatccattgaagtgctttatttaaagctttgtgtttttaaaatgttattccagctactatggaaaggatggatatggaaaagaagagtcatctattcaatatagttaagaggatggatggaagagggaaagaaggaaggaatcagggatgatttctaggttacttgggttgagcagctgtgtatatggtgatctattgattgagactacaaagattaggcaaaagtcagggttcaagaattattacatttgagatgcctatcagatcctcaaaatagctgttatacacttttttttttttttttgagacagagtctcactctgtcatccaggctggaatgcagcggcaccatctcggctcattgcaacctccacctcctgggttaaagcaattctcctgtctcagcctcccaagcagctgggactacaggcatgcaccaccacgcccggctaattgttgttgttgttgttgctgttgttgtttttagagacagggttcgccatgttagccaggctggtctcaaactcttgacctcaagtgatccaccctcctcggcctcccaaaatgctgggacatgagccaccatgcccagccctgtgatacatattaaatgaaataatctatgtaaaaagcacaatgcctaatgcagagtaaacattcaataaatgttagctattattcatgttttgagaaaaagaggaaagttccttccttggtctacccatgtggttttggtaatgactgatgactttatcttatcccatgacccagctagggcattggacaactaactggtctagatgaaaccaacaagaatcacactctcttagctgtggtgattggtccatcactcaagccacaccaacttaagttcttccctatgattttcaaactagaagctgaaagggaagttccccttcctcttcagtagggaccctgtaagagtccagggatgctgatggtaaagttcctacttctaggagaaatgccctctgtaattggagggaataaggctgatacccagagagaagcacagatgagagacagagtactagaggcagagagtgcttatttctagtaattctagggtagtgctgtccaatagaagcataatacaagccacatatgaaacactaaaaatagacaggtaaagttaattttaataatacattgtatttaaaccaatgtatccaaaatagtatcatggtaatatgcactcaatatacaaagttgccaaataagaatgatacaatggactttggggactccggaggaaaaatgggagggggggagagggataaaagactatgaatgtggtgcagtgtatactgctcgggcgatgggtgcaccaaaacctcacagatcacactaaagagcttactcatataacctaataccacctgtaccacaataacttatagaaaaattaaaaataaaaaaaaataaaaagttgccaagtgttcaaaacccagtgtgtatggtaaatttgaactcagactagccatatttcaagtgatcaagagcgatatatgactagtggctactgtgttggatagcactaccaacactacctgggctctacccaggccctttgcaggccataagccaatgcatgcccttgtaggatttcattaatttaagttggatttgtgtctcttatcccgagagtccttaatttacctaaaaacattatttcacttattccatttacatctgaaaccctaataattctttttttttttttttagatggattcttgctctgtcacccaggctggagtgcaatggcatgatctcagctcactgcaacctccacctcctggattcaagataatctcctgcctcagcctcccaagtagctgggattacaggcatgtgccaccatgcctcagtaatttttgtatttttagtagaagaggggtttcaccatgttggccatgctggtctcaaatgcctgacctcaggtgatccgcctgcctcagcctcccacactgctgggattacagacatgagccactgtgcccagcctaatcatttttttagaaatcacacacagtacattatattctgaaaattgattcaccaattcttattagcataaggactatcacctatttccctacttgagtgccaactcccacttcacatatgcactacagttaagactcattagacctctgtattccagccttgattagcacaagaaaccataatggagcatctgcaaacaagaatcaaaggtactacaagtgataactctgattgagttgatctgaggtggaatctgggactccatttttttaaatgttgtcctagtaattttgataatcacccagattcaaaactaccgagttggatcacttactaaatctaaatagcaacttctgccccttatttaccttttctattgttacaagtatttcctctgttgtatttactgaagcgcatactatattcacctttgtatacttaattcctaaccccttaatggatatacttcaaatattcaataaatatttgttgaactaaaagaaaaacttaaagtggacttttaatatgatgctatttccaatatgatatctaaaatagtccagagaagtagtgggagataataagagtactaagtttaggtaatggcctatctctccttctttctgttctaattttaattagctctctgctagtctgaattgagggtaaagggagttaattgttggattactctgactacagttacattaaaaagaaagtgccctgtggccatattaagtgccatgttgtacccaaatgtccacctgtagttagataattttgatttaattgacttcactcacatccagagaccatggaagggagtggaagtttggtcaattaaaaatcaagcattaagaatgccaactgattcctcctgagtgagaattagagaaaaggaattctaggtctgtgggcacagggaaagacataccaaagcattcataaatggctcttggttcctcacctccttcttctcttccacacacacattctaggaggttcaataaagtgctgtaatgtgttttgcacacagaaggtactcaacaaagttgtatcagttgctggggccataaccaagtattacaggctgggaggcttaaacaacagaaatttgttttctcacaattctaaaggccagaagtctgagatcaaagcattcgagtggttagttcttgctgaggcctctcaatctggcatgcagatagctgctttcttcctgagtcttcacagggttttccctctgtgtttgtcaatgtcctaatctcctcttcttatagagataccagtcatattggattagagcccaccctaataaccccattttaacttaattacctctttaaagaccctgtctccaaatacagtcacattataaggtagatggggttaggagagcaacatatgaatttaagaagacataattcagcccataacaagtaccgtctaggtaaccactctaacagaggttagatgaatccaagaatagctgaatcttgaagaggtcatatagagttatttggtttcagggatatgttaaacatgaaagatctaaaccagcggtttcaaacactactgttcaacagaatcgattatggggtatgttacaaattatgggtgttctggccacactcagaaattcttaggagtagaccaggcatctgtatgtttgcagcctggaacaaagtctggtattgaccctaaaagacatgtcaacctagacagccagcaatgaggcaagaagcaggactggcaatgaagaggaaaagacctcacgtgaataatgtagtgatctgtatcgctacattctcttcatcattaagtctctgttacccaaaattcactctaataccatattactctctttgtgactttgtccaaacaaagtcttcccaaagacgtaatgcacaatgagaagtctatgcttatgatatttttcagaggagggctggttagaatcacaaatgatgatcatttacttcacacctaatataactcattctccgctgaacggaatttggttgattgactgatttgtttaggccaatggattcaaggaagtgggccatattcatctcatcttcttctcctttaagctgcctctgggacaagttgacacacattttcaccactctctagtctcatggttgattaataatatccgtataattatatttcatcctatcattaaacagtactggattcaaagtaaaactcagtgaaataatttggcacaactgcttttaaaaattatatttttgtattttctccttcatatgcttctttattctatctctgccttccattcaacaaatatttattgtagtgccgggagtatgggaatataacaataaataaaacatagcctctgcccttcagaaaagtaaagtctagaaaagaaaaaaagatgtgtaaacaaataaccacaagagaatgtgccatattataacaaagatacacataaggtcccatggagcacagagtagagaactaacattgcctgaaggcagagcttacacacaaactgaaggatacagtcaagtatccaggcaaggacacaggacaagaacaggcattaaagcaagaaaatgcaaggcaagtttagggaacagaaaatactcatgatggctctaacaaaaggcttgtaaggttgggactcatggtgggccttccatgctacactaaataaccagcactgtcaggggaagtcactgatagttttttaagcaccatcagttctgtgtttaatttcccccaggcataaaattttcctgaggctgtctgctgctccccactccccagcgtgcgcccctcttccacagccccatgccgcctgtgctgtagcaatcagaagtacttactgttctctaaatatgccaggcatgttctcactgactgctaatgtcaaaagcatgacttgaaaaacatctaaatgcatgatcagaccagtgatagcaaccctatggtggagttttcaacagttaataaggggagcaatattgaatcattccagttctctatattttgtcatttgctgttcctgctgcttcatggaaaagggttatattttctctgtaaatagaacttgatatatcttcataaccgtcagcagggatggacactgtgctacttcccagcaaaaggtgaatgaaaagtgatagcagttaaaatggtgttctttgctgtttctctgttttgttttcatactcttcttttaaaatcagactgtaattttaacaaggtggcaggtaaagcattcctttttgcttttaatgctgcctggaaataatttgttttctcctctccagagaaattcttaaaaaaaaaaaaaaaaaaaaaaaaaactgtaaaaacctgactgttctgatacaaaccttgttaataggatgttcaccttaaaactaacccaaaagaggaacaagtaaagcaacatgataacaaatcacagaattttagaaaggactaagagcaaatgtagtggtgtggttaaaagctatggttcctttgaagctcaaattaagaagaacctgctagtactgatcatctagcatcctaagtgggaacatagcaaatagacatagaattataaccctaagagttgaaatcagaataatagcaccaatgaactcctcaaatcattttttaaaggaatatatttgtgaggcaatgcaagtgaaaattacataatatacagttactaaattcctgagagttctatttttgtttattcaatatctactaatataaggacaaaaatcattgctaatgatcaaaagagcatagcaatcattatcaaattaagaggccaggcatggtggctcatacctgtaatcccagcaatttgggaggctgaggctggcagatcgcttgagctcaaaagttggagaccagccagggcaacatagtaaaacccatctctacaaaaaaatataaaaattagccaggcgtggtgatgtgcacccattgtcccagctacttgagagtctgaggtgagagaatcacccaagcccggggaagtcaaggctgaagtgaaccatgatcacgccactgcactccagcctgagcgacagaaagaaaccctctccaaaagaaaagaaagaaaaattaattaagatgtgattcaatacattttttccaattctttaagttattaagaagccaatgtcaatctctcatccactgcaggaatctcctagtttccctaatatacaacttcggtctctgctgaaatattaccttttttatcgtaaatacttaaggtatacaacatgatgttttgttatacatatacatagtgaaatcattatcacagtcaaacaaattaacatatctgtcatctcagataccttttttccccctttggtgataatctactctcttagcaaatttctagtatacgatgtgatatcattctgtacattggatctctagacatgctgtacattggatctctagacattcatgctacataattacaactttgtaccttttgacatacatctccccattcctgtccctccctccccaccccaggccctagtaaccaccattctactctgtgtctatatattcaactttttttttagattctgcacataagtgagatcatgcagtgtttttctttctgtgcctggctttttcactcaggatactgtcctccaggtttatccatgttctctcaaatagcaagatctccttttttaaggctggacaatattccatcgtgtgtgtgtgtgtgtgtgtgtgtgtgtgtgtgtgtgtgtgtgtgtgtgtaccaccatttctctatccattcatccatcaacaaatgcctaggttgtttccattctggaccatggtagatactgctgcaataaacatgggagctcagatatcttgacaaggtgctgacttcatttccgttggatacatacccacaagagggactgattgctgagttatattgtagtcttatttttaattttttgaggaacctccactcagttttccatagtggctgcactaatttacatacaaaagtttcctttcctccacagtctcaccaacacatctctttttggtttatttctgaactctctattttattccatctgtctatgtgtctgtttttatgccagtaccatactatttttccatattataactttgtaatatagtttgaaatcaggaagtgtgatgcctcaaactttgtttttctttctcaagattgctttgcctatttggggtcttttatgtttccatacaaatattttctatttctgtaaaatattacctttgcctcttcttttcctttcttcccatgtcatagttccctttctttttcttccctcttctctctatgcttctcattctagatcacatttgggtaatgttaggtacatgtatatagtgactatttctcctggaagatgatttagactacaactacaactataatcacttagaaaagtgtagaattcctctgtccacctagaatagagctgaatttgttcatattccattccaaacacagcattctaggaaactatgaagtattctgcaagctgtaaaaagatccatataatagaatattatttgccattaaaaaggaataaagggccagacgtggtggctcacgcctgtaatcccagcactttgggaggctgaggtcaggagttcaagaacagcctggccaacatggggaaaccccttctctactaaaaatacaaaaattagctgggcatggtgccccgtgcctgtaatcccagctacttgggaagctgaggcaggagaactgcttgaaccagggaggcggaggtcgcagtgagccgagatcgcaccactgcattccagcctgggctacagggcaagactccatctcaaaaaaaaaaaaaaaaaaaaaaagaggaataaagtacagatacatgcaataacatgggtgaattctgaaaacatgctaagtgaaagaagacagtcatataggccacacattgtatgattccacttatatgaattgtacagaataggcaaatctattgaaacagaaagtagattagtaattgtctacactggggagatgggaggaatgggaagtgactgctaataagtacagtggcttctttttagagcgatgaacatattctaaaattagactgtggtagtggtttcacaactctgttaatatattaaaaaccatccaattaaaaactttaaataggtgaacattatgagaattatatctcaataaagctgtttaaaaacatgtatctaacgcaacagtctatgtgtacacacccataatatatgcatatatatacatactcatttacagagagttctgaattatcagcctgcagtttatccactgaaattttaaaattcaaaatttcttacttccttgattgtatgagaatggtaataataacaataatgacagcaataataatatcaagtactcatttagttcatactatgtgccagctattgtgctaaaaatacgtaatcttattaaaaccttacaaagtcaccaaataatagagtctgttactaaccattttaacatattattttttataatcctcacaacaagaactacagtttttctcaatttatgagaaaactgagatttagggtggtgaaataaatcattctcggttttacagctagtagttggcagagcaatgatttaaactccggtcactgcactctgctgccacttgagctatccctctgtaagggcaattgagtctcagtgagctaaaagaatcttacattacttttgcagacaggcatctaacagagtaggaaaaatcccagaaccaaaagctgaaacccagaccgcagtctgagtcatgatacaaactaaccaggccagccaaattccaatcctctcatctacaaacatggaaattggaatagaaatttttcaaggtcctatcagcttaaaagtccatttgtccaagaaaaacttacttaaaaatctgagtcttcagtccaaaataaacttgccagaagaaatgctttctttattttctgccctatgagtttacgactattattaggttgtaaaaatattaagtataactggaaactgaaagcataattaacatttacttataaagttcgatatcacccattagcaatataacacataatgatttattaactttttactataaaaacttttaaacatattcaaaagtagacagaatagtattaaaaaacccaacgtactcatcatacacctttaaaaatcgtcaactcatggtcaaatttgttccatctatataccctcccactttgaagaaaatccatggcatcataacatttctgtaaatatttcagtatccatgtgtaaaagataagggttcccttcttaaaagtataatcatgataccatcatgacacctaaaaatattaacaataatatcttaatatgacaaacttggaaaatacatttagatatataaatggcaataaataatacagatttaagtaccactttcactgatattaaaagataaacctaggcacattaaaattttaaagagtttatttgagcattcagtgattcatgaattaggcagcaccagactgcaagtgatttgggctccaccaaaggcgtgcaagggaaaacttttataaggtgtctgtggaagcaggacagagaaaatgtttgatttattaaagtggagagtccctacttagaggtaattggcagtgtctggtaaagactctagatagagattcactggtgctttctgatttgttaaacttaagtttcatttcactgttttacagtgtgtttactgtttacagtgagtttggtttcagtttgcttacataggaacccaaagcactacctaatggtttcccaatcaatttttttttttttttgagacagagtctcactctgttgcccaggctggagtgcagtggcataatctccactcactgcaacctctgcctcccgggttcaagtgattctcatgcctcagcctcccaagtagctgggattacaggcacacaccaccacgcctggctaatttttatatttttagtagagacagggtttcaccgtgttggccaggctggtctggaactcccggccttaagcaatctgcccgtttcagcctcccaaagtactgggattacaggcgtgagccactgcacctggccccagttaatttttttaacactgacaaattttactttgagtgttaaggctatctgtatattcaaattttccagactattatttctatttgaatacattatttatatatataatctattatatctatacctaatgtctctgtactctattcatgaaatgtcatatggcactatactgaatgtgtccatagaagtagagtactaaacattctatatatactgagcttattagttttgtttactcattgagcttgcctggtattgaaaagaaattaaattagttaggcatggtttgtttgtgattaacctttcctgtcttccacagttcaatttatcatcctcttcgtgataccaaatgactactttatgaattgttccacaaatttgccagctattattcacgagctacatattttatccaactgaagtgtttattctgtgacccttattttcatataactctctataaccattttgcttctaccatacttactctcacattccttccctagcttgccttgccctccaaaacaaaaaagcttccaccatgaaattactaattgatattctgccttataaactttgccttgaaagattcctttgaaaaattaatttcatttcctcgatctagccaatgataaaataatgatgacagcaaacagaagtagaaacagcataattttttaaaaaaggaaacatcaaattttgtattgaaaatttacatcagcatttcactagtgaacagacatttcctctgagaaagagtgataattaccatttgcacctcatgtaaggattttcctgaggcctaagaaagctataaataatatagtttcttttgaaataaagaaaaaaaatttaattttctttcatcacgctaacaagaagtaaaataggttgcaaataatggtgtagtaaatggattaaagagattagcttcaaaataactgcactgcaggacctaaatgctgaacttgggttatccaggctaaataaaggccagtcatcatcttatttttatagttcaatcataagttagggcttatgggagtaacgcaattaagaaaatatatatatttgggggagttggaaaagtttggaaaatttcaaaaatcaaatcacatttcaaatggattaggagaactcactaattaaaggtggatagatttcatactgttaaaaaaaaaactcaaacaagtaaaaaaaaatttatgattaaccaccaatacaaacaataggcaaatttattagtttctctgctcttgctttacaactgtaacctttataacaaaccctgttagaccttgtaggagaccctgttaatgcccacaccatatccccctgacttgtctgtgagttctcttccactgctgtggatagtcatgctgatgctgacagcttcccacctaaaggacccacagttctttctccattttctctttattcttcctggaaccaccttgcacatacactacccatgcctaagtccttacaccagggtctgcttttggggaaaaccctaataagactgttggtaatagaaatagcactagaaagcagaccttcagaatgagattctggaattgcattacttgctggtcagagggcagcaaggatccaatttctagtgataagtgagtggtgataacccctaacaggctacagcagtataatgcccaaaatttttaactgaggtggactgtaatgtgttacaggaaggaggaagtacaagcttatataatagctctaatacttgaaagacatgtggtaatcaaaacaaagattttggagtatgtgttaactactcgagaagctttgaagaatgagaatggcaggcttgggtaagccatctatcaattcagggcatgctgtaaaagtcagaaaaactccatgtcagtatttaaaatgaaccttatctctggcactcagctaacatactatactgaaatcaggcctaagatttgatgaaggagcttagctacaaagacaactaaatgcacagccccagcaggtctcccatcagggctctgatagggaaagggggagggtggtgatgcatgggagggtgatatttaggggggtgtacatgagaccactaaacactcaaatctgctgaaacctctgggccggcagaatccaccctcatccctttcataaaggtaagccacctctaattgcatggagacctggcaaaggacatacctgacgggggtgccttcctccagatctgcccttcatctttcattgcctctagaccagtaactagggtcaggtcctactgataaaagctccaactgtaaggcgcagtggctcacacctgtaatcccagcactttggtaggctgaggcgggtggatcacctgagatcaggagttcaagaccaacttgaccaacatggtgaaacctcatctctactaaaaatacaaaattatctgggcatggtgatgcatgcctgtaatcctagctacttgggaggctgaggcaagagaatcacttgaactcgcgaggcggaggttgcagtgagctgaggtcgcaccattgcactccagcatgggcaacaagaacaaaaagctgtctcaaaaaaaaaaaaaaaaaagctccaactgtgaagggcacaccttcacattggtgggaagaatatgggaagaaatcacctattcaccgaaaaagtcagctgagcctatctgacatgtgtcattagaactgagagcacacataaggacgtggatgttgagggtgctgagctgaggcatggggaaagaatgctagatagaggagagtgctttcatatggaggcaatctctggtgattcataatttaatttgtagcaaggaaatcataagtaggtcctaaaacactaatgggatgtcaatgtgactgacaggattccaaaataacaggcatcagaggtggcacttagccatcagaagcaaggtgaatgcacgccattaaaggtagtaaggtcagagcagtaaccagagagcttgacctgcaggggtctgtggcaatggttgataagtcattagccattttgtttatagaagcaaaagagatgggtaatgtatttgttgctagggctgctgtcacgaactaagtgacttaaacaagagaaatttaccgtctcacagttttgaaggccagaagtccaagatcaagacattgttggttccttttaagggctgggtgaatctgttccatgactctctcctatcttctggtggttttctggcattctgttgcgttcattaacttatagaagcatcaccccaatctctgccttcatcttcacatgacattctccttgtgtacatttctgtgtcaatattttctttttgataagaataccagccacattggattaggggcacaacctaccccagtatgatctcatggttactcattacacaattcaacctatgacaagtagttaataaggttaattttttatttatatttgcaaagaagaccaagaactaaacagaagatcgatgttccttttctggatctaaggcagttctcagacccagagcccatcaaggggaggctaagtcctcttgagcgaaagagctaatgtttctccaataattctttaaggggaagtgctgccatataacagagtatatggcaccatatgccagtatatacactggtgaaagtggaatacccaaacctttcagggctattggatataggctctaagctgacacttataccagggtatccaaaatagctttgtggtctcccagttagagtaagagcatttggaagccagataataaatggagccctgactcaagtccatctcaccatcagcccaatgggtctccagacccaccaactggtcacgtacctggtccctgagtacataattgagatggatatacttagaagcagctagaatccaaacactggttctctgaactatgaaacaagagccattataatagaaagggacaaagaaagcccctggtatcacttctgctctgtccctggcccaaataataaatcagaaagaatattttggccaggtggaataacaatttgtgccaccctcagaatgcttcctgcaaaaaaaccatacggctcatggatgagtcagctaaatacgttggtgcaagaggaaaactactgtcacactatagcccaaggcaaggatgaactactgcaatgttactcaaagtgtaatccatagactagtgccaattcataaatttatttttgtaagtcgacaaaataattattaaaagtgagagtacatatttggaaacattagagcaatttgacattgctgtaataactgtagttttatattttacaaaaagatcactcatgttgaactgaaaacaaacccatatatagttccttcacatgatcagtttgagtagcactgttctaaaggacagtggtgaaaggaaatccatcaggcagagcttcataactttacatgaagaaagaagtggtttgaggtgagaacaatatcaattgttgggcaggggctagtggttctgctaattgatcagatgcctggaagaagcaatacttcatgatcagatacaaggaggtctgagaaggaggcatgtggatgaccctataggtgtgaatacctaacaaagcatctatagtagaggcagcattgaacaaccagatggaaaagatgacccatccaatgaatgtcagccaatctttgtcctcagccatcacaatggttgcacagtggacatggaaactgactagccataatgtcagggatggaggctatgcatgggcataaaagcatatactccctctcaccaagggtaatctagctattgacagtgctgaatgtctgaccaataagtactggcccaaagtggcccctcaatacagaaccatccctcaaaaaagccaatcagacatttgtggcaggttgattacatcaaattcctttccaccttggaaggcacagcaattcatcctcaatgggcctgatggttattcaaacatgcttttgccttttttgcctctgccaggtcatatttactagcataggatccaccagtctcaccttttatggccattctagcactccatcaagctgatgaaccactagcattccatcaagctgatggccaaaaggctcagctttagaataactgtctaaaggattggtgccccatcctcttaaacagaggtccccaatctccagcctgcagagaggtaactctccatggcctgtgaggaaccaggctgcacagcaggaggtgagcagcaaggaagcaagcattatcgcctgagcgctgtctcttgacagatcaggagtggcattagattctcataggaggtgaactctactgtgaactatgcatgcaagggctctaggttgcatgctccttatgagaatctaatgcctaaggcagaacaatttcatcctgaaaccaaccactctccccatcccagcctcccacctctgtccatggaaaaattgacttccacaaaagcagtctctggtgccaaaaaggttggaactgctgctctacagcgcagtagatgagtcaaaccaatgatcattacacgatgttctgtccccttagcatgggtgtgggaactaaggggtagaagtagaattggcagcactcaccacttaacccacttgggaaatttgtccatcctcagtagccaagttgggtaatttgtacttcccgttctctcaacttcagactctgtgggatgtgataccttaacccctatgagtggaacactttcaccagagagtaaattactttcacccaaaccctttattttggtgcctgatttaaaagagaatctgagttaactttaacacagttagatacaattattatcaccttatattgaggaatgaggcacgaggaagtttaagtggaccagggtcacacagctagtaagtgatagaatcagaacttgaccctgggcagtctcatctagagtccttgctttcaacctctactctaaattatctgtttttaaagttcatgtttttgtatttagttgtcttggagcaaagcattcctatattattttatgtttctaaggcaggtgtggctagcacctctataattaaaataaagttcaattaaatctgaacaagtattatttaatatagttttttattattttaatacaggtttcaatgtaatcagacagtaacaatgtctagctctgtcttcatttagcatgtatctataaacacgctccttaaaaacatacctaaacacacacacaaaaaaagatgtctttataacaaattttcacaagttatgcatttttgaacaacagttaacaggataagttcaaggtaacagttgccagtgattttcatccctaggaagtaggtaaatcaaccaggctaggagttttcaaaaataaacataaactcctttgtactagctaatccttatcatttagcatcacctgtccttcagctggccctatgcttgaggcatcagaatgaagccctgggaactagtattcaaatcacaattattttaaagtttacaatgggcaatttcctaaaagtgatatgatagaaagagtatgaattctggagtcagacaatcccagttttgcaacttacctgctatgtggcctaggacaagttatttaacttttggatcttcagttttccaatatatagaatgtggaagaaaaaaagattgaagtatgcaaagtgcctagtgtaccatctagcatccagcagctacttaataagtaatagtttccttcttcataggtattattaattaattcatgtttacataattacttgcaactaaaataaacaataaataatgtagaaaatcctaagggtcttataagtttagatggaaataaattggaagcttgcataaacagattaaaacacagattcacaagaagaggaaataacaataatagattagaaagcaggtagacccagccataggaaagaaaacttaaatactactcagcaatatctccaggataccatcagaactgttttggtcaccccataggggtagacatggatatccactgctataattttgcactgtactaacatggtagcctctagccacaggtggcaaattgagcacttgaaatatagctagcccaaattgaaatgtgctgcagagttaaaaaaaaaaaaaaacctggatttcaaaaacttggcatgaaaaaatatataaaatatctcattaaaaatgtttagattgattacatattgaaataatatttggatttattgtgttaaagaaaacattgttagatttaacttcatttccctctttttactttctttatggtggccactagaaattttaaatttacataagtggtttgcattttatttccactggacagcactaatgtgaggtcctaatttaacttgaacagcactgatgtagagtcctcattcttaggctcccatgttcttccctcccagtcttccattctttagcaaagacttagcactacagtaacaacaattttcattcatgtccctgtatgagggccccactatcctggatgcaacacacggatgatttgccacaaatagtctttaaatgatttataaaatatataggaatgaataagcggataaataactcccagcgaaaaatgtccctcaaggacaatattcacataggcaagactctgtggtactttctaacacactttaaaaggaacattattttaatatgcactatccattcacgacattcaagacaagtgaaggttagctgtctactagaaaaaataaaattttaaacttgaggcatttattcatataatcaagagtctaggaaaactgcctgaattagtcaaggttctccagaggacaaaaaaaaaaatgcatatatacatatatggagatttattggagaactgactcacaagattatggagactgaaaagtccaccaatgattaattcattcattcatactttacatagtttaaaagtccctggcatcaagcagggtacccaggaaagccggtggtgcgattcagaccaaatctaaaggcctgagaactagggaggctgctggtgtaaatctcagagtccaaaggagttcaaaggcctaaaggaggcgctccatgtccaaaggcaggagaagatgtcccagctcaagaacagaacaaatttgcccttcctccactttcttgttctattcaggccctcgaagccagactgaatgacactcacccacatgggtgaggacaatcttctttactcagtcaactaagtcacatgttaatctcttccagaaacacactcaacagacagacctagaaataatgttttaccacttatctggtcattctttagtccagtcaagtttgacacataaaattagccatcacaccacctcaatcctctacacaaatttggctgaaactagcttgataagtctttctatcagaggcttcagtggaaaaactgaccaggtgatatggtttggctctgcatccccacccaaatctcatctcaaattgtaatccccatgtgtcgaggaaggacctgtaatccccatctgtcaacagaggaaggtgattggatcatgggggtggtttcccccatgctgttctcatgatagtgagtgagttctcatgagatctgatgcttttataaggggctcttccccctttgctttctctgtctctcctgccgccttgtgaagaaggtgcctgcttccccttccatcatgactgtaagtttcttgaggcctctccagccatgcagaactgtgagtcaattaaacgtcttccttttataaattacccagtctcagggaagttatttacagcagtgtgaaaatggattaatataccaggcaactccacagactctgggtatcttcttcaagtgtttcacaaatacagtttcccaatctttacagaacatgagactccaaaaataaccaaattctcacttcccctgctcacactccccccaaaaaatctactcaccacaaacaaagcaatctaatctgatagtagaaaaatcaaaattaatgaacagaaaaaaatctgttttggagataaaaaccagagaaccactggagaagatgacataaacagtgaaagatcacaggatggcttttcatcttcataactctgccattagtaaacaacacacactaatattttgcttctatgaaaatctcctgtataaattttcaaggaaaaattagtaatataaaaatatgaaaaatataaacttttttttttacttcgaaagtttttaatctcttagacaagtataattacagcaagcacttttctacaagtaactttaagctaatggacatataatggataacaataagcatcctagagtcaagttacctgggttcaagtgccagctctgccacttaggtgctgtgtgaccttgagaaaatcccttaacctttccctgctcagtttcctcctctataaaatgtggataatagcagctacctgagggagttgttataattaaatacattaacatataaagcatttaaaacagtgcctgacacatagcaaaatctaaataagtggtacttattattacaaatgaccaaaaattaagtgacagtaattggtacatctaatctcacctaaatgtcttttcatttaattgatgactgttctcctcactaaggacttctttaattcttccaacaggtgataaattgttactaggtttaagagccaaaggatacatattaaattttttgcaagactcaataaatatggttttatagcactaaacacttctaacaagagtaggaaaaaaaacatttcaggaaaaacgttttgtattaagaataggaaagtcaacagattgataccattaataccaatggacataatacttaaggcccaaaccacaccatattccactagcatttactaagtgtcaattgtgtgactggtgtttccaagatactggacatacaaagaagacaaggactctatccttaagggctcagggtgagtatacaggcaatacacaattatgttatgatgtaaactatggtttgaatgtgtcccccgaagttcatgtgttgggaacttaatccccaatgcaatagtgttgagaggtgagaaattcaagaggtgattagggtatgaaggctctgcccttctgaatggattaatgacattaaggtaggaatgggttactcataaaaagaataagttcagcccctcttaccccttttaacttccaccatgagataacacagcatgaaggccctcaccagatgccaccccttgaccttggacctctcagcctccagaactataaaaaaaaaaaaattcttttccttataaattacttaatctgtggcattctgctatagcaacatgaaatggactaagacaatgtattataacagaagtatgagcaaagtgcattacaggcaaaagaagaaatctgaacaaagccaaagaagcatgaaactgcatagcatatttggggaatggtaactcacctaatatggcttcagcattccatcaagaccttacattgctcttgttttttcaaacattaactacctgtcatgtgcaaggcaccaaagaaacagacatgtaatccatagcctctgggaaggtaatatctgtttcaggtgctaatgtataaatagaagttagctgcaagaacaaaggagtaagagcattctaggaaggagaaatggcatatgcaaaggcattctgagaaccaggaagagtttaacaagtctaaatccacgggaggatcccaagataaaggcagaggtgggatcattagatgttttggatgccaggcttttataacaaaagtgactagtaatcactaaaggatttaaaataagatcatgaccagatctgtgttttaacaaagcccttctgatagaaggccagtaaggagtaatccaggaggtaaaagggataaggaaatagcattagtgatggtgacagaaaaaaaggaaagaacatattcaagagggtcttcgatgagaaaatttggtaaaagtaaggaagaaggagattccttggatggtgccttgagttttttcctaatccctctatccccctagtagaaacatcttctcctttgaacctattttatttctacgttagtggacttttaggggggtacctatttattcatgtctccctcctcctactggtaaactcattatgggcagagactgtgccttatcccccttatattcttagcaggaccagaactagggtgaggagagtgaggcattcaacttcaggttcatgctggtacaaggttgaaatctgtttctatttaaaattttcatattttgttcatcacagactttttgcatacattttgattttttaaacattaaattaaaatattgtatattatttaatactttggcacactcttaaattttatacctgtggcaagtacctcacttacccctagtcaaagacctgatactcagtgtcttcctgacatagtacctaacacaagcaggtacttaaatgcatgttgaatgaaggaaaagcaaacaagtggcataagcaacaagatggatggtggtgggccttttacagagacagtgaatacaggaagagcaaaagactctagaggaacatgagtttataatgcatgtcagaagcactgcttggtgtattacagattaatttattattcaacactggaagcatgtataatggaaatattaaaggatgacattactcaaggaattgttctcaagatatttccccattctctttttaaaacttacactaatatttgaggtattgcagcaatatctaatttcttagttcagcttttaagttaacatttcttaggatgccaagatgagatgcttgttacatatatgtaccattaacactgctatggtatgaatgtttgtgttcccccaaaattcatatgttgaaatcctaatccccaagataatggtattaagaggtggaaccttttgggaagtaatcatgtcatgacagcaaagccctcacgaatggcattagcacctttattataaaggcccccgaaaaatgacttgcatcttccactatttgaggacacagctagaaagcaccatttaagaatcagagagagggccctaccagacacttcccaatctccagaagtctgagaaatgaattgtttataagccactcagtcaatggtatcttattatagctgcccaaatagactaaagacaaacacagtctttgatatgacttcatcaaacggcacccacatcactctatttctgtatccttgctcacttttcttcatagcatttatcactactagatgcagtataagttagttatttttcttccccctttaaaaaagattcactccatgagaacacagaatttttctgttttgttcatagttgtatccccagcacctagaataaatgccattgaaggtcatgacaaagagtgcgagggtggctgggggctggcttacactggagcagaaataagacaaaaaaaataaattaaaccctctgtggatacaaaactagagctaggcgctcacaagaatttaacagaaagccctaggagccaaaaacaaagatgcaattgcaaaccagagcaataagcttgggagcttacctgtagtcaccttgggaagtaaccagtgggcttgggtttaatagcctttggccagatgagattcaaatctctggataaagctgataccctcaaaggattacatacttggctatcactggcataccagaagataaaaggaaacttgcatttctcagcctgggctccgggaagaataaaaaagtctccctgagaattcttaaatatgacctagcctcctatctttggggctttaaatttataccacccagatggtcttggactcccaagccaagaaagtatatagtggttctgggtgtgatagttatcaatgtattttctcacagctcccaatgcacccttctttgtcttgctttatatattggagctggaccctacgagcattttcctttgacttctggctcaatgttaagcttcgtcaaaaggagggacaaggctgatcagcccattgaaaaaaaggtaagtgattccaaacaaactagttttacttattaaatataataaaacataaaatatttgtttctgaaaacctaacagaaagttaatacatagaattgtcatccaatatgaacatttccaatggtagggctggccttaagtcaagcttaatttttcatatactgaaacattacccatctaacatttgaacagattttttatctgattctcatctaactcaatagctgttatctttgaagatttatagcctcacacctaaatggatagcttttaagtagttttttaggccagtgggccccagattcatttatcataagattggttgcctatatatcccatttcacattccaaatatcttcccattttatagaatgataaagggttatatgcattttggatatagtaagaatgaaaatcattgagaaaaacctgggttgccaatttatatatttaatgcttatcagttaaactttaacttgctctatagtaactttaacttgcttatattaggactgcaaagtacaaaacatactccaacccagattctagcaagtaccaccttgcgaaggttaattttatctgtcaatttaaggtccccagatacttagtcaaacattatttggtgaaggtgtttaaatcggtagactgagtaaagcaggctgccctccctaacatggtaagcctcatccaattagttgaaagtctggatagaacaaaaaagttgaccttctcttgaataagaaaaaattcttccagcccaactgcctttaaaatgggatatcagttttttcctgccttctgacttgaactgaaacatcagctcttcctgggtctcaggcctgctggtcttcagaatggaaccacatcgctggctctcctggatctccagcttgcagatcttgcatcctgcaggtcttggaacttgtcagcctccataatcacacaagccaattccttataataaatgcctttatatacatatgcacatatcctattggctctgtttctctggagaaccctaatacacactgcaaatgacctcttattaactcctgctaaagcatcccgcctaaatagctacaaatgttccagacctttccctttctcctctcatttcaaaaggtaaaagtattgtgtttactatcttgtcttctcattgtccccattcccccatgctactaccttgtggaaacacattcctaccccacctctgtaattctgtggttagaacatgagctttgaaatcctgcctaccctctggattacagttgtttggctggatatcctccaagctgagccaatcagaagccataaatgtaaattagatttttgaaatttgtatttagaaactgaaagagagttgattgaagtccctctctgccaacaaccatgtgtgggagttaggcctaagaaaatgaaggagacacactgaaacagaggtaaaagctgaaagaaaaaaaaatagcatcctactgatacctaattccctcatttatacctgaagcttagcctcaccctgtctttccctgacccctttacagtagtcaataaattcccttttggcctaaactggtttgaattaggtttcagtcagtcacaactagagaagacacagtaaattcctactgcatgtaaatcattacagaaatctgtgaattatattaaaaataaccaaacttagttattcaaatgttttctaaaatctgtttgccataaattgatattattcaaaaatatatatatgttccatatttgtcctagaaacattaacattgaagctacttaaaatgcaaagattgcctaggaagaatgtctctttgcttgtttttacaagggacttatcaaattagaaagcaaaattagaaatcataatgagttccatgttctctggtgaacactatgaggtaccattaaaaatgttatataaaccaggagcagcggctcacacctgtaataccagcactttgggaagctaaggcaggaggatcacttgggcccaggagtttgagactgcagtgacttatgatggcaccactgcactctagcctgggcaacacagtgataccccatctctttaaaagaaaaaaaagaagaagaaacaagaatatgctgctttaagtttgtactatttttataaattaattttaattttaaaaaacactttaactgctatataaaaataatactataactaaaaatattgtaatctgaatctttaaggaaaaccatacaaatttactaaatgaggttatcattaccaaatatcttcttggcacttttaagttttaaattgagtgttttcttagctggttgaaggctgaaattcattatcttcttatagaactcttgttatatagaaaacacttaattatgaagtagttattcatacacatgaaagataaactggtcctgaatttcctcctcaataatataaatgttatcctaagaaacaggaaaaaaatggtggcttgggtaattaaaattcagagataaacacaatcttcagtacccaaattcaattgaattcaaagtcttcaaccacctattattttattttattttattttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcctggcctcacctattattttataaagctgctgacaaatattaaagttttaatagttgttttctctaatttgattgcccttatagattttcctgaatgatgtgctaagtagcataattgtgaataagcagaaagtaagagagaatataaaaagctaacacacatatacacttcaaaaacaaacttgatgagaacttagtcacaaagggtataaaccctctcaggatcgtaactccaggtgacttttctttttcactcttactaattttaccaactacgaaagggaatcagataatcctagaataggtaagagaggaaaagcaggcttggaagtgatcaacagactctatataaggccactaaaggaactagggagtgataagtaaactagttagtagaagtattaataaaaatttcaggccccagaatcatgctcacagattggaaaggttagatttttctgttgctttaatattatacaattgcaggaaatattataagcttcatttgtccaacagcatcatgagaacaggtaatgaatacaatatttcaggttcagctcacagaactaattttcataaattcttatataagtgaaaaacctcttatcctattgcaatgttctcaatctcattgccattaagactcttcacacaataaccactcagttaagagaatgacagagggattttttttcatgtgttttttggctgcataaatgtcttcttttgagaagtgtctgttcatatccttcgcccacttgttgatggggtggtttgttttgttcttgtaaatttgtttgagttcattgtagattctggatattagccctttgtcagatgagtaggttgcaaaaattttctcccattctgtaggttgcctgttcactctgatggtagtttcttttgctgtgcagaagctttttagtttaattaggtcccatttgtcaattttggcttttgttgccattgcttttggtgttttagacatgaagtccttgcccatgcctatgttctgaatggtattgcctaggttttcttctagggtttttatggttttaggtctaacatttaagtctttaatccatcttgaattaatttttgtataaggtgtaaggaagggatccagtttcagccttctacatgtggctagccagttttcccaacaccatttattaaaaagggaatcctttccccattgcttgtttttctcaggtttgtcaaagatcagatagttgcagatatgcggcattatttctgagggctctgttctgttccattggtctatatctctgttttggtaccagtaccatgctgttttggttactgtagccttgtagtatagtttgaagtcaggtagcatgatgcctccagctttgttcttttggcttaggattgacttggcaatgcaggctcttttttggttccacatgaactttaaagtagttttttccaattctgtgaagaaagtcattggtagcttgatggggatggcattgaatctataaattacctggggccgtatggccattttcacaatattgattcttcctacccatgagcatggaatgttcttccatttgtttgtatcctcttttatttcgttgagcagtggtttgtagttctccttgaagaagtccttcacatcccttgtaagttggattcctaggtattttattctctttgaagcaattgtgaatgggagttcactcatgatttggctctctgtttgtctgttattggtgtataagaatgcttgtgatttttgtacattgattttgtatactgagactttgctgaagttgcttatcagcttgaggagattttgggctgagacaatggggttttctagatatacaatcatgtcatctgcaaacagggacaatttgacttcttcttttcctaatcgaatatcctctatttccttctcctgcctgattgccctggccagaacttccaacactatgttgaacaggagtggtgagagagggcatccctgtcttgtgcccgttttcaaagggaatgcttcatcatcactggccatcagagaaatgcaaatcaaaaccacaatgagataccatctcacaccagttagaatggcgatcattaaaaagtcaggaaacaacaggtgccggaaaggatgtggagaaataggaatacttttacactgttggtgggactgtaaactagttcaaccattgtggaagtcagtgtggtgattcctcagggatctagaactagaagtaccatttgacccagccatcccattactgggtatatacccaaaggattacaaatcatgctgctataaagacacatgcgaaggtatgtttatagcggcactattcacaatagcaaagacttggaaccaacccaaatgtccaacaatgatagactggattaagaaaatgtggcacacatacaccatggaatactatgcagccataaaaatgatgagttcatgtcctttgtagggacatggatgaaactggaaaccatcattctcagcaaactatcacaaggacaaaaaaccgaacactgcatgttctcactcataggtggaattgaacaatgagaacacacggacacaggaaggggaacatcacacaccagggactgttgtggggtcgggggagaggggagggatagcattaggagatatacctaatgctaaatgatgagttaatggttgcagcacaccaacgtggcacatgtatacatatgtaacaaacctgcacgttgtgcacatgtaccctaaaacttaaagtataataataataaaatttaaaaaaaaagagaatgacagagggattaccaaaacagaaagggtacacatgctgatagtaatatccaattcacaaatattcctctacgcagttctaacccaggaaatatgtcttgtaattatgaaactttgatattttctgctatatagaagcattcattctaaacagtgaaatattctaaaaagttttgagtctatattaaggagaacattttaattaatgtgtctatcaaaataaaattagagttaatataagcaacatcaatgaaaggtttgtggaaaagaatgttttatttttatgggtacatagtgtatgtatttatggggtacatgagaaattttgatacagaaatacagtgtgtaataatcacatcagggtaaacagggtatccatcacctcaagcatttatttctttgtgttacaaacattccaattatactctagttattttaaaatatataataaattaatgttgactgtagtcaccctgttgtgctatcaaatgctaggtcttattcattccctctaattatatttttgtacccattaaccatccccactgccctactccccttcccagcctctggtaaccatcatcctactctcttatattcatgagttcaattgttttcatttttagcttcagcaaatgagtgagaacatgcaaagtttctctttctgtgcctggcttatttcacttgacataacgtcttccaattccatccatgttgttgcaaattacaggatctcattatttacaattgaataatactacattgtgtatacgtgacacattttcttcatctatttgtctgttgatggacacttaggttgattccaaattttggctattgggaatagtgctgcaataaacatgggggtgtaaatatgtctttgatatattgatttcttttcttttgggcatatacttagcaatgggattgctggatcatatggtatttctctatatttctagttgtttgaggaacctccatactgttctccatagtggctctactaatttacattcccaccaacagcatacaaatgttcccttttctccacatcttctacagcattcattattgcctgtcttttggaggtaagccattgtaactggggtgaaatgatatctccttgtagttttgatttgcatttctctgatgatcagtgatgttgaacatcttttcatatgcctgtctgccatttgtatgtcttcttttgataaatgtcttttcaaatattttgccaatattttaattgaattactagatttttttcccatagagttgtttgagctccttatatattctggttattaatcccttgtcagatggatagtttgcaaatattttctctcattctgtggattgtctcttcattgtttcctttactgtgcagaagctttttaacttgatgtgatcccatttgtccatgtttgctttggttgcctgtgcttgtgaggtattactcaagaaatctttgcccagtccaatgtcctgaagagtttctacaaaattttcttgtaccaatttcatagtctggggtcttaaagtctttaatccattctgatttgatttttttagatggcaagagataggggtccagtttcattcttgtgcatatggatatcaagttttcccagcaccatttactgaagagactgtctttttccccaatgtacgttctggcacctttgtcaaaaatgagttcactgtaggtgtgtggatttgtttctgggttctctattctgttccattggtctgtgtctgtttttatgccagtactgtgctgtgttggtcactatagctctgtagtataatttgaattcagataatgtgattcctccggttttgttcattttgcttgggatggctttgtctattttgggtcctttgtggttccatataaattttaggattattttttatgtttctgtgaagaatatcactggtattttgatagggattacattgaatctgtagactgctttgggtagtatggacattttgacaatagtgattcttccaatccatgaacatgaaatatttttccatttttccatgtcctcttcaatttcttgcatcagtgttgtatagttttcactgtagaaatctttcacatctttggttaagtttattcctgggtatttttttatgagattactttcttgatttctttttaagactgttcaccctggcatatagaacactactgattttttatgttggttttgtattctgcaactttactgaatgtgtttatcagttctaatagttttttggtgggggcttcaggtttttctaaatataagactatatcatctgcaaacaaggataatttgacttcttcctttccattttggatgctctttctttctttctcttgtctgattgcttagctgggacttgcagtaccatgttgaataacagtagtgaaaggaagcatctttgtcttgttctagattttatgggaaaggttttccatttttccccattcagtaagatactagctgtgggtctgttgtatattgcttttactgtgttcaagtatgttccttctattccaagtgttttgagggttttatcatgaagggatgttgaattttatcaaatgttttttcagtatcaaatgaaatgatcatatagtttttctcagtatctaatgaaatgatcatatagtttttgtccttcattctgttgatatgatgtatcacagtgattgatctgtgcatgttgaaccatccttacctccctgggataaatcccacttggtcatgataaatgatctttttgatgtgttgttagatttggcttgctagtgttttgttgaggatttctgcatcaatgttcatcagtaatactggcctgtagttttctttttttgatgtatctttgtctggttttggtatcaaggtaatactgaccttgcagaatgaacctggaaggagaaactacttccatttttcagaatagtttgagtagagctggtattaatttttctttaaatgtttggtaaaatttagcagtgaagtcattggatcctcggcttctctttgctgggagactttttattacagctcagtcttgtcagttgttattggtctgttcaagttttggatttcttcatggttaaatcttggtagggtatgtgattaggaatttatccatttcttctaactattccaatttttttggtatatagctgctcacactagtctctaatgatcttttgaatttctgcagtatacatcataatgtctgttttttcatctctgattttactggatcttctctttttcttagtctggctaaaggtttcccaattttgtttatctttcgaaaaccaacttggtgaaaaagattaaattcagtaggtcttaaatactttggtactttaggagattaatacaaaaaagaaaaaaagacatggattcttcaaacatctcacaatgaagagaggataaacacattaattttgtatataaaggagggaggagatatgtacataaatgcttgtctaagtatagaatctctacagaaggatatgtgaaaaccaaaaagaatgattgcctttgggtcagaggactgggggactggtgatctgggataagagcacttaattttcattatatactatttcccactgttggaatatttgaatgtatatacagtcctttctattccgataaataaattaaaaagcataaaccatatataaaataacttttacaaaacaaagttaaacgtaagagatataaattacacttgatattcaaaggatagaaagatcctattcacctacagaagcagagtaagtaccaataagggggtggtccatgagatggatgggtagaatagatatataacaaaaatcattccagggaagagaacacctgactatagccacaaagttgggaagggatggggcgtgtttagaaaagtgatagtttagaagcttaggctgcatataaggatgtgttctttttctgtagatgcctgacaaaaaaaaaaaaaaactatacagttagcatcttaaagaacgcacatttaccatctcacaggttttgtggtcaggagtctgaattagctaggtcctctacacagggtctcacaggctgaaatcaaaatgtccaccaagactatggtttcctcttaagcatagggccctcttttaacatcactggttgctgacataattcatttccctgcagttttaagacagacactcacccattttcttgctgtcagtcaggagccactctcaacttctagatgccaccagcgattccctgcctagtagtccctcaataagccctctaatgctcccaagatttgaatctttctaacttcagagaaaacccaatcccttttaaaggctcacttgattagatcaggcccacccagataatggccctcttaactgacttaaagtcaactgattagtgacctcatcacaagtgactctacaggatgtgtaccctataggatgacgtattagtccattctcacattgctataaggaaatacctgacactggataatttataaagaaaagaagtttaattgactcacagttccgcatggctgaggcctcaggaaacttacaatcatggcagaaggcacctcctcacagggcagcaggagaaagaatgagtgcaagcaggggaaatgccagatgtttataaaatgatcagattttgcgagactcactatcacaagaacagcatgggggaaaccaaccccatgatctgattacctccacctggtcctgccctggatgtatggggattatgaggattacaatccaaggtgagatttgggtggggacatggagccaaaccatatcaggtgagaatcttgggagccatcctagaattctgccaagcatagctggtaacagaagatgagaacaaaaattctcaaaagctaagccaaaattaaatagttttccatcctatatttctgtctccaaacgttatgctacttgtaaaatacacagggataattaggccaggcacagtggctcacacctgtaatcccagcactttgggaggtcaagatgggaggatcacttgaggccaggagttcaggaccagcctggccaatatggcaagaccccatctcttaaaaaaatggataattacagttgcaactgagaaacctcccatatttggtaactgtctactctttggctatttgtggtactcatttattataaggcctatgttactgactgggaatatctacttctcccttcgcagtcttttattcaatataaaccattcctacctctgtttgctgtactcttggctgccttgtctgttactgttagattaatatttaacttactaaggtcctcctcactccacaaagacctagcctctttattacttttttcccgctattttcagccattacttttgtgaccttgcataaattcacactagaaaagtgtaagtattcaatggttatatagcttccaactttgtttttgcagttttataaccttatttgatgtattcaatgatcagtagtttgttctcatctacactgaatgactatagattttttaaagtggaaacaggtacataggtaaccaaagtatacagcttgcttgggaaccttcatcctcattatgtttctggacaaccacatatggatacagtatgggacatcccttaaccttaggcctagtcagctttgttgaacctgttatcaatacgcacatctggagttcccatctccttcatgatggcaaatttctggatctctctgagtgccccaggggcatgcttcttgaagcccactcatggatgtgcttctgagtgttgatggtgtattcttgtgtcaccacctcattgacagcaggagagcccttcttcttcccacccttctctgcaggggccattctgccaggccaaagttggaaagtaacctccatcttaactacccaagaaagaagaaaaacaaacagcatagctttggtgtaagcaaaatgtcaattctacagctacatggtcaataagtatacacataattaatatttctacaatgttgaatatgattatttaggaaaacaagtctcagagttagaaatacccacttctcctttgatctggcagcttatattcttctcacagacaaaaatcaaaagcccttgataattttgcctgctgattgggaggcaatgctgatagacaaagaagtagaacactatgaaaagaaggcctcctgatacagttgctagtctttcctgacaacgtggcatatggttccaaatcttcaaacagctatcatattgctacactgatttaacaaggtgatctgtattctcccaaattaaatacatgtagagcactaggataccttcttctgagaaaaggggtatttattttctttctttgatactagatttatagcataacagttaagcctgcaagtaccaactgagtttctactaagtgtaacacattgtctagtaggtgggtgatggtagcaaagagaagatacatgataaatcagtcatgaatcctgccctcaagttatatataataagtgaaaagaaaatcctgggagcagaatcgacccaattttcctttctcttctgatgtcaggtgggctctgaacacaatcctcataatccccatttcctagtttccatgcaccattgtgatccctccccttgagtatgggcaggacctgtggcttgtttctagtcaaaagaataagcaaaggtgacacgacagatgggatacatgtacatgactatgtgattatgttacacaaacttgtcatacccattttgttggagtctctgtcttttaccggctttaaggaagcaagtggccatatggccaggaactgcaggacgattctagttgctgaagctggctctggactgatagccagcaagaaattgaaaccctcagtcctacaaccacaggaattaaattctgccaacagctgaaatgagcttgaaaacatctccttccctaattgagccccagttgagaactaagtactggcaaatatgttgattgaagctttgtgagaccttgagcagaggattcaagtcagctgtgccctgactcctggccccaaaaactatgagacaacaagtacacattgctttaagccactaagtttatgataatattgttatacaacaatagatgactaacacatctttcttcttatattattcaagttgctaacatatcataagaggtaaactcaagtattctgaacatccagtcaccactggtgacatgaaatccccagcccacatgctagagaaaaccagagttggtcacacagccagacccttttgtaagattcaagcggcaatttgccaccaatattgccaaaatagccagtatggctgcccaattaacagatcaaaaactaaagatcagctgctaattcctgccttgtacattctcagagagtaaggaccttccatttcccgactaaatgctcagaatgagccatcaggcctgttaggtaaaaatgagaaatttgaaggatcaagcggccccgcagacgctggtagagagggcaagcttaaggtgtagaagaaaactgtcattcccacttaatccaaaaaagtaaaaatatatgcctcctattttctttcagatataataaccaccttttcttaaacaatagcttatttgggggcctgcattcattacaaacaaaccagagtaggcttatatatcatctgaaggttcttttttaaaaaatttcttttgagacagggtcttgctctgtcacctagactggagtgcagtggcacaatcataactcactgcagcctcgacctactgggctcaaggaattcttctgcctcagcccctgagtatctaggactacaggtgactgtgaccacagccaggtacttttctattttttgtagagatgggatctcactgtgtttcccaggctggtctcaaactcctgggctcaagcaatcctcccacctcagcctcccaaagtgctgggattacaggtgtgagccaccatgcccagctaatttttattttttcttttttgtagagacaggggtctcactatgttgaccagaatagtcttgaactcctggaggatagtaatcctcctgccccagccttcgaaagtgctgggattacaagtgtgagccactgtgcccggccacatgaaggttctttccattgttcttccagaagtctcatcatcacaggctcattgtagtataaatattttcacataaggaatgaaagtgatgtgttagcatgatcttatcaggatcaaggtaactaaaaacaaatgacaaggtttctctttttattattcaacattgagaagcagaaaagtgttcaactgttactgtatttatttaatgctcaccttttaaagagtaaattcagttagttacgtgttataaaatgtgagataagacataatcctagagtaatgaaattttctcctttgtaaaaggagattcactataatttttcatgtaaagggaacatgaaaccaataacctagttccaaatggacagctaataaaattaagtttgcacatttaagagaaagttattttaatttcctttaattgtatacaatgttaaaaaggctttttgcaaatcattaacagttaagacgtactttcattgacaatttaggtagacaaaatattcaatgttgtgtgacaaaatcattcttataacattagtaaatgcataagcacatttccaaaaattgcaagaaataaaagccaaataattggaaagaatacacatttactctaagtaaagcttgattatacgcccagagatgagcatgcaaagtatagcctaatctatactcccacaatgcctcaaggtatctctgagtgccctgtttgtgaacatctgggtcagttctatggctgacaccacaatgtcctaaatagggcatgacaataaatgaaatgtacaataatgtaaagcagtataacctctagatacaataaggcactaaatgtaacaacgttaaaaatcagcaatatagaagctaataataaaacaaaacaaaaacatttatgggggtttcagggggaaaaaaactaggcagagtaaatgaaagataatctgtaggttacctctattcgctcctatcaggggcaagattcacatcctggtctctcccctgctaatacctgatgaatcaaactgatgaacatacagccaatcaacgaagccaaaaaaaatgatacttaaaataaatacctgaaaagatggatcccacattacatcttacttaacgcttccaacttgctatgagaaagatactaagatacgcaaagttgaaagtgattcaaattccacactaacaatttaaatgccttgtaagagaaagaatattcacacataataatacaaagcaaagcatgagatgagtcatgagaagatacaagtaaagtgggaccagagcttagagggtgaaagacgacttctagctaagataaggaagggcatcacagaggaaggggcatttaagttagattttaaaagatagaatttgaaaatacagactatagtagccttcatttcaatcaaaagcagcagcatatgccttcataactgcaatgaaatattatgtacgtaattattgaatgtctctcttcctcaatagatgtcaagttctgagagggctgagactatactttttcaatggtctccttagtacctagcagaatatctggtatgtcacagatgttcaacaaatatttattaaaggaataaataaacagaggcaggaatatagaggacaaatcgctcaatttgcctagtaaatatagaagacagggacatgaagaacaaaagatcacttaaggtgaaatgacagaagaccttgaaaagtcaaactgaagaatgtttatttggttggaaataaggagtcactgaagatctttatggaatgtagtgacataactagatctgtgctttcaaaagtatatctaaaagtaatgtacatggcagactacaaaaaagataaaatgaagaagtcaagagatcattataggagtctagatcaaagataacaaggacctgaagtagaataaaggcagtgggaatagaaagttaaaaaaaaaaataacgacagggatattaaacagataaaatcaatagaacaatcagttagttatccattccacaaacatcttttgagcaactactacatatctaccagacactgccaggagctggagacaggaaaaataaaataagctgtagtccttcacctcagagttgagagtcaatctgtcatctcaataagaaaaactgattgaaaactgatctcctagctaagataaggaaaggcatcatagaggaaggagcatttaagttgaattttaaaagacagtttgaaaatgtagaatatggtagactttatttcagccctttcagaataacacaataaatgaagaaagggagaagtcaatgcctctcttaaattttgagaacagaaactaagaggatggcatcaccatgcagagaatggaagaacaaaacagaagaaggtggacagggaggacggtatggacagattctgacacactgtctttgtgtggaatacgcaagtgaaaatgttcctgaattagttgcaaattcagaactggaggacagagcacagattagggcttatgatttgaaaggcatctagcataaatatgagagctgaaattgagagcagacaaggtaagaaagggtgaaacatgtagaaccttggagatgatccatatttaacgagatgagagaaggcaaagggaagaattaagagaaaattatcagaaaatcaaaccaagccaaaccaggaaagaggagagcaatcagaggcaaaaggatcatcaggacaacaataagtgtttccagaagcatggaccatcaacagcattatttgcaacagagaaatcacggaaaattaggactgacaaaaaggccactggatttgggaataaaagaaatgtattagtgatatttgagagagcagcagagtgataagggaaaactcagtttgcaaggagttaaggtatcagtgaatggtgaggcagtggagatagctggaacaaactgctctcttgaagtctgaaaatgaaggaaaagaaaatgatggaacaatagcttgagggacaacagaaggaagaaaaaaatttaggctaaggaaagattatatgagtatgtcttttgttggagaaaaagtggacaaaaaaagcaacattttttttagaacaggaaagagcagagatagaagatccagtaaaggcataaatcaaagatgcataaaatacttgatgtattcattcaataagtatttattgaatgcccaccataaactcaaaactggagaatatacaccggagaacaagctaggtaggatcccaagctcatggagcttgtatgtctaagcttccagaggaaaaggaagaatacagtggacagggtagaatgcctttattctaccctgttgttgcagaacagccacagagtttggatggaattaattccactgctaccaatggtctcagaaatcagcatcatcttatctgtgttatcagggtatttgattcacgaatgaccacacaacctaagttggtcctatcagaatgaaacctgggactttgattaaatggaaaagaggacaatcctgatcgacaaaatgtgctgaggtgaggtcgggaactgttgcatacattttgctacctgaaagaagcccacttgtgctgaaggcaacatagaggaggattgagctgagagaattatggctgtaaaaaatgaaactctgatcaaaccacatctgaaacccatcctttctttggacttttcagttacatgatccaaaacatctctttctttgtttaaggccatttaagccgagctttttgataatttcaagtaaaaccatcctaattacaaattagatgtcactgtaggcacaagtaaaacggttataaaactgcagcacaaaataagacctgcccagtgcagataccagagactgtgccctttctccactcttctggctttagctgtctgtattagtcagttctcacgctgctaataaagatatacacaacactgggtaatttataaaggaaagaggtttaactgactctcagttccacatggctggggaggactcacaatcatggcagaaggcaaaggaggagcaaagtcatgtcctgcatggcagcaggcaagagaaaacttgtgtaagagaactcccctttataaaaccagatctcgtgagacttactcactatcatgagaacagtatgggaaagacccacccccatgattcaattaccccccaccaggtccctgccacaacatgcggggattatggaagctacagttcaagatttgggtggggacacagctgaaacatatcactgttcatggttctaagctttgaaactacaactcattctcttttttttaaattatactttaagttctgggatacatgtgcagaacatgcaggttacataggtatacatatgccatggtggtttgctgcacccatcaacccatcatctacattaggtatttctcctaatgctatccctcccctagcccccaccccgcgacaggccccagtgtgtgatgttcccctccctgtgcccatatgttctcattgttcaactcctgctccttctcctataaatcctttccccactcctccacccaaggttattttctcttcatcagcccctaaacttcaagagatcttagcagcctgggagcataagggcactcttcctctcagcagcatccaaatttaccccatcttcatgctccagaattaagtgagaggggcctatgacttgagcaacagtcaccaataagggaattcttgggcctaggcccagcgaatatcctttctgcaagtttgcccctgtggctgtatcaaccctgagtttccatcttttcgtatcaatctggctgacttctcttcctttgaaactagactcacagtgcatctcctcctggaaggcctccttcccagtggcccttggccgtcagatgctgctcctcagggttcccatgaaaatcaatactcacctcctcctagccacacagacatggaaggacagagctagatacaatgtgatgttgttcttactgggacaaggattacactttattttatttgtgtataacctacatgtgtgggggaaatgaatgtcacttgtaatgtggaggaatgggtgctggactcgcaggcaaaacacaagacttccaggcatgaggggatttcttacaagttgcaggacctctccaagattcttaatctataaggactttatcactgggttgttgtgagattaagaagcatactgaatctgaaaagtattgtagtcctttgagaatgatacctagaaatatttttgttggatattatgaatgttcagaggaggcaagagatgccttcttgctagggattgctagggaaaaactggagacatagataagtgaaaaactcaagaagaagctggcctttaagctgactttggagaatgtgtaagatttagacatgctgaaatggggatggggagaggtagccaggtgaaggaagccaaaagctgagaagccagcatcaacttagcagctaattttactaagcaaatatgtgccaaccactcttctaagtgccagggttacaacagtgaaaaattcagaggaggcccctaccctaagagggtttacattccagttgggaaagacagacaataaacaaagacaaagatatgaaatgatttctgttagaggtaagtgatgtgaaggtgatgtgctatggggactggaggggaaacattccaggtaaggtagtaaaggccattctgaggtgatgacatttaacctgggaagaaagtgataaaatagagtggagctgaggaagaatatgccaaaggaaataccaggtgcaaaggccctgaagtaggaacaagcttggcgtgtttgtaaaaccagaaaaaaaaaaaaaaagccaatgtggctacagcaaagtggacaaaaacaaaagtagtatgagattaaggctgaggttatatctaagtaacagcacggtgtcagtttagattgaagtttgtagtagtagatgatccttgaaaacaaatttgggctagaattagaaaatctcagacaccaaattaaggtggatatatttcattcttcaaaagcaattgtctcacaatataatgagccaggtctgcgaggcaagtcctcagggatgcccacagatatttctcataaattaggtgactcttgtggaggtcatgggcacttaatccagaacaccaaggcagcaaggcaaagcagctgcgagactgttggtgacgtggaacacagactgagcagaaagttctctagctcaatttcccctgttgcaggaagaaatgaagcccagagaagaaaacaggcctgggaggagagagagtagacatcataactgatgttcaccaatacgtggttctcctctagttctgcccaaacaagaatgataatgtgtcactttgggaccaaagcatttaattgctggtgtttggctccccgaacctgccatggcaatcacttgttaccatggaggtgttatagacaggtacagtgtagaatgcagagccaatatctggagggaggctgccatggagaatcccccagatccactctggtggtgttaactcactgagaaattggaggttgtttgttatggaaggataacctaacctgtaatgattaatacaggatatagacagagtttttaaaaagaccagaaagagtagacattcttgctctgagtggggaaaggaggaggagagaatatgagatactactcaatgtctctgacagcatgcattttttgccccaattctccattcttggctagatcagtgacctttatcagatatgtaagccttgcacaaaataccatagactgggtggattattaaacagaaatttattttctcacatttctggaggctgcaaatctgagatcagggtgccagcatggtagagttctggtgtgcagatggccaccttctcgctgtgtcctcacatgacaaagagagaaagagagcaagctctctggtgtctcttcctataaaagctctaagcccatcatgagggccctaccctcatgacctcatctaaacctaattatatctcaaaggccccatccccaaataccatcacattgggggtcagggcttcaatatatgaaattttgggcaatggatatgattccatctatatctgagtgttttctcccactctttggtttacactttggccatgtgatttgcttggctaacagaatgagctggaattgacagtatatgccagttccaaagccaagccttaaagagcccttacatgttaacagtttcccccttgcacctctgctatgggcatgagaagaacatggcatggctagaccattccacaaaggaggacagaaatacatggagtactaccaccactgcaaacacatattgcaacaatctgcaacatgcagaaccacgacccaccaagcctgcagcataaatgacaaatgattatgtttttaagacagcaagtttgtggtggtttgttaggaagcactactggggcagtaggtaattgatctatataatgactacaggaaaatggccaaggaggacctgtggctctttaggaagagtcttatgctaacaaagctgcctaggaaaattaagttgtactgctccaaagactcttctcttcaaatcctgttttcttatttaccttttccagttccctgaaataggtcctaaattcaactctgatactggtcagcaaggtttgtgaagaagacaaaagcactggggagggggatacagaatcataaagtaatacaaaaaaaaaaaaaacagaaaagaaaatttcaggggagaaaaatcaagtgcaatacaaaacaccaaaggaaatgagatctgaggtctctaagtttactaagaaggctagtcatcatgaagccatttttggacaccagggagacagaggcatgggagttcaggaaaaaacaagtggcaagaaaattgagacagtgagtttaaatcattgagtttagaaacgtaacaatgaaaagaataaaaaatagagcaacaactagtggagcaggaaatagaattcatttcctaatacagaagacctatatatataggtttctatatcagtgctatatcagtgctatatcagttttctgttgccacaaaacaaattattacaaacttattatctcacggttttgtaggtcagaagtctgagtgagcttagctggggtctctgcttcaagtctcacaaagccagcatcaaggtgtcaaccaaactgggctcttatctggaagttctagagaataagacctccgggcatattcaggtggttggcagaattcagttccacacagcaaataggactgaagtccccatttccttgctggctattggctggaggttgctcacaactcctagatgctgttctctggccctgcatgtgctcatctccatcttcaaagtcagcaatggtgcactggacctttatcatattttgaatgtccctgacttcttcttctaatagcagctagaaacaaatctgttcaaaggcccatgtgactgtattagacccagataacctccctaccttaaggtcaactgattaggaacctcaattatatctcaaaaccccttgtgctgtgtaacctaacataattatggaagtaacagccatcatatttacagtcctagaaattatggcagaaatcttagagggccatcttaggattctgcctaccacatgtacacatttaaagttgaaaaagatccaaaagcgaaaagaccttgaagaagattttaaatagaaccttgtattacacaaattacctataaataggaaggaaagaaatcaaggaaaaagtatgccatcctggccatagcaaaaaaaaagaaggatgccttttattggagatttgaagaaagaattaaaaaaaaaaagaaaaaaaaaggcagaggcaaaagacaccttttatgccaactatttactttgccaaaattagtatcattttaatttagatacaaagaaacatattctaggctctttgaaaaagttcctccagatggttacatctccctggagtgacagcacctagcgtagccttgcacatattgggaattcaattaaacactgctgaccatctgattgagaattcagaggctggagtagctgactcaatataaacatatggcttagttcccatcaaaggaaaaatcaagtcactctattctcctccccaacatcgcacctcctttgcaatgtaggagaaaacagatatgaactaataaaaatagacgatgtaacagagattaggaaacaggcaaactggagaatacaaaatttctctaattttaccataaaatcagaatgcttcagctaaggatcagcactgtaaatatgtcattcttaattcaattgcattcaatcagatcaatactttccgatcatggcttcaggatatttaagatggggaagacacaatctgagcccagctgctaagtgttgggggataggagaagcacacaaatgactatactgtgaggttgagctatattaattgtggaaagccaaatgaagataagaaaacaaattaaaccacttttaaccctcttaagagccatatgaaatatttatacatgagaaaaagcctcaggcagatcaaaaatatttttcaagatcatataccaagtatattgtagggtacagattcaaattcaagactgactccaaactcagtctctcccaaagaagaggcaaatcacctctggttggctagttggatgggagtttggaggctggtggagagaaaccaggaacagtttcttagggaagcagttatttcaggtaaaacttggaaagatatacacagttttgaaaagctgagatggcaaagaaggagaacatttccaggaggaacagcaaaaagcacagaagcaagaaatcaggatcaacatttggagaatggtgagtagatcaagtagcacaaactctttacaaataaagatagattggatgcacattctggaagtcaaatattggggttaataagttactgtaatagttcagggaagagcctaaactagaatctcagacatgaaaaaggagaaaaggagaagaggggactaatgtgaggagtcagatggaagattactctcttatgtttacattacagtcaacaacaacaacaaaaaagacagccaagtccaaaaactaagcttggattcaaaagaaaaaagtcatccctctgccaccctcttttgccctctagtctagaggttagtaaactatggcccacagggcaaattcaacccaccatctgtctctgtaaataaaattctactggaacacagccgtgtccactcatttacggattgttaatggctgctttcaccctataatagcaaagactatgtggtccacaagacctaaaatatttactttctagtgctttacagaaaaaaaaaaattgtcaacgcttgctctagttccatactccacaagccactcttatttgtttgtttgtttgtttgtgacagggtctcactctgtaacccagactggagtgcagtagcacgatcacagctcactgcaggctaaagcaattctctcacctcagcctcccaaatagctgggattacaggtgcacgccatcatgctcagttaatttttttttttttttttttttttttttagcagagacgagctctgtctgtgttgcccaggcttgtctcaaactcctgggctcaaacaatcacctgcctaggcctcccaaagtgctgagattacaggcgtaagccacttcacctggcctgttccaattcttttagtagcttgttctcatctaaatattaagcttatttggatatttcctgactgataaattatcaagactatcatttgaattcctattatagtaactgagactttggcttgcttgcaccatcagccttccccgcatcctccccactctccttccccaccacacatactttcctttccccgtatgaatatatatttatattcgtagtgtttgcaacattattgtgactacataaatattcttcattactgagccagataatgtaatgtaattatgtttatgtttccatgcttataaaaatgttattttctgaagttaatagttatcatttgtttcatttgcttagtttttcatttacctatcactattttttctgagtccaacacatttgttctgttcatttttttccaaacattcaaacacaccaaatacttcatttttatttgttcccctcaaaaccaccccccccaataaccctccatcctttttctctaatctgagtggttgctctcaaggcctagtgaacagttgcttttctggaacttctctctgccctgccatattgagtctgttctcctgaatcctatgtctttctctttattgattttctcccttgttttatggaagctcatcctccagaagctttctatgaaatcacacataagatataaattgtttaatccttccaggacttagaatttcttcattctgtcctcatatctaattgatactttcagccggatagagaaatctaaactgaaaaggatttccccctcagaattttgaaagcattgcaccactgtcctctaccagccagtgttgccataagagtttgatgccattctgatttccatccatctctatgtgacttgtgttaatgctttgtttcattttatactcccttcacaaagcttttaggaccttattttaatctatgatgttcttacatttcagaatgacatggctggtattcttttctcatttattgtgctagatacttgggcagccttttcagtctagagacttacatccaccggtactaggaaattttcttgtaatatttctttgatagcttccttcctttttcttgtcctctatttgtatcaggcaacctgtagctataataaggcttcataataaaccatcctaaaactcagagacataaaacaatagccattcataattgttctagaatctaccagtcagtcaggcagttctgctgatcttggttggatttggctagggagttctttttggtgttgactagacctcacacaggtatctggggtaggctggctgttagctgaatttaaatggtatttggagctagtgcagtggctcatacctataatctcagcactctgggaggctgaagcaggcagatcacctgaagccaggagctcgagatcagccttggcaacatagcaagaccttgcctctaccgaaaaaaaaaaaaaaattaaaattagccaggcacaatggcccatgcctgtagtcccaactataactcaggaggctgagccggaagatcacttgagcccagcagttggaggttacagtaagctgtgatcctgccactgcactctagccaaggagacagcgagactctttaattaattaatggtattaggtaggacagggacctgtttcatgagtctcatccacaagcatgttttcatgataatcacagaggtttcagacattgtatacacgtatcaaaatatcacactttagccaataatggatgcactttaaaaaaagaagaaaaaagtatcacccataaatatgtacaattatatgtcagttaaaataacagtagaagaaaaaatgtgctttttaagcctctgttgtgtcaagttttctataacaaaattgatcaaattgggtcacataaccaagtccagagtcagtatggagggcacctgcaaaaggcttggatacatgaattcatgcatggaacccctattggtcagatcttggaaatgctgaattgatcctctaattttcttttctttcctatgttccatctcttaggtttattttttttctttgttgctgctgctgttgttgatgatccactttctatgagatttcttcaatgttatcctgaaacttctaaaattttttatgttagttcataataaattttaaatttccaaactactttcttgttatctaattttacctgtttcatagcatccgttcttgttttaaaagtacaatatcttctcttattactctaatgaaattagtaagagtttttggaagtattcttcttgaattgcctctgcttccctcagcaggtgaagggaagtttcacccaacttcccacagcagagaaaggtatctgggtgatctaaaggctcttgtactttcaaccaagatccatgttctgctctgtgttttactcccagtttttgtggtgccgggagtttccaaatgtgagtctctaaagggtttgcatctcatcaatgtcttttctatagggacttcagaaaattaaaggtaactctctgcaggtagcattcttcctttatttttcatcttccaaaattttgttaagatctctcttctgctatcccaatttctttatccttataagttaataccttttaaagtcttctactgccatttcagtgagatttgaggaaggaaagaagaggagtttacatggtctatagacactctctccatttgcttttggacacagtgaattccaagtaacaccacaataataaagcagatatccaatgattgaaaacacaggtgaagctcaagataaaggtcagaattagagatgtaaattggagaactgcttatacagaaatggtttctacaactatcaaaggaaataaacaaaatataaaataaagacaaaatatccaatgatacaatatttagaaatgcctaagctaggaaaaagaaactatcaaagagctcaaagaaggaggaatgataaaaatagaagagtaagtgggttagtactaagtcacaaaggtcaagggagaaaaaggtttcaagagaaaaaaagacaatcaatgatatcaaatgctgctgagaaacacaggaagatgaggatgttgaggacataccatttggtgattaggaagatgatggtgaagtttaagagagttgtttcaatagcatatgagtacaaaagataaagaagtagatagtaaagtagataatgtattggtggttcttttttccccaataatctggtggccagtggaagacaaaaagcctgagataagtgagaggagaatttgaacatacatgaaagttaagaaaagtttttgtgtttttttggtttgttgtttaaggaaaaaaaaaaaaccttagcaagagtacaaaaggaaagatttgaggaaagaatgtaaatgcaaagatgaggaaaatcaaaggataataaaggactggaggagaaaggtaggatatgcactcatgagcacacatgcagaggttcatcttagaaaaggggaaggcattcttactgcaaggcagatatgcagggaaagagaaagaataaaagcagaggtagagagagacaccagaaaaaattctgaaaacctcatgcccaaatgtcctcaagctcagttaaataagaaaccaagttatctgctgagagcaagaatgaaatttatagagagtgaaaaaggtttggaacagctggtctggtaaatgtaatagggggtttgtgggggaggcggtatttattaatttacttaagaaatagcggcagcaagaaaagtctagataaagctattctaagttctgggagactctaaacaaaatatggatttagaaacagcaaaatttctgtttttcacaatagtagctataataatgagagatgctcagtgggtatgaggtaggtaatgtcaagtgatcagaataaaatatccaaaaattaacaaaacctgaatttttcaaaaggacttccttttgtattttactttttaagaagaaataagaaaaagaaaactaataaatcttcaatccagttctttcaacatttattccttgctaatttctgactaataaaagcgttaattccaggctaattaagccttcttaactgaccttcaaagttctcctcaactatgcctaactatatcaactccaatctcctttgtccaaacactactcctccactacaatctaaaatagttgcatttccatgcatagtagttcacatttgcaaatacaaaggctgctgaatcttagaatttatttatctctaccaatgaccaattgttcacaattaggttacttttggtcctgattccttttggaatttatatggaaagatgtaacatttacggagccattcattatcactgttgccttcaccctttccttagctaacagcagccacttgattcatttacctctaaagcattggttctcaaccagaagcaattttgcctcccagagaacacttagcaatgtctagagatgatttttggcatccagtgtgtacaggccagggatgctgcaatcctacaatgcaaaggaaaaccccaccccgtccccaacaaaaaaaaattatctggtccaaatgtcaatagtaccaaggttgggaaatcatgctcaaaagctacctcattcatattctaagacctataaataggtcaacaacgaaataaaacctgcctttggctcaagctcattctctcctctgctcctgatctcctacattcccaggccctttgtctgccttgaccattgagactttgattgcctttttcccagcaaggctatgatatcctgattctcagatccttagctcccttgggccatctgacacctaagatgcagttgcccctgtgaagttccaaaactccccaggcttgtttctcactggggggtctttaatccttgttttctggacttgagtctttgcacggtctggcctctaacataacctgactaatcctaatcatctatttctccctacaccccagggtgacaatatggtttgacagtgcacatcagagcagcctttaaaaggccttctcgagaccatcctggctgacacggtgaaaccccgtctctactaaaaatacaaaaattagccgggcatggtggcgcgcgcctgtagtcccagctactcgggaggctgaggcaggagaatggcgtgaacccgggaggcggagcttgcagtgagtcgagatcgcgccactgcgctccagcctgggcgacagagcgaaactccgtctcaaaaaaaaaaaaaaaaaaaaaaaaaaaaaaaaaaaaggccttctcctgtctaactttggagtctcagcattccatctcttcttcctgcagtcacctaaggggctgttacctatctccagaacaacagtttacatgtgttaagacctcattatatggttgctggaggaaaacatgaaccaataacttgcaggcttgagttacaaagaacatacatttaaaccaactgaattctggatctaacagttctttcattcagttaccaaaatatttattgaagtacagtaccaggcatgtgggggtgggtggcttaaaaaaagtatccataaatagctcacagcttagtatataaaatcagatatgtaaataagtaatctgtaattagactaattacagtcagattattcctattttataatatctaaagaaaattgtaaaagaaataaaatccttcctcagaattgacagaactaatggtcttaaaataaaagtacatgggatgaggctgggtgccatggctcatgcctgtagtctcagcactttgggaggccgaggcaggcagatggattccctgaggtcaggagttcaagaccagtctggacaacatggtgaaacctgtctctactaaaaatacaaaaattggccaggtgtggtggtgggcgcctataatcctagatactcaggaggctaaggcaggagaattacttgaacctgtgaggcagaggttgcagtgagctgagatcatgccattgcactccagcctgagtgacagagggagactctgtctcaaaaaaaaaaaaaaaaagcgcatggataaataaatgagcaaatgaacaagcagatggataaatgagaaaccaaatatcaaacaagtaaattttttctgggggtcttaggcaaagtggtacatcatgtaaatgagagcctcattattctactacatctcctttcttttcatcttccttaaatgtcattctcactataaatgctaattggtttagcatatataacaaattaatctgggtgatagaataatgctacaacacaatccatgctgaaaaatctttgcttctcagttttgcagataatgaagcctctaaacagacatagcccaccagtatgtagacagaccaggactgatactaggccaaaagacaccatgtagcctctccagatgtttacagccagtgtgcatctgactggtcagtgcttgtgcctcatcagtggtaagttgttttaatgtcacccttgatcagtacattctctcaattttagagcagcaggcagggctcccaagaagagatttcataactatattatgttcattctccctttaaaagtataaaaattccaattaccaattgacatagcagaaagcatccacctggttagactgacttttcctctgcataataccttgttaatccatcataatgatttattcatattgctgctgcactgagatatcagatgctacaactacgattatcactgttcctcgtaaagtggagtcttacagagctggctttgaacccaagctctatcaggtactgtctacgtgatgttcaacctcttctaggctgaagtacgtgagactttaaccaaatgcaattgaggaaaataatatttaccttagaggtttgttgtgagcattgataaggagacgatatatctatacagactagaacataccaggtgcttaatgaatcctagcttctccttttagccaaatctgatacaaacatattgatcaagttctttcccttccttcctttcaccatgtgatgcctgctccccttcaccttccaccacaactttttcttttctctttgcttaattttctttaagtccctccaccttatcggcaatttactttttcatttatcaaaagttactaagagcacgagcttaccactgcctctcccaaaatatctcctacaaatctctggaatccatagtgaaaagtagaaactatgattccaaatttgcctttaccctaaacacattgttttgcctttgttttaaagtggcttttccctcctcatctctgataattttccagcattaagagcattggcttttgagtcaagcaatcttggattccaaatccaattctgttgcttatgtagtcgaattacttacctggttgacttattaaatttctgtggctctcactgtcccaaaaactagaacatgtatggcaatgggcacaatgcctagcacataataggtgctcaaatatatcatatttaattgttctcagcactggcattgctaaccaagactaccttctcagtcaacaattagtctcaaagatacaatccaaatcatgtcccattagcatgtgccctgttctgtatttattcactcaactaatcatctcctgaatgctgtatatgttctaggcataaaataaagacatttgtacagcactttcaaagataactaaaccaaagtttcagacttaaaggaactcattgtctagtgggaaggcaaacatgtaaacaaataattacacggcagtatactaagtgctaaaaatagatgcatgtacaaggtgccagggaagcaccatagagagagatcaggcaaagcttccttgaagagatgactatgccagagttgagtctgggaggatgagcagggattcactgagcacacaagggaaagacggacattctgggagagacaggggcaggcaacagtggaaagtccatgatgcctgctgaaaacaccaagtacaggaattgagtcgggttggagagtgctgctacaaagaactggtgaaaaaatggggcagttaggagggagccaaaccacaaaaggcctcaagtgatgtgccaaagagtatggactttattcattaagcaatggcaagccactgattttttttgtttttggggggttttttgagacagggtctcactttgtcacccaggctggagtgcagtggcacgatctcagctcactacagcctcaacctcctgggctcaagtgatcctcccacctcagccccccaagtagctgggactacgggcatgcaccaccatgcctagctaatttttttgtattgttagcagagacggggtttcgccatgttggccaggctggtctctaactcctgagctcaaacaatccacccacctcagcctcccaaagtgctaggattacagatgtaagccactgtgcccagcctctattgatatatttctaagtcaaagaataacatgtttataatggcagaggaggaatcaggttggaaggactgttattggaagtggtgatactgagtggacagaagtagtaaggaaaaacgtcaggcatggctctagagtttctagtttaaatgatgcaccatagttcctaacacaaatgatgcaagtaacagagcagaactctgggtacagataattaatgttttgcatttcatacctccattgaggaggagatgttcaataggacaccggggataacatgtctagcgtgcaggagagagaaatgaattacagatacaggtttcgggtagattttggagaataataatttttaaaaccaaagaacatgctttttttttttttttttttgagacagagtctcactctgttgcccaggctagagtgcagtggcatggcgcgatcttggctcactgcaatctctgcctcccgggttcaagcgattctcatgcctcagcctcctgagtagcttggactacaggtgcaggccaccacacccagttaatttttttttttttttttttttttgtattttcagtagagacggagtttcaccgtgttagccaggatggtctcgatctcctgacctcatgatccacccgcctcagcctcccaaagtgatgggattacaggcgtgagccaccatgcctggccaagaacatgctttttaaaagaaatataattcatttagacttctctcccaacttcaagtgaaaagattacaaattaaaaaccttaaattactatctattgcatatatattaaaatctaacattaaaaaatatggaaagatgtcaacacatttaatgaaaacaaaaaactttaacagaggtaagtattgtatatttatttgtctattactttgcttaagcagtctgcttgctaatataaggacattttccttacctataagagtaacgtatttccaaaataatgttttcatggccaaaaaaaagcataacgcttgcttcatcttctgaataaacaagtgtgtttaatttcctgagtaaacattagtcatagttgacactgaacagcgtccaaattcaaggaaggagttaagaaatttctaaaaccccaagagcaatatacctcacccagagaatctagtgaagagcttattataaaggactaaaagtcaatgtcataccaaaattttaaataacatcatgcatccctctacttaataaattatttcaaaatcaggtcacaattgacagacacactatcttgggcagacgggagagactagataagcagggaaaatttccttttctctactgaagcatgtccaccaactgtcatatctggaaaacagccaaaatgagcactttatttgcaaaaagaacaggagatttataatgtgagcaaaatgtgtgctatataaatgcagaatatagagaattattttaagattcatatttctgtatgtttagaaataatgtttcaaagacgtagattaaaaccacaagttcatctatataaaaagctctaaaagccaagggtggcaacgcttaaatccctatagataagctttacccttttcttctgggctgtgaccatctatgcgaggtaaggtttccttataaacttctaagacagataatctggcctcacaggtatctaaatgaattagccacataaattactctgagaaaaccacagccaaatcatgtctctcttaaccttcctttccttctgctccctaaccctctgttttctctttagtcacagagcattttctagtttcctgaccacggggtttaccagccaaagctgacacagctgagttgagaagggaaagcagctgaactataaaggaaggaaatcagagagaaaagaggcagggagtctggaaatgctaactagaggggaaataagaaaaccctggactgtgtctgaatctgtagaaacttgcaactctagattaatgtcctcaactcaggtgttggcggcccttagtcaactaagggtttgcgaaaattttccaaatgggttcctcgctaatctaaaataaatacatattaaaaatagtaataatggcagagtctcaataacatttatagccaataaccagggaaaaggaagggtaggcattcattttgagtgactttactattggaaactcctggacagttacagcattgctattaacacaattgtcactttggataaggtgtccaactgcatcacacagtattttggttctttaaagaagttaggggctgggcatgatggctcacacctgtaatcccagcattttgagaggccgaggcggacggatcatctgaggtcaggaattcaagaccagcccggccaacatggtgaaactccatctctactaaaaataccaaaaattagccaggcgtggtgacaggcgcctgtagtctcagctactcaggaggctgaggcaggagaattgtttgaacccaggaggcagaggttgcagtgagcccagattgtgccactgcactccagcctgggcagcagagtgagactccctctcaaaaaaaacaaaacaaaacaaaacaagacaaaacaaacaacaaaacaaatgaagtgagagaatttaaacagaaaggaagtgggaaaggtaaggtgaagaaagacttctggtttgagtgtattctcttaaaaagttcacaaaatcgctgaggtaataaacatttttccacatgcctcttttctgagattttgtccaccttctcctccagccatgaggtggggctcaaggagactcagcagcccctagtttatgctacaagatcctatctccctgccttcccctcatcctcactgccttgattcctggtcttttcaaggcctggcagttcaacatttccttgattctatgaaagacttctatagtcataaattcccattcccctttaaagaaaaagcaagcaagacctccaaggaaggatatattaaacatggatcttgtacccttttctgcaactcctttcatcagtgagatgatgataatactatagattagattgtggagaaaataggtatctatccatcccaagagtcaagagttttggagggatttttaaaggtaatccaggaacaaataggataggtactctgcatgttcccttgttctgctgatgaatgtcacaaaatacaaagtttacgaagcatttctatggacacccaaggacaccataaaaacagaaagccaagatacaaatactttgaaatactgtgaaaaggtcctacgttattagaggtattgataagaaaacaagatgttaagaaaagagtagaaatcacgatctctttagatccctagatgttttcttgtgtattaagtatgacattttttaaatccaggctggtttagttgtttttttttaattttactttaagttccaggatatgtgtgcagaacgtgcaggtttgttacataggtatacatgtgccatggtggtttgctgcacctattgacccgtcctctaagttctcttccctaaccctcccacccccatcaggccctggtgtgtgttgttcccctccctgtgtccatgtgttctcattgctcaactcccacttataaatgagaacatgcagtttggttttctgttcccgtgttagtttgctgaggatgacggcttccagcttcatccatgtcctgcaaaggacatgatctcattcctttttattttatggctgtatagtattccatggtgcatatgtaccacattttctttatccagtctatcattgatgggcatttgggttggttccatgacttcgagattgtaaatagtgctgcaataaacatacgtgtgcatgtacctttatagaatgatttatattcctttgagtatatacccagtaatggtattgctgggtcaaatggtatttctggttctagatccttgaggaatcaccacactgtcttcaacaatgattgaactaatttatatgcccaccaacagtgtaaaagcttcctatttctccacagtctggccagcatctattgtctcttgactttttaataatcaccattctgactggcatgagatggtatttcattgtggttttgatttgcatttctctaatgatcagtgatgttgagctttttttttttttttttttttgagacggagtctcgctctgtcgcccaggctggagtgcagtggcatgatctcggctcactgccggctccgcctcccgggctcacgccattctcctgcctcagcctccggagtagctgggactacaggcgcccaccaccacacccggagaattttttgtatttttagtggagacggggtttcaccgtgttagccagaatggtctcgatctcctgacctcgtgatgcacccacctcggcctcccaaagtgctgggattacaggcgtgagccactgtgcccggccgatgttgagcttttttacccgtgtgttggccacgtaaatgtcttcttttgagaagcgtctgttcatatcctttgcccactttctgatggggttttttcttgtaaatttgtttaagttccttgtaaattctggctattagacctttgtcagatgggtagattgcaaaaattttctcccattctgtaggctgcctgttcactccgatgatagtttctttcattgtgcagaagctctttagtttaattagatcccatttgtcaagagttctcttcttaaggtagtaaaactaaaattcagatcatctttccattgagtttgttttcccaaacctagggaaggagagcaggaactggtaatagtgcctgctgtttattttttcttaaatgtggcatgcaaagctgaatgatcttttaaagtacagaatataactgcaatgaattatttctgcaatacttccaactatttttcccatttctttgcaattaatgatagcatttttttggctatagcaaatgtttactaaagagcttcctggacgtttctttgcttagatttatttctaggaattatagtttcctgatagtaacttaaagcttgggaaattcccagtatgaattacttactgtcctggttcatttgaagcaataatcatttttataagacctgtgcagatgtgccatattttataatatacttgtgtcaatttccagacatatttttatgacattttaaaaatcatagtgggaatatcatataacaagaaaaacctacttgctggaatccttatctctatcgaattctgcaaactcaacttcttcagtgaatgacagttaatatctcagttcttttataactctttttcggcattatcatcatcttactaaaattcttgagaatgcactttgctgataattatgataaagaaagaccttcagctaaacagcaaaaaaatatataaagattttctgtctctcattctggaggcctactacatgtccacaacactatacatgaaaaaaagcccattaaagaatgcaaagtgctgaccagcctatcaaattatcatcatctctcctccaaagtgcaaggagaaatagtatccaggagaattgccacacagtgctcatgctttggtcataatctgatgttacctaaaatcattaattgcccaattttcttccaatacaaggtacagccaatgctgactttgaaagagatattatcattgtcatcacctagataaaaagaagagcctcctccactttctcttccactccctattcctcttttccttccttctcatttcccttctcttcctgaaaaattcagttcctacactattaagtaacacagagaaaggtaggtgtccacatcagaggaaagatggaaggcacagtggaaaggtaggaggtgtgtccatattggggcaggcctagtgtggcgtaccatagcctaagtgagagggcatcccttctggcatgatatgagagggttagaacccacacagggtgaagagggtgcccatgtggtgatggcagaggggaacaccccagcatgggatgtcagtatccaaacagaatgagagggcatccacatgcaagggtgacctagtgcagggggattagagtccaagaaggatgaaaagattattcccctgtagatgcagaccaggagagagtcagatatgaaaagggtgaagaggtgtctctgcagaaggacagcctagtgtggggtgacagagcctaagagggaaaaggaggacattaacagaagggaggggacgatagtggagaggagattgatagcatataagacgacttatcaaataagtatatatacaaagataacagaagccagactggaggatgaaggaagttacaataaactcatatttttaataactatagagatgtaaatatgtgtacacagtgatgtgaatatattcactccctggctgagaggatctgggagatatgacactccaaaagccatgagcataacaatacccaaatcttagcttctaatggcccactttccaataaaaggaaccaggccacttggagaaaaggttgattccagggctaaggcaggaaaagatgagtcctggaacattttatgatgccaaaagcaaggaaatgctcaaggaatggctcaaaaaaaaagtcagcctaaaagggatcctactaagtctgagataatttaagcatcaaaattaataatgatagcagtgcattataacctaggcaataaaacagcaaaccatgagtccacactgatataaataaatgaataaaagaaagtttgatgaggaatgggatatctgcataaatgtacctccacacaaaatagttattaaagggggaaaaaggtaattatatatatagaagtttgacaaccaccatcataagcaagtgattaaaatgaacattatcagcaacgggacagatcaaatcccatgccacctgacaggatacaatgaaaagaacagagcatccctctgtggcattcccaccaaaggtgcacaacctgggccaggcacggtggctcacgccagtaatcccagcactctggatggccgaggcaggcagataacttgaggtcaggagttagagaccagcctggtcaacatggtgaaaccccgtctctactaaaaatacaaaaattaggcgcatatttgtagtcccagctactcaggaggctgaggcacaagaatcgcttgaacccgggaggcagagcttgcagtgagccaaaattgcgccactgcactccagcctgggcgacaaagtgagactgcatctccgaaaacaaccaaacatcaacaacaaaaaaagtgcacaacctgaatgtaataataagaaaacagcaggtaaacccaaagtgagggacatcttataaaataactggcttattgtctttgtgtcaagatcacaaaagtcaaagaaagactgagaaattattcacactcaagaagactaaggaggtatgacaactaaatgcagtacatgattttgaacttaatcccaataaagacattattgggacagttggcaaaacttgaatgggatctgaggaataaatggctgtaatgtgacaaagttaattttcttattttagtgactgtattgtggttaggtcgaagaatgtccttgtctgtaggaaatacaaactaaagtattctggggtgattaggttgacaacttacttgcaaatggttcggggaaaaaaaaggttatttaaactatatttccagattttccataatatgtgattatttcaaaataaattttaattttaaaaataaaaatatttgacagtatgtagttctacctccaaacattaaagaattacctgaacctgactcatggtcggatttagatctgatgtatgatgggagatgagagccaaatgctgacaccagactgctcaaacgaaaaagctaaatttgtgagtttttatgccctagtaaaattagatactactgtatagttagctattatctcatgtaaatgatttttgtaagggcctagagagaagagtctattttccagcctccaaagcaccatcaccatactaaatgcatagtgtacacctcaagatatttccataccataaaaatatgtctcaaaatattttaatgcttttaaaaaggagaaaatagtaatgataggcttactaggaacccattaatctcatggattacagcacagcacatacaacttccgtggaacacaatttttttctgttcaagttatctttgtgaggaatgtacaagatagaaaacaaatactaaatctttggtgaccagtaccactcctaaaagcaaaaggaaaaaagcaatcctctgcctctgggatcagaggaagattggccaagcagtgtcactccctatggcctgtcttggtgcctacagttacaccattaaagatttaggttaagacagtgtaaacaaatgacttattataatgcaaatattccagagtttcccattcaataaaagatactcatgaaatatataattatgatttataattatgaataatttattgaatatctaaattatttattgcatagatattaatgcttagtaataataagcattttatttcctcctgtgtaataggcactgtgatagatattttatataaattatctttaaccattccaactctacaagatagatgttatcacctccactttataaataaggaaactgaagcccaaagaagttaaatcacctgcatagcgccaaatgtcctttcagttgcagagtctgcattcaaactcaagactcggaatttttccattacggttttttcttttcttagagattgggtcttgctctgttacccaggctggagtgcagtggtgtaatcatagttcacagcagcctcaaactcctgggctcaagcaatcctcccgcctcagcctcccaagtcacagggattacaggtacaagtcactccattacattctgcttcttctttcactatgtaatttactattctgaaaaatagaacctggcgcagtggctcacacctgtaatcccagcactttgggaggctgaggcgggcggatcacaagatcaggagatccagaacatcttggccaacatggtgaaacgccgtctctactaaaaatacaaaaattagctgggcatggtggtgcatgcctgtagtcccagctactctggaggctgaggcaggagaatcgcttgaacccaggaggcggaggttgcagtgagccgagatcacaccacggcactccagcctgggcgacaagggcgaaactccgtctcaaaaaaaaaaaaaaaagaaaaagaaaaaagaaaaatggagatctatggtatgagggaataaaatgccatataggaaagcttcttattggtacaggataaaactaaattatgagacttctgagtttggggtagaagaagccaaagaatgccttagaaccatgaaaggaagaaaggctaagcaaagggacataagggcacaggaagaggggatgagaaaggtctaaggacaaactgcctggttccccagttttcctacacagcctaacactagagttgacaaaagtccctgaattaataatgagctcagttaaaaacgacaggcttagatttattggcctgaaagagatggatcataaatgagggctgtgggctgggtgtggtggctgacgcctgtaatcccagcactttgggaggccgagacggatggatcacgaggtcaggaaatcgagaccatttggctaacacagtgaaatcccgtctctactaaaaatacaaaaaaaaatagcccggtgtggtggcgggcgcctgtagtcccggctactcgggaggctgaggcaggagaatggcgtgaaccctggaggcggcacttgcagtgagccaagatcgtgccactgcactccagcctgggcaaaagaccgagcctctgtctcaatcaatcaatcaatcaatcaatcaatcaatcaatgctgtggtgaacactgtactttccttctttgtgtgaaaggaatgaggacaaataaatcccacgtacatggtttagatgtttgttccctccaaatctcataccgaaatgtggttcccagtgttggaggtggggtctggtgggaggtgcttggatcatgggagtggacccctcatgaacggcttagcagcatccccttggtgatgactgagttctccaaatttacatgaaatctggttgtttaaaagtgtgtggcacctccctgctctctctcttgcccctggtctcaccattttatacactggctcacctttgccttctgccgtgattggaagcttcctgaggcctcacctgaagcagatgccagcaccatgcttccagtacagcctgcagaaccctgagccaattaaacctcttttctttataaattatccagcctcaggtatttctttatagcaacacaagaactgacacactcgcccatctggaaacatgggatggacaagttattaaaatacctttgaagacaatagaagttagacaatatcaagcacctagaattttgggggtaaaaaattccacactgggtttttgtgggggttgttctggttcaggtttttttctttttgcccaggctggagtacagtggcatgatcatagctcactgtagacttgaactcctgggctcaagcaatgcttctacctcatccccctgagtagctaggactataggtatgcgctaccacacccagctatttttatttttttattttctgtagaaacaggatcttattatgttgcccagcctggtcttgaactccttggctcaagcaatcctcccgcctcagcctcccagagtgctgggattacgggtgtgagtcaacacacctggactaacactgtatatagtgaaaataactgacaagggcatatttttaaaatgtctttaggtgatttactttaccactcagttcagtttactgttcatgtgctatcaagaaacaaatttaaagcaaaatactgccaataatatgaaactgataagcacacaaaaataattgagaactatgtaggaactgaaatatattactatataattttgtagaaaatgtactttccatttacatgttggaaatatattggtatattcatattttaacataagatatgcattgatccctatggcactaggaagcaatacagcacaattgaaagatatctgggatcagaaacacctgaatttgcttcttgaatctgcatgagtactgattataaaactactgactttgtaactctgggcaagttattcaatttttctaaccttttcacccataaataaaaatggggaagacattgcaagacttgtaaagattgaagaatataattttatgtaaaaaaagtggcctgtgtgatgtttacaacattgcttataataataataaagtcaaaaatcatccaagtatctatcattaagaaaatattaagtaacaacagtatatacaccagattagtggttctcaaattttagtgcacataagaatgttctagggggttgtaaaatgcatatttccaggccttacacttagaaattcttagaatactcagaaatcctggggtgggatcaggaaataacacgtttaacaaacaaccataggtgcttctgatggaggacatctatgaaaagtatgcagtagatggaatacgatgatgccattaaaaataactatgaagactttgaaatagcattgaaaaggtgtatgatatacccttaagtgaaaaattcaggatccaaacttgtacgctttatctgataactacattaaacatgcttaagaaaaaagttgtttttagcaataagattaaaggtaatttttgatcttttactcaaagttttaaatagtcatgctattattataaatgaatcactaacacattaaaattgaaaaaaaaaaacacattggatcctcatggccttcaggattaggctcaaactccttagggcaacacacaaggtccttctatctccagacttagctcttgtccatgctccatatcaaactacttataataccccaagctatattctatattttcacacactattattgaatatactgttccttctgcctgaaatgccctttctccaacttgtctggaaaattcctattcatcccacaagattcaagcactacctcctctctgcagtttcccctgaatactcctccaagtcaaattctgggtgcctccttcttgctcctagtattcctacagcattatttggtatttccattgctccatatatcaccctgtattttacctttttgctgatagatctatcccattattctgcaagtacatggggtaggtagagatgatctcatttagttttagaatccacaaagtactcagcaaatacttgttaaaataagtaaagacctattttttgttatcactgttcttagttatcagttttctaaaaaatcctgagtgccctgctggttagttggataacacttggctcaatgattaatgagctttgtctaatatatacatatatatatacacacacacgtagcataaaacaaacccatgaaaaatttttaagaaatagtttaaccattgtttgtaattcttcacgttctctgcttatgtcttcaaagtttctatcaaccttcaggatgacagaccactctggtcaatagccaaagcaggctaacaggaataactctgctctgggctcctccattgctggagtttacccagccaaagaacatccctgcagaattcttgctgcttcccccaaacacactcccactcactgccatctccgcactagcagtaaaatatctatataaaacagagataattctgtaagtaaatagagcagttttttagtatattcaaaacactagatactatatttagtatatttgtgtaatacataaaacatttcaaatgcagattactaactagaggtaccaaacaagaacctaaagtgactaatagtaattcaggccaaaaaaaaaaaaaagaaagaaaaatcaatgtggaagaatactaattgagatccaggtatcagaacttcaaatgctttccctgtaccgtaaaacataagttttaggaataacctggatgctgaagccaacttgcaacacaatttttttaaaaagaaaaacaaaatacattttttaacatttgaatctcaagccacattaggcattaaagctgtgatacaactttgttccatatctctgtcacctgtgatataataaatgtgtacagaaatacttttagtgcacacttcatagatactgtacttttttaaaaattgaagatttataggaaccatgtgtctaacaagtccatttttccaattaggccaatgtgctcagttcatgtctctgtgtcacatgttggtaattctcacaatatttcaaactgtttcattatttttatatctgttatgatcatctgtgaactgaataatgctgtgtgtgttctcaccactccaccaactggccattccatctctctccctctccttgggcctccctattccctcggatacaacaatattaaaattaggccaatgaataacccttcactgacctataagtgttcaagtgaaaggaagagtcacacgtttctcactttaaacgaaaagctagaaatgaataaacttagtgaggaaagcatgttaaaagtcgagacagactgaaagctaggcctcttatgcctaacagttagccaagctgcaaatgcaaaggaaaagttcatgaaggaaatgaaaagtgctactccagtgaacacatgaatgataagaaagccgaagagccttattgctgatatggagaaagtttgaggggtctggatagaagatcataacagcaacacaacattcccttaaggcaaagcctaatccagagcaaggccctaactctcttcaattccatcaagagctgatggagctggggaagctgcagaagaaaaatctgaaggtagcagaggttcagggggcttaaggaaaaaagccatctccatgacataaaatggcaaggtgaagtagttaaatgctgatgcagaagctgcagcaagttatccagaagatctagctaagataattgataaaggtgactacactaaacaacaaaatttcagtgtagatgaaacagccttctattggaagaagatgccatctaggactttcatagctaaagagaagtcactgcctggcttcaaagcttcaaaggacaggctctcttgttaggggttaatgtagctggtgactttaacttgaaaccaatgcttatttaccattccaaaaatcctagggcccttaaaaatgatgccaaatctactgtgcctgtgctctgcaagtggcacaacaaagcctggatgacagcacatctgtttgtagcatggtttactgaatattttaagcccaatgttgagacctaccactcacagaaaaaaagattcccttcaaaatattacagctcagtggcagtgcactagtcacacaagagctctgatggagatgtacaagagactagtgttgtttccatgcctgctaacacaacatccattctgtagcccagagattgaggagtaattttggctttcaagtcttcttatttaagaaatacattttgtaaggttatagctgccatacctagtggtagctatagaaccactaagaacatttgcgggccaggtgcagtggcccatgcctgtaatcccaacactttgggaggccaaggtgggaggatcacttgagcccagaagttcaagaccagtctgggcaacatagggaaaccctgtctctacaaaaaatttaaaaattatccaggcttggtagcacatgcctgtggtcccagctacacaggaggctgaaagcaaagaatcactgagtctgggaggtcaaggctgcagtgagcacagtgatcatgccactgcactccaggcctgggtgacagagtgagaccctatcacaaataaatagataaaacatttgtggttcatgggaggaggccaacattaacaggagttttggaagaagttgattctaactcttatgactgattttgagggattcatgatttcaacagaggaaggaactgcagatgtggtggaaatagcaagtgaaatagaagtgaagcctgaaaattggactaactgacaacaatctcatgataaaatttgaacagataaggagttgcttcttatggataagcaaagaaagtggtttcacgagtggaatcgactcctggtgaagacactgtgaacattgctgaaacatcaacaaaggatttataacataacataaataaagcagcagcaaggcttgagaggagtgactccagtgactccaattttgaaagttctaccatgggtaaaatgctatcaaacagcatcccatgctacggaaacatcttttgtgaaaggaacagtcaactaatgtgaaacttcattactgtctcatttaagaaattgccacagccatcccaaccttcagcaaccaccattctaatcagtcaccagccaacaacattgagacaagaccttctaccagcaaaaggattacaacttgctgaaggctcaaatgatcattagcatttttagcaatgaagtattttttaattacgtacattgttttgttagatataaggatgttgcacacttaacagtacaatatagtgtaaacataacttttatatgcactggataaccaaaaattttgtatgactcactttattgcagtggtctgaaaacaaatccacaatatgtctgagctatgcctgtacatctaagtaataacgtctgatataggcaaataatatatgtttatatctaaaatgggtttatataatccaataaaaaattctagagactaaatgagtagcaaaaagaaaatacttttctatcaccagccatatactctctcatttctcatgtctccagtcaaatcccttccccttcagcctttaagaaggaagaattagccaggcatggtggttcacacctataatcccagaactttgggaggccaagtcaggaggatggcttgatcccaggagttcgagaccaacccaggagttcaagaacagcaaggcaggaggatcacttgagccctcaacaacagaccccaacagacagggtttccctatgttgcccaagttggtcttgaactcctggattcaagtgatcctcctaccttggcctcccaaagagctgggattacgggcatgagccactgtgcctggcccacaaatgttcttaatggtgtctagcatggtcaatcctttccagaaggttttcaatttactttgcacagattcatcagaagaatcactatgtatggcaggagtttgaggaacagtgaggctctgtccttataaaaaaaaatcaaaaaattggttgggcatggtggcacatgctggtagtcccagctacttggggtctaagacatgagaatcacttgaccctggggggcaatgaggctgcagtaagctgtgattgcaccacagcaccccggcctgggtgacagagtgagaacttgtctccaaaaaaatggaagaattaccacctgtatccaacattctcttacgagcctggcaaaatccactccatttgttctgccagaagaggtcgatggctttactattttggcctaatgttttgttgcctctttaaatgaaaatacgaaaagagctgcttctttctaaaagctttaccaatcaattacaacttcactatgaattaactgtcaggtcccacaaacactttttggtggtaaagaaaggaaagaaaaggcactgggtccatgacgttagaggataaattaacattgaggtataagcattccctttcctctgcagcctcaccagcatctattgtctttcgacttttaaataacagccattctgactagtgtgagatgctatctctcactgtggttttgatttgcatttctctgataactagtgatgctgagcattttttatgtttgttggccacttgtatgtcttcttttgagaaatgtctgttcatgtactttactcattttttaatagagttacttgttttttgcttgttgacttaagttccctatagcttctggatattaggcctttgtcagatacacagattgcaaatatcttctcccattctgtaggttgtctgtcagtgtggaaggtagtacagagatttctcaaagaacctaaaattgctaccattcgacccagcaatcccattgctgtgtatatacccaaaagaaaataaatcattctaccaaaaagacacatgcattcatgttcattgctgtgctatgcacaatagcaaagacatggaatcaatctagatgcccatcaatggtagactggacaagaaaatgtggtacatatacaccatggaatactaggtagccataaaaaagaatgaatccatgtcctctgcagcaacatggatggagctggaggccataatcctaagaaaattaacacaggaacagaagaccaaataccacatgttctcacttataagtgggagctaaatataaagcatatgtggacataaataagggaacgaaagacacagtggactactagagggtggaaggggggtagattaaaaaacagcctattaggtactatgctcactacctaggtgacaggatccatgctccaaacctcagtgtcatgcaatatttccatgtaactaatctacatacatacttcctgtatctaaaatctgttgaaaattttttttaaatattcagataggctggaatctagagatgatgccagctggcacaaaaactggagccagggtgaacttgtagtaattagaaaaaaacgctttttttctgagatgtgattgaggagggttaaagggaatgtggtgtgggaaatagaaacaggaaaggaggttggctgtttatgctcacatccatcaatcaagatttgatccaatttgatcaaagaatggtaacaagtctaagcagtttgtttcagttcagttaactagaagtgattaaccacttcaaataaagctactctcataacacaatagaatccaaataactctactgcacagcttaatcaaagttccatttcacaactagatccatgaagacatgtcatttaataagaaacatgattcataagaatcagattcagagatgaacactctggacagtgcagtagaagaaacagagtgtcttagtctattttgtgttcctataagagagtacctgagactgggtagtttacaaacaatgtatgtttttgtgattcacatttctggatgctgggaagtaaaagagcatggtactagcatttgctcagcatttggtgaggaccttcttattgcatcatcccatggcagaaggcagaagggcaagcaagcatgggcaacagaaagaggaaattgggctgaactcattattttgtgaggagcctcccatgacacctaacccactcccacaataatggcattaatccattcatacatgcagagccctcatggcctaatcacctctaaaagatctcacctgtttgttttgtttttattttgagtagggtctcactctgtcacctaggctggagttcaggggcatgatcattgctcactgcagcctcaaactcctgggttcaagcaattctccccacccagcctctcaagtagttggggctacagacgtgcaatgccacacctggccattttgttttgttttgttttttatagagacagggtctcactatgttgcctaggctattcttgaacccctggcctcaagtgatactcccgtctcagcctcccaaagcctgcgattacaggtgtgagccaccacgtccagacagatcccatctcttcatactgtcacaatgacaaataaatttcaacatgagttttggagacaacactcaaatcatagcactgtggaaaacaaaatttatcctttggtcatattttttgatccatcttcaaatatcaattaaaagcctcatccagatttaacacaaatgtaaaatgtatttgatatcctactgacaccaaagaagaaaagtagactcttaagaaaagtttctagatctgtattacacaagaaaattcaatgagttttcaactggcattgtgcctctgcctgcccgtacggcttacataaccatgtcctcacatgcatgagaaagaactggaagatagaagcgtcttctttgtaaattcctttttcaaatataaaatattctcccatatcaacatatgatgagtaataaaaactcactgtattttaattaactaacatcattctgcaatatgtccaaaacggaaactaaagacactctaaaatgcattaagtgttaaatatcttcaggttccataggttgaaattagtcttttctaacctttgtctggcattatagtcagcttccatttctagttaaatactcaggaataatgttctatcataggcttctgatagaattttccaaaattacctcaaaattatttcagtatataactgaactaatcaaattgtttactgtcacctgaaaggttaagttgctaaagtcagcagaggcactaataaatattatatgcttctgccttaatgtcagtgaagacttgcatcagcctttgtcatctgtaagaaatcgagtcacacaagaaactgtgcaatggatggacaggttgagtagtagtcactggctggctgccctagttcactgctacacatcaccctcagtgttttgaaaagggagctgaaaaccctgctcagtggagaaagaggtcaataccaaaattcaccctcctttctccttactccccatcatgcagctggcactgttcactctggcagatacagctccctgaacataatggtgcaatcaccacttcaaacatcattactatctaaaatagataacccacttgcaacttgactatttttatagatataacattttcatggagcttaactgctctatttgtgatttattccatttaaccaatgcagtttccctgaaagtgagtttcttatatcagggtcccaataaccacaattgcccaaatagttgtgaaaattacagtacttcctagttgtctgttatctccctgtattcatcaccaaaatgacatgagctgaatcctaaatctgaaaaattataagctctctggtttttatgtttttggtgaccagaagattgttttgctccacttcttattgatctactttttcacatggggatcttaagaactgtattatttatttctgacaagaatttactaaatacaccttatataaaactcaactcttcgaggcattaagaaaatcaaataaattgaggcattaataaagttttatcactgtattaaaatacaaataattctctatcctatactcagcaaaaaattaattaaatatacattttaaatggaaattagttttgtttagaataaaaggtagttgtgccaaaggaagagaggtttttttttaagattttgcagctgtctcataaaagatatgttaaataaactgaaatttcacataaaatgtagaggaagaaaaggagggaggcaactcaattttagtgctctgatgagctcagatttctttaaggatgaaagggggtagtaagaggtataactgcaagcaaacacaaaaaaagaaatatatacttgtccaggaaaaatgctaatgtcctttttagctaagtttgaaaaagagaaaagaggtgtaacagttcactaatttcaccttcagttctggcagagtaaaaggaaaactgtgggtagttttaaaccacaagataattttctatgatatctaacaatgccaagaatctaattcttcccaacttttattttgcttctattttccctattgagaaccattttcaaatcagaagggataaacaaataacttcaggagattactgaaggtccaaacgagaccataagggacagtaagctgctttaaataagtatgcatatccagacccagaagaattagatgcaagagggtagaaggaatttttgccaatactaggaattaccaatggctcactgccagaaacaagccataataaagtagactgattttgatggaatttaaaggatagatcaaaagaatgccatacacttaaatacagtgtgaatttagaaaggcagtagataaaatacctcacaatattctcacaggaacaatggagagaaatagctgattgtcattgcgtggcttcaatcctggtagaaataccatgagtaaagactgttacttttaaatttatactaagttgaagagaggtgctttggggatatagcacagtgtgttgaatttaggttatagaaaacatgcttattacatctctggatgatacaggggagagaagttaatacgctgaaagacagactcaagagtcagaaagaagaaaaaaaagagtcaaaaagatatagagaaattacaaatacaacataaaacaaatcagataaaaaggaacaggaataatttaagctcaatcaacacttttaaaagtaccagaaaggggacctggcttcacaggtcattgaaaaaaaaaaataccaggaaattttaattgactgtatgttcaacatgagccaacaccattacatggcccagaaaatcttgacctgtaggtaggtcttagatcaataataaagagataataatttcattgtatcatgttttaatagctgctattttattttaattacataatacatattcattacagaacactgaaaataaagcccaaccacaattccaccactcaaagatgaatactatcttcattttggcatcttatcattccagacttcttaagcacattataagtgttcaaacaaacttattttttcttgcaaaaataagatcatactataaatgcttcttgtaacctgctgtccttggttttcttattcagccataatgttctactctggtcaagggacatctactgcattttgtgaatttctagtcaccatactttaagagggtcattgcaaaatttgagaatatgtaaagaaggaaagagagagtagagaaaagtatgaaaactaagttcttaacatctatgctgtcttgccatataaaaggttaacagagatgatagctcttccatgaaaaatacttataagaaaacaaaaatacatgcatctaaagaactatcctgcagatgaattagactgctttatattgacccatacagccaatctactaccaattgctgaaagtcacagggaagtggattttagctcaatgaaaagaaaaattttaaaataattacagctgtcaaaaatagaatgaatctagtcattggaaggtttaacagggctggaataactaacaggtaagaaatgttacagagaaaatttccgcactaggtgagaagttggaagaaagttccctccttatttgacgattctatgattgctatgggaaatttactcccagtccaataggaagcaaatctttagtcattaaggccttaaagaatacagtcaagtgctttagaggtgcatgaaaaatattaacactaacgatgaacacctatatgctaaatgttttgcattcattactttatacttcatttaatccttataatgatcttatatgataggtactattattactatttccactctgatagaatagtgaggcttagagaggtttttaaatttattcaatggcattcttacatttgctgaaaattgcagtgccacccaaaagcatacctgattccccattacatagttactgttgaaaggataatttcttattaccagtagataacaagtaatcagaagcatcttcagaaaagttcttgtctagtgaaccctcaaagggcagttgtgagatttttttaattagaaaaaaataccaaaatttaaggaatttcaaattattcttcatagcaaaaaatgttcagattggcctgtctaaattggccacatacctttaaacttttgtgaataaaacagattcaatgaatgagacttaaaatgttgtaaaacaaatctgaatcacagattttcaaatctttgccattattaattaagtgaccatgggcaagtccttaatcttatctttttattccttcatctgtgaaatgacaatggacctcctaaggctgacacaagaattgaatgagatgacacgtgtaagcacttagcatagggtctgacaccattattacacaacccaggtaataaagcaagcggggaaaaagtgccaaacatattctacagttccttctaaaacattaagaaatttcaaagtgtcattatgtttgacgggggacacattttccattatcctgccaataaatttctgatgacaatcatttttgaaataaagtgacaactaaataaaatgtgccttcttaggaatgtcattttatgcaaatgattgcccaaagaatacaatttcaactctcattttcttcagacactattcagtataagatggataaaagcaagtttaaaggttattggttttgtttgtgatttttacaacttggttcgaagtactctaataaacacatgttgtttacttttgttttctatgtgcaatctttgttgtagagctactactactactactacaccagcaaaagagaaaacctctcactcaagatatacactgtgggtcactattttgatactttagtgtccactaacattaaatacttggtgttttatccctaaaacttgacatctattctttaaaaaaaaaaaaaaaaatcacagctgggaaaggagtatttaaaggatgtttgcttttgagttttgtcacaaggagtgtttttaaaatacgatttatcacaataaaattaagtgaaattctcactgttctcaaataattcctcatgttttcccgaagaaattgtttattttgagaaaattctttcagcataccagtttttagacataatcatttttataactgatggatccacagcaaacgttgttattttacgtgtaacttaaaactgtaaagagataaattgctttcacataaactacatgtgactacaggcaattattagagctgcaatctgaaatatgcacacattgtctacctgtgtttgaaagagaagattatttaacaagggagtacacacaagtcatctctatgacctattgaaaaaatgtcccataaatattcattcttctgacatgaactatcattccaataaaatgtcactgtcaacgagtatatagaataacatatggggctttttaaaatcccatcgactatttttcaactcaatttatttcactgtaatagaaactttccattttcccttttagctagccctataattaattgcactgtctgaccaccacaacctatgagaacttgtgtaaagaacgcaatgtcatcacccaaaagtttctattaagcacttgtcaagggtagcatggaacagtttttaaaaaaccagggaaatcacttgggctttctaaaatttttacaactatagttgggttatccaagagatgttttaaggcgaagatatgaatgacaattgatgactccaaaaatacccaggataaattggatagccacgattttagaaactaaagagcttcccttgaattgtatctagtgaatactctccaggcttcctccctcccagttgatttcatttgtccatcaatacaacttttaatagtttctcaagtatggaaatcaaccccgctatttccaaggtactgctgaatgaagaccttgacattttttttaaatgtcatcttagaaagattctccaagcaataccagtctcacctacgacatcttcacgttaaaaggcctctaccgtactccatatacagtatcccaataccaacctggcatccttcatcctgagctataacaaccaagtttcactcagctatgtccaggtaactgaaagtattgctggggctgcctaacctgccccatcaagttttatacacaccctgtgctgaagacatctcaccagaaagaaggttcactcacttcattttgtgggatcataacccacggcacagcaaacgccttctgcaagagaaggtaggagccaccgaaggctgtggcttttgcagggtaattgcatgcacgcaagagattctctgccaatttcatttaactagacaaaaaaggctgcgttcaaagctgcaaatatgtaataaatgttgatggaaagcgggcggaacgtcgattttcttcaagcaacactagtacatgtacaagttctgcaccagggctcagaggaaaagtagcttactgacgcattgatggaaggctattttaaaattactcaaagaatctaaggcatcaatctgactgggaggctcatacctcctctccatacacgcagtctgttttcctacctaatttaagaatgaatcgctggcagccaccaggtgcaataaccgtgaggaggaggacgtatatccatcacaatgcataatgaggtgtgccaaccccggagctggtgcccgtccttaccttagcagattagacaggggcaggggtccggatccaccgcccaggatccctcctttcctgccagacaggagtttctccaccagagccacatttccagtgcgagcagcttccagcagctcctggtccttccccatagtctctcaccgactcccccacagagtccttgcccccctcgggtcctcctccccacccacccccactccccaaaatccagggccctcttcgccccaccctaaaataatgcaagagcttcagcacggagagctccctgcagccccaggcagggagcacgactctctcctcctcttcggggcgcagcttttacaatggggatcagaccatgtcttgaaagaggggctggccgagctgggagccgcgacgcgcccccacagccactcccctgaattcccaaggcctcgttcccgcgggtgcggcgtgagggggtggggactcgggggtgcttttgaggagcgggaggagggtggtgaggactgaggtcggaggaggaggaggaggcggcagagagagtcctagctggagcgggagcgcag

SEQ ID NO: 425 - DNA, 150923 bp, Homo sapiens
tgctgtacaacttctgttttatttttgtgtgctttttttataggatataaataatgacaaaaattacaaaatttataactggaagcccaagcttatttacacatatgcttctgtttcagcaaagctcctattaactttgctcctatacaattgcctcctggtaccatattttagtgttatttaactctcattttgctacatacatatcaacagtgaataggcaaaatatatacaaggaactgttcagttcaagtaatttaatattgtattaaaattcttcaacactgaactaaaaccgtatacatttgttagtttgaaataaaatgtagttattcttcaaaactcaccaactgatgaatgtaactgatcatctcagttaggtttaaaataatgtcagttaataaaaaaacattaagacaattccacaatttatcaatatcgctataatgaacttcaaaatgattcacaatatgattgttagaacaatatacattaaaatgttatttttttctataatgatattggtactgtttatataatttgattctacataaatatacattatggtatcatacaaatactccacagagacattaaaaaattaaaataccttaaagaaatgtaagtaaattttatttaatcaaatagtaagcaaactttttttttgtttgtctcaagaaaagttttattactttggaatttcttcttttttttttttgtatttattttttctagaaaaagaaatttttgcaatagaattttattaacacctttctcaaacaaggtttccatgacagaaatcttgacagcaggagcactagatttttttttttttaacatgttctttaaaacactgtgaagattaaaaaacaatcttggcaggctgatggctgcgtcagcacttccgggcctcctgctctagggagcatcaccagtattttgccaccactgagccagtcctcttggtagtagcagtagaaatttaattatttgaaatgaaaccagaaacatccctcgcaactaacctagttttcttatcaatgcattaatgaaacattcttttaataaaaatatttaatacaagacacattttgctgtgcataataaattcctctgctttgaatcattctttccttttgaaccaatcatttggttgaaaggttttctttctctgacataggtgattacatataaaatccacaaatatagaaatggggaaacagaatctcctggcaatcatatcacgggagttgtttttgtccttttgcattaaacgatactcaatgatagaatgattttacagatgctttggaggtgggaggggtagtgctgctctgatttcacctttaaaactgctgacagtgaaagcatacttttaggcagtattagagatcccctttacttttttttttttttttttttttttaaagaaaaggtattattttccccaaatgaagcaaagcaagtactggggcggagtcatcagaaataccttgggaggtggtggggaggggagtcgggagcatcagggaaaacccatctcaactcacgcctctcaggggttgcgactggaaagtcttgcgttttccatcactggtgcagaaagaacttccccaggaatggccagtggcctttcgcccgtaacaaggccgcacgctcagagcagtcttcctcctgggctgggtggacgcggaggcgcgaaggaaagcctgctccgggaccgcttggcgagcaaggcaccgcgaggacaggaggacggcgagtatcagaaaatcgtggtttcatacttggtattaatgcccctcttggcttcttggcccggctccacaatccacggtagattggccagagtcttttgctcagatgggtcgatctgctttaaaacagaaaggctgatgcctgttatacggtcgccgcgcgggtgcgcgcatgcacgcggacgccgctggcgaacccacgcgaggcccctcgccccaggcgcggggcggcgatgctggtctaggcggctcgcgggctcgctctttggacacacatttaccgcataccgactctctgcagggcaccctgagggtgacggtgaataaggcacagcccttgcccttgtgagcacacagacggggagcagacagaggcggatttcagtgctgagaggtgagatacgaggggaagagagggcaccatgtgggcacacacaccttgggagccaggggggcttcctggaggaggtgaatcaggcatgccactccccggctctcactctccagtggtttccatcacagtcagtcagaacaaaacccgaactcctcaccgtgacctccagtacccctgcccacctgatttttctgctgcagccacacagcttccttgctcttcctgcccgccaagcccacgcccagggcctctgcgctcatcatctgctctgcccgagttcccttctccagacacctgcatgcctcatgctctaatgccattcaggtctctgctcaaatgccacttccactggcacctgtattcctagaagcctttcctgtttactcctacaaaaagcaccccaacttttctgctctcctcttctgccttattcctgacaatacttattgccgctatgcgtcatcacatatttatttgttcatcctccactgccacgtatgctcatggaggcaggattttgtctgttttcatcactgccattttctccaaaacgcagaaaagctcctggcaaccccgtaaataataggcacacaataaatacttgttgaataaatggtatcaaaagaatgaggtaatatttaaatggacagccgaaggaccagcaagtatttgcctgaagacaggaggagggggcatttgaagtagatgaaacagcacatgcagcagtcccagaataatctatacaacagaatgaaacacagcctcatcttccactatatacagaaatcaactcaaaatggattaaagacttagagggaagacctgagacgatgaaagaactggaagaaaacattggggaaacactacaggacattggtctggataaagattttttgggtaaaatctcaaaagcacaggcaacgaaagcagaaagagacaaatggaattacatcaagtgaaaaagcttctgcacagcgaaggaaacaatcaacaaagcgaaaagacaacctacagaatgggagaaaatatttgcaaagtatccatctgacaagggattaacaaccagaataaataagggactcaaataactcaatagcaaaaaacaaaaataaaaaacaaaaacaaaaacaaaaccaactcaatctgattaagtaacaggcaatagaactgaacaggcatttctaaaaagacgacatacaaacggccaacaggtataggtaaaaatgctcaacatcactaatcatcagggacatgcaaatgacaatcacaatgtgatacgatctcacccccgctactattgaatggctagtatcaaaaagacaaaaactaatggatgctgatgaggctacagagaaagggaaacacttctacactgttggtaggaatctaaattaggaaaggcactatggagaatagcatggagggtcctcaaaaaactaaaaattgagctaccatatgttccagcaaccccactactgcgtatatatacaaaagaaaagaaatcagtatatcaaagagatatctgcactcccatgtttattgcagaattattcacagcagccaagacatggaatcaaactaagtgtccatcaatggacgaatgggtaaagaaaatgtggtatatatacacaacggaatactattcagccataaaaagaatgagatcctgtcatttgcagcaacatgaatgaactgaaggtcattatgttgagtgaaataagccagacacagaaagacaaatattgtatgttctcatatgtggaggctataaaaagtggatctcatggagattgagtagaatggtggttaccagaggctggaaagtgaagaagggagagtagggatgaagagagattggttaataggtacaaaaatatggttaaatagaaggagtaagttctagtatttgatagcacagtagggtgactgtagttaacaacaatttattgtatatttcaaaataactagaagaattgtaatttctcaatacaaaagaaaaatatttgaggagatggatatctcaattactgatatgatcattacatattgtatacatgtgtcaaaatatcacatagcaataaaaaacagtcccagaggtaagggaaaatggtcgttgaggggttggggtcagtttgcagggtggggagcgggaaggcagacagctaagggtgaggaggtgagcagggacccagtcaggctaagccttgagacaaatcctaaaatggtttcgtccctgtgcgtacaaatacaacgggacactcctggggcggggccgggctgtccgctctcaggaacggccctcaggtggatctacaccatggctgcctcttcctttggtgtttccaggtctgcctgccctgtcctagctgcctgctcttctcagagcctgaggttgtgggaaggcctctcccatttctctggcaccatgagctttgcagctgccttctaccgtgccttgactgtatctccataaagctgtggggaggacctcacgtgttcttagggatcactgaatatttcttaccaagaaatgcctggggctgaaggaactagaatactaatgcctgtcgagggggactgatcttgaagcacataaataacatcagtattattcactgtatattttcctatttcccttgaaggcatctggatgaatattctatgagctcttatgccacccaaccctttgtgctcttctggaagaagcctgtggggaccagggtaaggtcagatagaggcacctgctgtgaacagatttattcagcccacatgagaatgaatacaatagtctaagagataatctctaaaacattctgcaaattcctggacacttagcagcctaatcaatctcaaagatatgcttgtgaaatccatccacaggccctcattttgtcatccacagatattcactgaacacctgctatgggcctggttccggtggtgacaacacaggtggggtccctgtgtgcatgaaacttacatttttttttttgagacggagtcctgctctgtcgcccaggctggagtgcagtggctcaatctctgctcgctgcaagctccgcctcccgggtgcaagccattctcctgcctcagcctccctagtagctgggactacaggcacccaccaccacgcccagctaacttttttttttttttgtatttttagtagagacggggtttcaccgtgttagccaggagaatctcgatctcctgacctcgtgatctgcccgcttcggactcccaaagtgctgggattacaggcgtgagccaccgtgcccggcccaaaacttagatttttgtggaggaagatagacaataagccatcagtaaaaaaccctcaattaataaatgctacacagaattaaaagcagatgacatgcttgaaggtgactgggtatctatgtcagattgggtggttaggacatccgcctcttcaagtagccgagacctgaatgacaagatgaagtcagccatgcagaaaccgggggaggatattccaggtgtggggagcaggtggcataaaggcctcaggtaggagtgagcattacatagtcaaggaatgggaagagctgagcatcacagaggactgtggtgggaaactgcattctgggtacttggggcagagggtgccatgactgatctctgctgtgtggggaggggagtctcaaggagctatactgcataggcctggggcgaggtggcagtggccccgactggaagagagatggaggaagtggggaagagtggacaggattgagatatattttaggggtagggtggatgggatttgctcatgggctggatacagaggtaaggggaagacagggatccaggctgacttgtagactttgggcttgagttgcatggtgagtggctgtggggtggggaagttggtgagagaagagctttgaggggaaaatcaggaattgtgtcctggacatgctaagtttcagatgtctgtgaagcatcaaggtggaaatgtgaaagaagctggccacgtgagtctggaattggggggtgcccagggctggagatacagaactgggagccagtgtgttgggttgggtcagtgctgaatgggaggaccaggggctcagagcgtggcatcggaagaaagacttcagaggagatacagctcctggggatggctggtaatgagtgatggacacaggagcgaatggccggggctggagggaaagatcccgaaagtaaactgtcagggaactgtgagaccagatgctggaggggtcaatcctgtggatgttgatggtgccaagaagggtgacaggggtaggcccccaaaagaagactgaaaacaagaactgcatgttcacaaagggaggtgcctccctgcaaatgttaaaaatgcctgctgctgttccccatgacagtggaggtgggggctggtgagaaggaggagagacagttccagatggaaggattcgggggcgtgagagcaatgcattctgggggagtcccagggtttctaggatgcaatacggcagccggggcagaaaccagatgggaggctggttgggaatcttccagcttttgaatattgctactaccagaggaggccgctttgaagtcatgcaagcctgttgggacaggatgtctgcagagcctgtgggagggaaggggaagaaattcctggaggaaggcagatgctgagaaggaggggctgcaccttctgaacaggcaccatgccgcaggaagcctcagctgcgggagacaaagcacgcaggccatggcgcaggccttgcatatagcagggcagcctgtgcatccagcttcctctagctggggaccgaggacatcatcactgtgtacctctgcaaacctctctggaggccaggggcttgtaggaggctttgccctctgatgggatggcagctgaagccccagggaacactgctcccaagctttcctgaatctttaggtaagattcaccaagaacagcagtacctgctgctgagacccttcatagggttgctgcaggtgactgagaaagtggatttctctggaggctccaggttgagggagatggtgcccaagacttggtgggaaccaggcagaggtgatgatggacacatgccaggaggaggccaagggaaaggatgaagaagaggccctgggttctaatggcacccacaccacacaagggcctggttagcagccccttttcctcctgttcaaggttttttagaacatctgtatcgtttctacttaccacggacttgcgaatgctaacgcggggcttggggatgggtttggagggtttgttttcaaagctttctggaagtgtggaggagtgtcccccttttcttgcttgtagtgctagctggtaagcgacttcgaatgcctgtcccagggttaggatgatttcataggctaaattctgcaagaaaaatgagaaagcatttgctactggcacactgcaaattagaatgggtcgaatggctgaggaacactgagggaggtgaactagggaggaacttgaactacttcaccagaggcagcagcgattcggtggaaatctacaaagaacaggacactccgggtccaacttagggtttacaccaggctttagtcatttgtgaaaagaaaaatcttgggacctcaaatcactaagacaaacgaaaaagtcagctgggaactgtgttgggcaaacctgccttgcattctattcctaaataagatagctacaaagataaaaaagctacatacctccctcacaatttgcccaaaaggaaatttcctgtggacaaaagacagagctcaaagtcatgcctctgctcatgtgagataaatgcatatcagattgcttcccctgtcctgttgtttccctaagccagactaaggcataagtgactattcctgtaaattgtgtattcagtgaaaggctgatcttcagaaactcaaaataattcaactgtttgtctcttatctacctatggcctggaagcccccttcccatttctagttgtcctgcctttccagaccaaaccaacgtacttcttacacatactgattgatgtctcatgcctccctaaaatgtataaagccaagctgtgccctgaccaccttgggcacatggtctcaggacctcccaaggctgtgtcacgggtgcattttttttcttttttttttttagatggagtctcactcttgtcacccaggctggagtgcagtggcacaatcttggctcactgcaacctccacctcccgggttcaagcgattctcttgcctcagcctcccgagtagctgggactacaggcacgtgccaccacgcccagctgatttttgtatttttagtagagacggggtttcactatgttggccaggctggtctcatattcctgacctcatgatccacccgcctcagcctcccaaagtgctgggattgcaggagtgagccaccacgcctggtccacgggtgcatctttaagcttggcaaaataaattgactgagacttgtctcagatatttttggtttacacactgatagggcactcttgcttacagatccccagttagccccaggaggagcaggccccacagcccagtggccccaggagcccacaccattcaaagctctccctgtgggcagttggtttgtccccaaggccttggaaggtaaggggttactactggtatttctgctgagtcctgggagcacttcaaccttgcctgtgaggatgatcccacacactccacaggaggtgttcctgagaagtttgggtctttttacctcaaacatctgtgattcagtgaacatctacgaaacacaatcaaaatctaatttaggcctagaggagaggcattagtcatgctggtgtggcggctcacagtcgcagcagtgagcacgcaaacagtgctccaacagagccaattccccagctatttcttgaggcttttgctctccctgtgggtccactctatattttatcatgaaatcagcaagagacaggtgattctgtcaggctagatgccacgccaagcagcgcctgggagaaaagttcttttcttccgaccttcaatcagtccttttctcaagatgatttctagctttcttctcttctccaaatgtgtatctttgatttctgccttttcttccaagcacagcttccccttgtcttctctcactgagaaaccatcacattgtctgacccaaaagaggcagggtggccaccacaccctgaggtcacagagcatcagagaagcagatgcatactggtcacagagagtgttctgaaggtcactgtagcagctgagagcaggcatggtctgccccaagctttcttttttcttttttttttgagacagagttttgctctttttgcccaggctggagtgcaatggcacaatctcggctcactgccacctccacctcttgggttcaagtaattctcctgcctcagcctcccaagtagctgagattacaggcatgcaccaccatgcccagctaattttgtatttttagtagagatggggtttctccatgttggtcaggctgagcttgaactccccacatcaggggatccacccacctcggcctccaaagtgctgggattataggtgtaagccaccgtgcctgaccatccaagttttcattctgatgaatgtccctagaatgtccactcacggtttctcaaaaatcacagaaatgtcattctgctgatgctgatattgcaactaagctggccctctctgttcctgcccatctccaccctcatcaagcgctctgggagcccgattcccacactgctgctggggagatgtgtttgcgattgttcgcatttgaagatgatggagaggaagatgcaggatggtgccttctgaggccatgggaaagaggcccaagggttctagaccaaccagattccagatccatgccagatcaattgtgatggtctcagaaccaagtggggaaaatgcctctgagcttgagagtcggtttgagagaggatgtgtctgtctcctttaagtgagttgctaggaaatactgaccctacaagacagacatctgcctgctggagatactgcaccttgcacagcaagctgagcacttccttgcaacgaacactgagcccatgtttgcctccagagatgagtcagcctagtaaattagtaacgcaccagcaaatgatagtggaggaggtctgggagacagctctgaccatcactgcacaaagagggctgagctctttccactgcctacacttggcactcacgtcactgtcagctttgcctcttagtgtttgcgtgggtcccctctgaaaggcaggcagggcttccgacttctgtagtctcacaatgaagacacaggctcttggtcttgttcatgctactgtggaagatggctgattcccatctgttggggacatgtaccagatattcctgttctgggtgggaaactagactaagatgaaggtgtgagattcagtgattctgtaacatgtggtctttatctgctgtaacagtggaacttaatgagtgtgaattcctttaccattaacctaaaaacaagttactgaaagcgagatctacttaaagctccaggatcttcaaaggaaagtaaaaagaccttcatttgagcaagtgaggtttttcacatgattatgggaagcctaaaggttttgggagagaatgtgttagaagtcctgccctttcatttttaattagttcctggtattaggaaactgctcaaataagacacacagaccagactgttggattaagttttcctgcctaatggcttcttctggttccgcttacattttccttgacttcttgctttggttttattttagaatgctttgtcaagtttcttttgtgattatgtatagtacaggattggacactgttacctttcctctcttgtctgcagccctcctgtttgtggtactgatgctggatgccaggagggcccatgggcaccgagacacaccttccaagtgctgtgttgcccatcccgacacaccagggccctttcggggaaacagatgctcatcccatgggacctcaggacacatgtgtgaatggggaaagaacccccatttttttgtaggttcaattctcctgcctctcctattaacatccctaccatctgaaacgggaggagagttgctatcatgtacgaggagactctaccgggatgaggttgaaaattatattgtaacatcagaaggcttaggtgagaagcccatcttgcaaacctcaatgatgctggctggctctgaagagcccatggtgacacccagaaaatctgaaagcccaactgtctctgccttcaacatattatccctgcaactgtggggaggccaacgcctggtactgggtctggcacattccaggtgcagaagaaatgcttgcttgcttgctgaatgaatgaatgaatatccacaggactaactggagtaatcgtaacatttctagttaatactcagtctagctaccattaagggagaacttaataggtgtgagagatgtgccaagcattatctttgtttcatttaagtcttaccaaatcacatgcagtagcatattatcctcattttatagatgaggcagtggaggctcagaggggtgaaataactttccagacatcacagagacagaaagttacagaacttgacatgacccaatatctgtgctcaaaatcccccactcttggcccaacccatgtgtctacccagcttgtctctaagatgactgccatcaactctcccctcccgtgcacaccatggtgttcccctgttgagaagtcgaatctgctctttgaatctggactggttttactgacttgcttgacccataggatatagcagaagcaacatgctgaatttgtgaggttgaatcatgaggagtcttgcagtttcctcctgggcctctaggaacattactctgggggaattagtcatgtaaaaagtctcaccatcctggctggatgcggtgactcacgcctgtaattccagcactttgggaggctgatattgtttagctgtgtccccacccaaatctcatcttgaattctagctcccataattcccacgtgttgtgagagggacctggtgggaggtaattgaatcatgggggtgggtctttcccatgctgttcttgtgatagtgaataagtctcacaagatctgatagttttataaatgggagttcccctgtacatgctctcttgcctactgccacataagatgtgcctttgcttcttctttgtcttctgccataggcctccccagccatgtggaactgtgagtccattaaacctctttcctttataaattacccagtctcgggtatgtctttattagcagtattagaacagactaatatagaggctgaggtgggtggatcacttgaggtcaggagttcaagaccagtctggccattagtgaaaccccatccctactaaaaatacaaaaaaaaaaaaaaaaaaaattagccaggctttgtggcaggcacctgtaatcccagctacttgggaggctgaggcaggagaattgcttgaacctgggaggcagaggttgcagtgaaccgaggttgtgtgactgcactccagcctgggtgacagagcgagactccatctatctttttttttttttttttgagatggagtcttgcccttgttgcccaggctggagtacaatggcgcgatcttggctcactgcaacctgtgcctcctggcttcaagggattctcctgcctcagcctcccgagtggctgggattacaggcgcccaccaccacgcctggctacttttttgtatttttagtaaagacaagatttcaccatgttggccaggctggtcttgaactcctgtcctcaggtgatccatccgcctcggcctcccaaagtgctgggattacaggcatgagccaccgcacccagctgagactcaatcttaaaaaaaaaaggaaaaaaaaaaaagttcttgctatcctgagatcatcatgctatgagaatgcctgagctagccacaaggagaggctgcctggacaggaacaacggtttcagccaggccagcccaggctcaagatttgggagtgaaggggtctcaaagacattggagctccagcagacatcgcttggagaagactcaagacccagacagatggctccagtcgggctgccccagcatctccagccattgcaggcactctggctgaggccccagatgttgttgagcaggactgccacgcccagcccagatccctgacttacagaattgtgaacataataaatggatgttgttttatattttggggtggtttattacgcagcaagagataactggaacaccatgcgatgctgcagaaggctggttggaccctcattcagacaacaggaagatgacccatgagcccaggagctgtgatgaatgctgcttagccaggaggccaatcctggagccacccggtcccctggctgccctggctgtggggaagctcactgatcacagtgagcactaaggtgtcccatcccatctgctggctcaaaccactgtgctgcagtgaagtcagcaaaatcatgctctcatctccagttactacctcccttgggcataaattcaaactcatttagttttacttttattacctcacgtctctcgaatgctgtaacctggcctgtctccgaccttggctcttcctgtctcatataagctcattggaagatacttgctttggtctttctagcataagtcttttgagacacatttattacggcgattggtctggagtattgtctaccttacagagaccaccagtgaaagagagctgcatgtgtgtgcatgtgtgcacgtgtgtgtgtgtgtgtgtgtgcacacggggtgcaggtgtgagggttgattactgaaaacagcatactctgagccttggttttctcatcttaaaatggggataataccatacgcagtaccccctaactggattgttctgataatggctaataatattatttaaccaaatggcaataccggctagcatttattatttactatgtggccatgcaccatgctaagtgcttcaacatgggctctttaattcaatcctaaccgtatctgtatgccgtaggtctattacttccattttgcacatgagataattacgctcagaaaggttaaataacttgctcatgaagtcagcacccagacaaactgggatttgaatccagttgttctttctgagaggctatactcttcttgaccattacaccttaaaactatacataagataaaataaaaaaaattctgtaatctgttttaaaaagtttaaaaaacatgtgagccaattgagcttccaagtgactgacccatcttggctgtggtgaggtcacctactggcccattgcctgggtctcatgcccagtctggctgagaggcagcctccaggccgggggtgtacttcgtgactccacagagaccatcaacacaggaattcttcatctttggcttccccaagggtgaggtaaaagatacgaggcaactcccatcctcagtagtggctatttaggaagaagggtagggagtcccagtccaatggggaaaaacctcctggaaagcacaggaattcccctcttcccttcccttctcttctcttcttccccagggatttttcttttttcttttcttttcttttccttccttttttttttttttttttgagatagggtctcactctcttacctaggctggagtgcagtggtgtgatctcagcttactgccatctccacctcccgggttcaagtgattctcctgcctcagcctcctgagtggctgggattataggcgtgcacgcctggctaatttttttttttttttttatggcagagatggggtttcactgtgttggccaggctggtctcgagctcctggcctcaagtgatcctcctgcctgggcctcccaaagtgctagaattataggcatgaaccactgtgcccggcctgggattttgatctgcgaattaagaactgctacattagaggagcttaaggaaccactgtatcataaagataaatcctaaggcaatcaagggatgcaaactcacttttcttgtgcaagctgaagatatgcaggtcagcttatatttactgtggtttcttcaaggcaatcatggatattgaacatcaccacagatatttaccaagctccttccaagtgttaagggctgtgtccctggtgccagtcccatgcctagcctatagacaatgtccaggaagtgatcactgaatgacatgggggagtaaaagtgtccatcaagactctcattacatccagaggaggctcatggagagacaaagagatcttcctcgctgtcctcccgcatccttgtccccgaggctatacgcagcatattcatcggtctagtatgagaaaaattgcatcatagatggtgggcaatctgtcccctagaaaaagctctagccaccaaggtaattaatttattttaactggtacatcactaagatttttgtttcttagtttgaaaatctcttaggcacaagggttcactgatacatgtgcaaaaatattcattaaagtgtttaaatttttcattattagaggactgattaagtagaatactaggtagccatttaacatgaaaactggaggcgggtggattgcctgagctcaggagttcaagaccaccccgggcaacatggtgaaacgctgtctctactaaaatacaaaaaattagctgggcgtggtggtgcacatctgtaatcccagctactcggggggctgaggcaggagactcgcttgagcccaggaggtgaagattgcaatgagccgaggtcgcaccactgcattccagcctgggtgacagagtgagactccgtctaaaaataaataaataaaataaataaatcaataatgggttaaaagactacgtaaaaatatatgtatacatatacacatagataggatctgtatatatgcatagaaaatagcaatatggatcaaatgtgaatagtagttatcactgcgtattgagactggatgatttctatttttgtattttggaactttatttaaatgaggattaatgatgtttacagtcataaaataatctttccattttgataattaaaaacaagagaaagtcttttgcgtttaaaatagtcttattcttgctttttttttttgagacagggtcttgctctgttgtccaggctggagtgcagtggcacagtcatggctcacagaaagcttgacctcccaggctcacatgatcctctcacctcagcctctggagtagctgggaccacaggtaatgtgtcatcacacctggctgatttttgtatgttttttagagacagggtttcaacatgttgcccaggatggatcttattctttctgcatcaccttggggttctgagggtctcttcattctctggctgagagggctgggaactactttccagcaaaatctggaacctctctgcaggtgctgtcatggctcacctctatgtgccaggaagctgcccattcatttggcaaagaatcttgtttaggctcttcagttttcatactggatgccaattctaacatcttctcagtgagactttgaagtatcaagctcttcctttaagctgcaaccctaatacttctactccaagtgcggaattgaccctttaatggtccaacttctgccaagcccaagtgaaaaatgttgttacgtggatattaacttatagacatgcagtcaatccgctcttgtagctgtgcaaagtttgatctctgcacgaagtcaaactgcctatgaacttgaactgtattttatttcctttcataatgatgataaagcagtggcagcagcaactacacatgatattgcctactacatcctagggacgaggctaagtgccttctgtggattgtctaccccttacaacaccttacagaggaggaatgaccatcctcattttacgtgtgagaaactaaggatcagcgaaattgacaacttggccaagttcatacagcagagccaggattcaagtgcagatctgacttcagattagccagtgtttcatgccactgggctatcctaccttcattgctctcatgaatgtgctggtcttctgtgcctatttcattgaggcaccctctagaacaccatcttgtgttttggagattcactgtacaaatgttggtgaagacattattacacagtatcccctcatgggggcctaggacagaaagttccttcatacttaagtcttattaaaatactattttcggaagggaaggggtatacttttctttcaaagaaatatgcagcataaaattactgcatttccctttttgccttgacctccaggaagctcagagctaaaagctcagagctagagagagcccagctcccatacctttccacaactccatggtctgtatattgatgctacaacttttcccttgatatggagcttccttttagcctatattttccctaattcagatttgtgtgtatgtatatatatattttcagactactatacctattcatgtaggctgtcttcaatccgttatggaatgaggcatggtagaaacactgtccatttgttcacttagatatttattccaggacttactttgttgaatgcattgctgcccaaatggctgacaaggtatgtcaggcataaagcttcatctcatctggcgaatatgacgaaggagtaaggaatctgaggaggaggccatccagggaggaaaggccctcctgacccaggctgggaggctgctctttctgagtggaccattttgacctgccttgcagtgctttgcattaccattagaaacacaatggccacattttcatgactggaatggaatgaacaaatgtattcattccatagcatcagagagctgcaggcccagacaggggtcagcagaagctcacccacaccatgaagagggcacagatgcagacacgttcaagggaagggctgtgtctgtatgtgggagtccagggcagaaaagcttgggtgtcataaagtaccttgagatgtctgattgaaaagtgtctatcagtgaatagaggccataaacagagtccctggatcacctgcataggccagctccaccatgggctacctacctacagcacctattgccactgagaagtgggtgtggtccaggtgacctattggtccctttccaccctgggagtttcaggattctctgattagaaggggctatcttttacccagtcaactacagattcagtttagagatgcacgcacagttgatgctgtgctaaacagtggcatgttacccagaggccagactgcagggctccataacccaccagctagagctcagagaggcagtcaccaccaacgggctgcccttcatctcagaaaacaccttcattccagcaatcacccctaaatgctattccaaatggccaagcatttcatctattacaaaatggatttgttcttggcaatacatgcgtttgccatctcccacctttgcctggtgagttactgcttatccttgaagactcacctcgggcatcatatctccagaagccttctttgaatctcctttcctgtcctcccaaccctggctaagttaggtgcccctcctctgcggtgccacaataccttgggcacagccctacttaccacgtggtatttattatgattttctccttatagggctgattcccccagttgactgagctccttgagggctctggtctcactgggctttgcatctctagggcttagaataggtcaggtgctcaagaaatgtttgttggctaaacacaaaaaggaagttgcctggtaggtccctaagataagggaacttgcaccttaaggttaagaaaagggggaatatggatggccagagccaattccttccttctgtcttctctcccacaggcagacctgaagaacaaaagctagacaagtgcagataatgccacagggggcctgaagacacaagaaggtttttttcaatctgggttctcagtggggtctccagaaagaagcgacatttctttttaggctatattttgcttgtacttgtttttttaagacctggggtaagcctggtctacaacttgcttcacccacgtccggaggcaaaaataacttcgagaatattctgggcatattcacagacttcattgacatctctttagctctacctatagttagttctctcaagtaccagccagaaattagtcttcatagattgtacagaaataaatagtgcccaatcatagccttcagcatttagaaacaaatattagcaattctgctaagatgtctatctggggcaagatgacaaatcaactggccaaaatgcaggtagcttctttagggctaattttggctaactaaaagagccacgagattcctttatctccctaattataacaggggcagatgtagaaaattttgaaaatactaagaataaaggaaaaaataaaattcagctgtgaaattccactgttgggatatggctactgctaacatcttggtgcattttctttttatatttgtatatacacccaaatactttcatttcctatatgaatatttaaatatgaatttaaaaactagaatactttatgagtctaaaatcataacatattttatgtgcagtctcataagttccttttttgcgcaacattatctcatagttggtcttcgcatgccattacacgttcttcaaaaaccagatttttaaagggggtgagcgttccactgtatctgctgaggtttaactttatgcctcaccccaagtataggaggttgggccttactttgttaaaccacaacttgctttcttatattaatagcattccaggttccctgtggatgtcatgcactgcagcccaacacactggtcacctgtcttcatggaaccacagcctaaggtggctggccagcagccctgtcacacccatccagagggactggcctgcctgggaggaagaaacatgcaatctttatcctgtaacttggccagggtttgtgcaaaggtggtacaggaggaagaaatgccagatttcaacctctcccctgctcctcaaaagaaaaagctccagtggaagctgtagggaactcttcactaactttttgtttttttcaagacagggtctcactgtgttacccaggctggagtgcagtggcacgatctcagctcactgcaaccttcgcctcctgggttcaagcaattctccagcctcagtctcctgagtagctgggattacaggtgcctgccaccgtgcctggctaattttttgcatttttagtagagatagggtttcaccatgttggccaggctggtcacaaactcccaacctcaagtgatccgcccgcctcagcctcctaaagtgctgggattacaggcgtgagccaccgcgcctggcttcttcactaacttgtgaggcattggacatgggtcactcaccagattcaaaccttttaaatttgaacccttgttgtttaaatctttctcaaatggatatgcctgtttccttggtttagtcagcacagcaaatataaatggcttttcctttacttattgcagatgcctacctgataccctgagttcactattctaaattgaattaatgagttgccgtgcctccaaaccgaccacgtgttcactcacacagactaagtgttcagcttccaacctgcgcgtccctcctcttggagagcccaccctgctggctgctggtgcagtgcccgggtggcatggatctgattctgttgtaactatttgcttgtgtcccttcatctcctgctggaccatgagctcctggagagcagggatgtgtgtctaatgcatggcaggcactctatcaatacaggaatgcattttatgtggaatctgacttttttcctcagatgtggaagcacgcagcaacaaacatatgtcgtgaatcaaaaaccgggacataaagcctcacacagggtctgacaagaatataagcatcactattaactgcttctgctattctctgtgtcctcggcagctaagagttattgaataccatgtgctggaaatgcgtatgtgtcaccttgtttaatccttgcaatcaccataggaggtgtcctattataatctctattttacagattaggaaactgaagactagaggcattcttttttattttttgagtcagagtcttgctcagtcacccaggctggagtgcagtggcaccatcttggctcactgcaacctctgcctcctggttcaagtgattctcatgcctcagcctcccaagtagctgggattacaggtgtgtaccaccacgcctggctaatttttgtatttttagtagagatggggtttcaccatgctggtctggccagtcttgaactcctgagctcaggagatccacctgcctcagcatcccaaagtgctgagattacaggtgtaagccactgcacctggcctttatttttctgagacagagtctcatcctgtcacccaggctagagtgcagtggtgcgatctctgctcactgtactcactgtaacctccgcctcccaggttcgagtgattctcctgtctcagccttaggttcaagcagttctcctgcctcagcctcccaagtagctgggattacaggtgtgcaccaccatgccaggctaatttttgtatctttagtagagacagggttttaccatgttggccaggctagtctgggactcttgaccttaggtgatccgcctgccttggtttcccaaatgctgggattacaggcatgagccatcgtgcctggcccatggcattctcgcccaaactatgaagctaagagtgcagatctgggattcaaaaccagactgattctaaaggccaccccctgatcatgacacttgactgccagttatttagaagtggggggtgcaacaaatacatgcataaatgctgcaaagcaatctgtgaaaacaatttcagaatgtctggtttctaacttcacaaaaaatgggattaatttaaggcactgaaaactttgtctccccacccccaaaatagggatgagaagatctctgaatatccaaccacctttgtctttgtggcctggttagttctcagtgatttatgccaatggagaggagatctggataaatgaaacccagcactgttaatttatctattcttttttgggaggtggtggtgttagtgtagaaggaccattggaatgcgatgctgtcttttttattccatcagggccatttgctcctcttaggagctgcgtccttcctgcagctgacttgctggtgagtttcagctggctggacagggccagggaacggcttctcttttacctgtaggttgccactttgtatgcagaagagtaaccagggaaagtgttcgagttcaatttttaagggctctatgcattgtgacattttcttatattgccatttcttttcacagtatcacagtcaaataggttgaagtctattttcaggtggagaaaatgagaaacagaatgagagagatcacccgcctccatgatattaattcaattgtcagaggtgaactaacatcaataatagcaagagttcttttgcatctttaagttctcactttgtgggacaatctctgcaacataagccataaatatttttcttcagggacctcaaactactccatggaagtaatctcggcatttaaaaaagcactcaagaatttaaatttttctttcctttttttttgagacagagtcttgttctgttgcctaggctggagtgcagtggtgcaatcacagctcagtgtctcctaggcccaagagatcctcccacctcagcctcccgagtagctggcactacatgtgtgtgccaccatgcctggctattatttattaatttttttttttttttttgcagacatggggttgccctatgttgcccaggctggtcttgaactcctggagtcaagtgatcctcctgcctcagcctcccaaagtgctggggattacaggcatgagctactgtgcccagccaggaatttaaattttattaaactgatgagaaaaccaacaagcaaactcatagcagagccaaagttggaagtggtgtaggtatcactgatcacgaccacgtggttgatgctagtgtttttcttgccccacactttggctggctttgtgcatatggatgggagagtactacagaaggtgatcacacagtcggatgaccatgttttcctgcgttttgtcacttctgtttctccagcttagatcctcacatggcccacattcagccaagaaagcacagggaagagggagctccgtctcccacacgtcccacccaccctgcaccacgtcttcaacattctctacgcactcctgagaccgtctcagcctcgccatgtgctgcacaccgaggagcacaggatttgggagttgcaagtgaaaaatgagcatggttaaaaatatcaaagactgcaaacatattcttttcagaggagtgagaattagcaagggtctggcagcaaagccatggcttttaatgctattaaaaaggaagaacaccttttaacatttaaaactattgaatgaggctcttctcagatatttgatacaaatctgatactcccatggagaatgcatcaaaatctttctatgttgacttacatcaactctctattactgagaaatctagagtaactaagcaaataaaatacagaagacaacagttttgaaattaccttggttgtctctctctctcacctatagtggccttttgaggacgatcacttcagcctcgggatctggtggccactgaaatacccattccctctctggcagtcccatttgtgtagaattctctccactcatttaagagcagaggagagaaaagctgagtccatttttaactctcacaactcctagtctcataacacatccttcttttctgctcaccctacagttccctcttccccaagttctcactgcccagaaggtggagtttggggaagcttttgttctacagtgggtgagatgtgtttcaggcctagcaagttagggatatgattagaaatcagctatgacaacaacgagagcatagactccagaatacagagcaggcttggtgcttgcttgtgtgtatatattggcttttttcttgacaaccctaattctgttttgctctagtctttttattttcatctccccatcatttaaaactgaaaatatcacaagctgaatttatggtagattccaagcaacaaaagcaggcttagagatcatcaaatgtaacattttccaaaatgtgttctgcagaaggccacccctgtggggtgctctctaaaaaaaaaaaaaaaaaaaaaaaaaaggccgggcacggtggctcatgcctgtaatcccagcactttgggaggccgaggcgggcggatcacaaggtcgggagatcgggaccatcttggctaacatggtgaaacccggtctctactaaaaatacaaaaaattagccgggcgtgctggcgggtgcctgtagtcccagctgctcaggaggctgaggcaggagaatggcgtgaacccgggaggcggagcttgcagtgagcagagatcgtgccactgcactccagcttgggcgacagagcgagactccatctcaaaaaaaaaaaaaaaaaaatggctaccatggccaaataagcttaagaagccccgcacactccacccccgcctcacatctgagcacattcagggccctgcagagtcccatagtacgtaaactatgttaagctcacatcctagcttctgtagggggggctccaggcctcctttctcggactacaatttctatgagaaaatgctctgaacttcaaatctaactgtccataaactggaaacttcctagacatcactgaattttcttgatgatatcagataaaaacatgggatatgtgataacagtacataaaaacatgtgacccataaaaggtctttaaggtccaaaaagcagtaacttcacaattaaaaatgtatacatacttatttagctaaaaggttaaatgtgtatttgaggtattatagggtcttctttactttttttttttttttttttttttttttttgccatttggggcagcccaggggactgattcatatcaaaagaattttaagccttcaagactggactggtattgaactgccctacataaggatacaaaatccatgctcaaagaagctttttttagtgcaagtgaagcttgttgcatctcagaattgctcaaagtcccaggtcaagggtggtggcctttgttactaattttgaggtttgacaaactgttcacctggagaagattaaaatggaggatctgtgtaagatgaaagtcctttggagctggtatgagaatcctaagctagtaatgtttacattaaatcaaacatctggatgaaaagataaatgttaaggcaattctctacatgtttttctaagtgtatcagggatataacgttcatcataaaactaaacagttgactatttcttcccccaacatttcacctcagtattctggtgatatatatatatcacacacacgtatagctaataaactcaagggggcagatagtccacagaaaccagttttagtttcatgtggaaaaatactttagatactctgatgaaggcaaattatatattaccttaaaaaccaattttattgaaagaaatgctgcaatacttaggaaaaaggtggcgttcatcctgaaaagtatcagaatattcatgttgatgttcaatgcaaacacggtctagaggcagcaagctctgtggagtcaatgttttctttctgctatttctattttaatgtttatttattgctttcactttttcaatcctttcgtaatggcagtaggaaaactttggaagataaatacacatctgacaaacctatcttatgtcttttagcagaaaaagggtcaggctgttaactgacgtcagcaggcagggagagggaggaggtgaaggaacaaatgctgaacacctgttatttatgaagcactctacatatgttctttcatttcactcctggtgaaaacctgcaaggtagaaactcttgtctctgttctctagctatgaaaattaggactgggaaaagtccagcaacttctctaagaccagagagtagagagatagctgatttgggatgtgaactttggtattccgttctttctatgacatcaatccaacccctatagagaaaggtatttcacataaaccaaaatagatgtgaacaggatgaaatttgactgtataaagaaacaatcaaattttacaagaattgcaagttatgtttaaggcaccagaaacctaacactgcacatccttgtaaaccctgaatgaaatggctttaatcaacactttaatcccgtgcaaacaaacgcttcctgagatatttagagcagtctcgcagggctttgctttgcagtctttactgttaccacagactacttttatatcactctcctcaagcctccccaaatggaagggtttgtttttttttttaaaggcccatgatcattctttcccattttcaatctttctttaaaaaccaaaaggggtgaggaacatgtagcatgatacaaatgctctgagcatgaactgcctgactcacggaccttaagctggtatagattttggattacagttggccttggcctataggtgttcatcagaactggaaaacattgcttcaggcagtcttctacccatgacattgaactgggggctggcctctcacgaatatatgaatacgtgattcctgattctttaaatatgtatatttcaaacccagtgagcagagcagaatcatcaaacttaagtggcattttcaaattcttctgattataaattattaatatactatatcagagatatcctcaagcaatttgtaccaccttgagggcatatcaatcttaaagaaacatttgttatttcctttaattgtttccattttccaagtttgtaatatatgagctagtcttttaggtttaatgacaagtatggctataaatggaagtggtgtaatcccataaggatgtcattacaagaccaactttttttttgagtgacggtttcactctgtagtccaggctggaatgcagtggcacgatcatagctcagtgaagcctcagtgtcctgggctcaagggattctctcatcagcctcctgagcaactgggactacaggtgtacaccaccatgtctggctaatttttttttttttttttaatagggacaaagtctcactatgttgcacaggctggtcttgaactcctgaactcaagtggtcctctcaacttggcatcccaaagtactgggattataggtatgagctgtgcctggccaagagtaactttttttaaaaattgagacagggtctcactctgtcacctgggctagatggcagtggtgtgatcacagcttactgcagcctcgacctcccaggctcaggtaatcctcccacctcaccctctcaggtagctgggactacaggcatgtgctatcacacccagctaatttttgtttgtttgtttttgtagagatggggtttcatcatgtttctcaggctcatcttcaactcctgagctcaagtgatctgcccacctcggcctccaaaagtgctgggatttcaggtgtgagccactgagcccagccaagactaatttctgaatgagcatatgggccaaatcttggagttcccaattaccacctgtaggtatctgatctgactcctattcaatatagaagactgcagatttgtatgaggcaaacacacctattatgccctagtacttagaaatggctactagagaaactgacagacatagtgagggacaaggaggctgtaagacctttactatgttttggtgccagagaaacaaagggatttctcaagtctgaaagtgaaattagtaaatgagtaatggcagttgagatactaggtagggctggcattctaagttgaatggaagaatgaaaatatcgaaaaatctccaaacagcctagtctgccaaaatgtacttggtgttatgagtggaactgtgacccacccaaaattcatatgttgaaggcttaacatgcagtaccttaaaatgtggctgtatttgaagatagtgccctgaaagtggtgattcagttaaaatgaggtcattggggtgggccctgatgcaatctgactggtgtccttacaagaagaggaaatttggacccagacatctaagcacagaggaaaggcgatgtgaggacacagcaagtacgcagctgtattagtcagttctcacgctgctaataaagacgtacccaagactaggtaatttataaaggaaaggggtttaattggctcacagttccacatggctggggaggcctcacaatcatagcaaaaggtgaatgaagagcaaagccatgtcttacatggcggcaggcaagagagagcttgtgcaggggaactcccatttataaaaccatcagatcttgcgacacttactcactatcatgagaatagcacaggaaagacccacccccacgattcaattacctcccactgggttcctcccatgacacatgggaattatgggagctacaattcaaggtgagatttgggtagggacacagccaaaccatatcagccgccatctacaaggcagggagagaggcctcagaagaaaccaaacctgccgacacattggtcttacacttctggcccccagaagctgtgagaaaatgaatttctgccatttaagcctctcggtctgtggtactttgttatggcagccctagcaaacaaatacacttggtatgtatcttaataccgggtaaacaagccaagctagtgtgttaattataagttgggctttcaatacagtccaggcccattctgcaaagtctttaatctgttgaaagggggtgggtactcaccacatcaaaggcagtaaacacatgacagtagtggtgattagacttcaaatcttttgtgatataggcaaatgttgagaggtcttctgggtcctgggcagcacaggagatattacgaatttcatgctcagcaattatgttctggaagaaatgacataaatgatcattgttttcctctgcgaaccagcatatatgacaaccaagacaagtaacccaggaagcagttgctttccttctttctggagtgttctagactagcaacactcaaagtggtccactatattatttgtgggtaaatgaataccagatatggaagaaatattttcatttaattaaaaacaacctaacacagtcatatcctggagctgcagttctcaccagttgctgtgcatagaagcagtctgggtggcggccactttttttttgtttgtttgagacaagagtctcactctgttgctcaggctgaagtgcagtggtgcaatctcggctcactgcagcctcccgctcccaggttcaagcaattctcctgcctcagcctcccgaatagctgggactacaggtgcatgccaccaggcctggctaatttttgtatttttagtagagacggggtttacaccatgttggccaggctggtcttgaactcctgacctcaggtgatctgcccacctcggcctcccaaagtgctgggattacaggcgtgagtcaccgcgtccggcctccactttaaaaaataatagtaattactaagcatttgactgtttccattccccatgtccacctgtagctgtgcagcactgctttctgctaattctgtatggaggggagcatctgtcgctttctctgtatgagaagagatctgacccaatgaggctcttcaaatccctcgccatcatgcttgcacgttgttcttgtgtcctgctcctcctccctcagagcaagggcaggtactgaaggaagcaggcaggtggaagcctcaaggtgctttctccgtggaaactaaggtgcaggggcctgataagagaaacaccatactgcaagattcaggccttggatgccttgcttgatctgggccctgtggctatattaacaacactttcctaactacatccactgtgtataattaggaggtggtgctgttgctaccattatttacaggtgaagcaactggtactcaaagaatttaagtgccttatgcagagcaggtgctggggtggaactgaaatttggggttgtctgactgtggagctcaggctctttgaaatgcattgcaatgcccttcaacgtctccacctccctcttactggcttaacaagaattgagttatttcttctctagcatctctttgtgccttcttccctggtgggagaaaggtttaagtaccattgtcctgaagcacaaaataaccacgaagcagcttggctgcaaaccctgctagaaacttcttttgatacatagatgtgtttaaaaagaaaaaaagaaaaaaattcacataatcttgcaatcattttcttatcttataatatcccatttatgtttttttgcagttgtcacagatctaaaaccctcgatgctttagttactctaattactttttaattgcgctgtcttaaataacctgttggcaatacagtgttccgtgtacagccatcaatgcctaaaaatgcttacaaaatgtccttccctgccagcacccccagcaagtacttcatgtccctcactttaccaagctgagtggttcggaggcaattacagaattaactcacaaaagaaaattaaattaagacatttttcaccgtggccttttgtgttgacattaatgcagtgctctgtcaaaaaataactcaaattgcaattggaatcccataaacaagtaacattctattgcaagataagtttcagactagaaggtgatgatcctcttctggcatccagatagcattccttcaagtagaaaaccaaattagggatgggtgagtcttaaaataatgttaaaatgagaaaaaggtgcaatgtgagatggtgtgggaacctctgccattatcttgattgggggcagccaatgccctgggaagcctgggtggatttggtctcacttgtccaggaggcactgtcacaggaaataggtgcttcaacttttactaagttggcattttgtgttcttgagatcttttgcaagatctcaaggtagatgcacttcttgggaaatgaaaagtgctctgtgatttttattgcactgaactctctgaatcttgccaactcatgggatgccactcttgacaatttccaatggtgcacggcagcactgtggcctgggggaaagttgcaaaggaggaaaagtatatctttggtactctctcctcctgtgtctttgctgacccctgaattttctggagccctcttcttctctttctctctctctctcttttttttgagatagggtcttgctctgttgcccaggctggagtgcagtggcaccatctcagctcactgcaacttctcaggctcaagcaatcctcccacctcagcctcctgagtagctgggactacaggcatgcaccaccagcctggcttattttctgtattttttttttttggtagagaaggggctttgccatgtttcccaggttggtctccaactcttgggctcaagcaatccacttgcttcagcctcccagagtgctgggattacaggtgtgagccactgtgcctggcccagccctcctgttctctattccccaggagcccaggactgtcttttagctgcccagggaggcctgacctctgtgatactccatgttccaaaatcagccttctccccgactgtggaaacttctactactctgttcccattgtctaagctataaggaaagctcatgctagttaaaatattctatattcaggtaggaataactcatcattgtggtcatcctaactggcgcttaaaagatgctcttgaatttgtattgatagcctgcggaggcaggtatttttgaacagacctttgtgatatattgccaatgctagaatggggtaaggtcctgggatgtcactactgaaatactgccatcactctgcattgtctacctgtgcagaatggtgaagccagttctctatgtgcaggacgaatcaaaggtcaaggatactacagttgtagactgtatggagactagatggtagacttcctccttggagaagaagccaaagaggaacacattctttccaccttgtgtcatgcatttatgagtggcttttccacaaattaaaaagtgatgtcatgaagaggtacaggtgatgcacctcagttgaaaactggactcctcacatgttgatcagtctccatttctaagcacattttaagaaggccagagctttaaaaggctcaagagaagaactggggaggggctcctcctgcctcttcttggggatagaaattctggcagcatagcacccttcaatagggagagatggttttgcctgtctgttgtttgccatcatggtgagaaacagctgaagaggtgtcttgctggtaggggtaggacaggattctcgggtccagctaactcatatggtggttctgagaagggcgcgtggtgatgaagtgatgcagcttagaaatctgcctctcgccactgcattcaatctgagccccgacaggtgggacctttctcttgcatctcctcatcagccgggcttttcctgagtgaggagactgcagtgttccctccagggcggggccaacagtatagacctagagctaactggtgatgccctgtggggcacgtgatgctgagaacagcacatgtgcttaacatggccttaatttgtctccaagcttcttaggagtatttgctataaaaaaaaacaatgggaggcccactgcagtgactcatgtctgtaattccagtgctttgggaagctgaggcagaaatattgcttgaagcaaggagtttaagaccagcctaggcaatatagcgagatcccatcactccaaaaaaacttaaataattagccaggcttggtggtgcatacctgtagtctcagctgctctggaggctgaggttgggggatcacttgagcccaggagtttgaggttacagtgagccgtggtggcgccactacactccagcctgggcaacagagtgagaccctgtctcttaaaaacaaaacaaaacaaaaaaacccccaaacaacaggcacttgtttaggcaaatgttccaaagtattttgtgcccctaaaatagcataggccttgtttaaaattggcattccaaaaaaatttttaaaaactcaaaaaacaaaacaacaatgaaagcaaaaaacaaaccctggcactgcatcatttttaatttagccagatgggaaggctgaggagggagtcagcacaggaaggcaaaatgcaacctgctcctcagctgagcactgaatgtagaaaccgtgtctcctctcggaagacctccctccccgactcccccaacctgaagaagggtccgttactaaacagttgcagtcccccaggccgaattccctgctagagcaacctttgggctattgatcaacagaaggctgaggtgatttatctaaaacactttagtgctaaatctattgcaagttccacttttaattcaagatcgctttctgcttcctccttcttaaatcaggattagtgattcaattcatttcctaagttgctaggcaatacatttatgagtttataactaggcctctaaccctttcccatgaattcagccaaacccatttatttattataatcaaaggaaagaaatgcttcacggagggttaatctttcacaaagtctaatgggggctaataggaagggaagagtaattaacacacaatgaattatcacacaatgaattagtttgcacttcaaactaatttgtggaaggtagctgtggagtaacagaaaaagcattaggttagggaggttgaaaatcaagttttagtcgttcttcacgaccaacaggctgtgtgactgcagggcagcactgagccaagggactgaggccttcaggtctccagctgcccagggcagattaaacaatcacctctctgaccaaggcaggggtacgagatgcaaggttaggagagtactgttgaagaataaagtacgatgaaaacataaaatatgaacagtaggctgggcgtggtggctcatgcctgtaatcccagcactttgggaggctgaggcggatgattacctgaggtcaggagttcgagaccagcctggccaacatggcgaaatcccatctctactaaaaatacaaaaattagccgggcatggtggcacacacctgtaatcccagctactcgggaggctgaggcatgagaatcgcttgaattccaggcctagtggcctctagtacctgaaatggtgagatctttaaatatgcttgcatattaaaagttctttgcttcaaatcaaagtggcccactgacacagcactgcccagtgggggaaatccctggtgaaaacagaaagcaggactctggagtttatcaatctgctccttttctgctgtgctctttgctctagaacaaagtagcatacacaggtgtcctcgcacacactgctagaatctaggtatctgggcatggttcctttcacaccacaacttgaggatgatccttcaactgtggatcctccgtcccttctgaagccagtcctcccaccctggctgatggtagtatttctcagtcttacccagtcaaactccaccaatacggccttccactattttctttcttctaacctgctaaacacaatctctctacttgggctccctacacagcaactactagactattgccctgagtcacccacactctccctacccactgtcatactgggggagatcagctaccttgcaggtcactgggatgtggaccctgtatagccagttgaaattaacatccttcagttccttaaaaagccaggcacatgttgtcatacattcacagactggctccacttgccaccaacataggcactttgcctttgctctagattctgaaaatatgttgaggaccacactgcaaagacttgaaaaaatatgctgaccttctttatttagcatctttatttacatagaattatcttttgcatatctttctgtgcttttgcttccaagagtagtcatcagtgagcagaggtttatggttaactcatctaattattggcaattgaagtagaagtatctccttgaggcacaggagcatcaacttctgtgtctcttgccgtgtcagtaagcaacatacaatggaaccggcagagctctctttcattcctctgattgtggagagtgggttagagaaaatgctattaatacagctgcatccagccatacccccaaaatcatgaaatgattgccttaggactgtaggaacttctcagggcaaataccacttgtttagaaattgtcagaatccaagtctgctaaagttgttcatctaagagagtgtcaaattcatccactgaaaatatactgctattcaagctttccaagcataaatgggatagagggagttgtttcaatttagggaaaaaaaaatccaggtgccaaagtctttcttaagatttagatacagcaatagcaatggtatctttgccattctataatgtgttccataaagtgttagaacttttaaaaccaactgactataatttaaggataaagtaattttatataccaggaactaaagatgcttccaagaaataaaaaagcaaatcaatcagcattgttcttatttgagtctccacaattattatctgtcaacaaccatcaacaatattttgcacagttggaatcaccattatgctgatattattggtcagcatgatgctgggttatatgctttttgcctgggtttcagaactttttctataaccgggaggttgttttcccaagcagatttggggaacttgggtttacctaactactgaaacaacaatctctttcgtcacagaaaaccaattggaaaaacttccgattcagatgctggggtttaatagagacaccaaagagtcactgcccgtgagacttttccctggaacctaaatccagttgccttggccctaagttgctgtttcttaagttcacctgtttcatgacttctgttccctttctccaaaacggagggggtccaggtgggaggtctgggtgagaggtccagagaaagaccagcattcaccaatggtgatcacctcttttaccctccttctgtacttgattagttgaaaggatgcaggaataaaacacatgaacgtttggggttttgtgaggaggagtcagtcagctttgagtttatggagagggacaatggtcacacccaagctttctacttcagcaccacgatgctgttgtctttgtcaagaaaggaatgctttttcagtaaaatgcaaccccactgaccacgcttgacatcacagcccacaaactattcccactgtgaggaagaagtcacagcggagccacagcatggcctgggctcttttctgattgtgtctcttaagaaaacagtacagctgaaactctctcccatctcagaggctgggaattaaatgtagttataaaattaaaaagtcagaaaattatcaacagaaaagacacatatatatctctagataaacagaaagacaaatgttctagccctttatctagtaacatctcctctgatggaggagtgatgacattgttgacttttcaatctacaagtgatttttgttttctgtttcaatgttctccagatccaaagggacatgctggataataagtggccacagtctattagagaaagcatcatgacaaagtgaaagcacaatatttatagaaaccccagatcaagcccttcccccaaatggttcctttctgtatgtatgaaggtgtgtatgtgtgtgtgtacatgagcgtgtatctataggtatatgtaggaagcatgaaggttgggggaaagggatgattacagtggggagtgctgggtattataggaagcaaaggattttagatcatacactcaggactgcatctggtgtctaaaccagagagaggagtggtacttaccttatttgttgcatcaataaatttgactcctttatatgagacagaaagaataatagtagggaccttcttcatttgctctgtagacttctgaaattaaaattagaaagctgttagagcagtttgtgttgcgtggcaactgaagcacacaatttttcctcctgaaagataaagatgagctcaaattaaaaacaacaacaacacacacacacacacacacacacacacatcagatacacaccacgcacactctaattttaatgtctgcctctcctctcttgggcttagctatacttcgggcttataaagttatccgtcttgcccttgaggatctaaaaagagtttgttccgctactttgtgtggatgaaggagtacttcttttccctgacactaaagggtgaatgaagaggtctgtctcctactgcaatttcaagtgactgttcctttcacaagagttaaaccacatcggacttaactccaagggtgcatttgacattaacaaaatatatgcacccccccttttcctagttaccttcattcttccaggcacagataatgcttggatgtatacttaaaatagggatgtaaaagatatcactatgtattgttcttgaactggaccaaatccataaatgctgatattatatttacagcagaatcacttgtgaccacaagggatgtaatgatgctctagaacaatgaagccctccaggagcagtctgggttttgagccacagcaaaatgctggacagcccaggtaacctactttatcatttagagctgctacattcccttaggccaagttcttgtgatagatgttcacactggctgaatgtgcttagagtttgcagcttgtacagttttatgcatctgcaaaaagtttctctataatttagtatgtgcctttcctgtttagctttatcattcatcaccagtcaccagcagtcagtttacttcattgccctctatatatactagtaataatcacactaaacatcaagaagaacctacctgacagttagcctggtggattttccagttaagacagatgggaacataataggagagaaaacatataaaaggtgagagagaggaaaccatttcaataattcaccaacagtgtaaattcattaaaaaacaaaagatgccacaaaagaacaggcttcagagtcatcaaagatgcagtgccactgttattttagaaatgctgcaggctttcaccggcccctttctttctctgtttctcatcattctgtttactgcaccgcacagtcttaggactgacacacaagaaccttccactttgagctttcaacaactagttgtcttatgtctattaagggaatcaggaaaaaatagaaactttcttgatttattcatttatatttcccaattttctagttttaaattctggaatgcagccagaattcaggaaggcttttaattggatagtgtgagtgaaactcattgaactcaatgatgagacttcaattgcatcttttagttgagctgtgaaaaggggtgtttcacattttcctgattgttttggcacaacatctttttgagagttactacgcctgtttcaaaaacaatggcttactaaaagtattgttatttaatatctgttgttgtatacaggatgtgaaaaagcagctctcttgctttttaaccagttttgaaattccctggatgcatcagtgttcctttgtgattgccaaaaagagagattatgaaaataaaatataaggttagaaactcgttttaatgcttcttccaaccacttcttaaaaatgtgcaagacacatcaaaggcaggctagaagaaatcatgtgcaatgtgttgattttaaggcaacgcggtggctgaactctgtaaagagggagggctggggcagcccaggcgatagttggaataactgaatgcatatgtgaaaaattttctgcaaagcgtcacagtggatttcggtaaatcacctcacttatcttttgccatgaatccattctcctggacagatctatctgtaatgcaaagcaatatacagctaatattcagatgaaaatctattcgttatttgttcagcaatcgagttgttactttaggcaacccactgtgcttgtcactggaaaagctcgagtctagttcagggatggcagacagacctcaaactgtgtgcaaacaccagtctgctgaaagcactgtgttgagaaagattctgagctgtgtctgagctcagtagaaaagagggctggaaatgatgtctgccatgggagaagaagaggacgaggcggcccaggggctacacatgaacatgcctgctaggtctgataggaagaacagctacaattacaatgttgacaaatgtgacaggagcaatatgaacaacatgcctccaggatagtgaataaaaacagccttattttgcttgacagagtggggccagtcttcattcattcattcaaaagacaatgacggcctattaggggtgattgagctgactcttgatgaataagcattttccaagtagcaaagaggccaaaagaggctgttttagcaacagaactaatacatgcacagaggcctagaaatgagaatgtggtgggtttgggtaactggtggagatgagagtggtagagtaggtttggaaggttgtgacttactctgccaagttagggtccgttggaagcttttcactagagagtgacacaatcagacctgtgttgcagaaagattcttctggtggttgtttatgaaggagggactggaagagctagaggctggatgcagggagtcaggaagttattgtgcaaatccaaaggagagagagaccctaagcacctgagttgaagtagaggcattggagaacaggaggaggcaccacaatgtcgatgaggaagaactgagaggttctgttgattgatctgctatggaagatgaatgggtgggaggattccacagatgaagaagccactgagataaggaatactggaggggaaagtgtttttgcgtaagcataatggaaatgcttttgcacatgctcagtttgataagcaggtggagatatccagtaggaaatgagaatcagatctggaaatccacctacatacatggatggccaaggaggtgggagtggacaaggtggtttaaggagtgaacaagaaaagagggaaggacacacttcaggggaagatgaaatcccaaggggtggggcagaaacaagagctaatgaaggaactggaattgaagttggaagatgcctacaacacagtatcacagaagccaaagaggagagggcttagaaggtaggagcaatgccccatgccatgaggactaacaaggcctaaaatggtgtgcctaccacagtggctggctcacacaggagctgctactttcattgggcttactgggtggaattcctggcttttgcaacaagaaaaaattgttgctgatttcattaagagtagcttcaagaaaatggtggcagcagctggagaggagaacacagtgagctgtgcaatggatgccagttaaaggaagcagaaagctggaacaacaggcaggtcaggacacagctcttgagctgacatgaaggcatcagcggtggttcctgtgatggtacaaagatcccacatcagatgctcggccaagttgaacaaaaaaaagaaaagatgaaggatagtcatttctttttcttccatgggtcccaggaatctctgctctcctaactggaggcagcactatggtgtcagtgatgcaggctgtgcacaggcctctatgaatggcagtgttgggggtggccatgctttccaatctggagcccaaactgtactgctctctccactgagtcatttgacaagaagctgatggatcctgaccagccagagagttcaaagggagggtgggaaatcttctgggtagagcccctccttgaaggcatttatacaccctacaaaagataaggatccatcgtcttttaaaggggttttctgatggtgtactttgacaagagtttccaaagaggtcttttcatacataatcttagcaaaagatgaaaatgcatagaaagaaggcaaagaggctaggcatggtggctcatgcctgtattcccagcactttgggaggctgaggtgagcagatcaccagaggtcaggagtttgagacaagcctggccaacatggcaaaaccccgtctctactaaaaataaataaattaaccaggcatggtggtgggtggctgtaatcccagctattcaggaggccgaggcagtagaatcacttgaacccaggaggcagagattctagtgagccaagatcgcgccactgcactccagcctgggcaacagagtgagactccgtctcaaaaaaaagaaaaagaaaaaggaaaaaaaaggcaaagatcaaagttattgagtcttcagggagtctaatctgggaggcaagaaatctagtaagtgcccacttcatttcatgaaggctttacaggcatcaaaatgtgagcacggggcttcagtccaatcacaggcagtcaaagtccctccttccccattttctcttcggtgttatgatcatcattcttttctccttcccagggacgaaggcgcctactctgaacatcaagttactgagcacgtgctctcaggcaacactggtttctatgacctatctatctgcatgctctgctgggtgtctgtataattaatactcccatatgtttctgttaaaaattcaagctttattgatttgtataaacagaactctgtacttcaggcccatttccccagtgaaagatgctcaaggcgaaccttctgttatcgttttctttcgtttctagttgcttttccctatgccatgctctttgtggcatttttcaggtttcccaatgttctcaaatttaccccccttcagagccagctttacagaagagactaatttgtaatggagacctctgagtacataagcagataaatactcctgggtaaggctccaaattattttaatttttacagcatcttggtcacctgcaaaaagcattatagtgatattcaaatgtattttgttcacaatttcccaaattaagaggatcatacttttatttttccaagagaaatgatatttagttatatagagatgttacgtttctgaaatctaaaatacaatgcaacatttgaatcctaaattcaaaggcagtcttctctttaagcacttgagtttatattgtctataaccattaaacagaaacaggaatcagaatttcatatctggaggtggccacctgaaatattgttcttagtaagtcactgaatgcttttagagcatttttaaaaagaagagattttgaaatcaccaagagaaagaaataaccatctttcttcttctcctttttaattttaaattatgaacggcttggtatcaggtcagaaattatcattggtgcttttattactgccttaaagcatgttctgaaaataagtaggttttctattttgaatgcagaatcagtagtatggagataccctttccagagtgcacgaactctaatctcagagcaagacttttccgagcacgaatgaaagcagaggggtttatgatggggagcacttcagttgtgagctgtaatgctctttgagtctggagtggtgttaatgttccgagtaagaatcattagtgccccatcatcagcacagacagggaaaacagtgaggctaatgtggggaggacgccaccaacccttcattcttacaatgccccgattgctcccagtgtatctgaagcacaggctggggaagggatttccggttggtctgttgccatccaacttacagtatatttttaacctacacatggctatcctgagaatgctttctagttagatattcagtcctgagtcgtaactattaattttggcatataatatcttccttagttagattcaaagcttaattattatattccatttcagcaagtaaattaaaataggatcaagcaattatgtttggtagccctaagtgactttcaaatgattaaaaaacatacacaaaataagcattattgtggtgattttgtaggcagtgaaactagctaggttgtgggattacaagagataaaaagcagaacaccaatcagcaatttgaaatgaactctcaccatttgaaactgagcttaaaggccactttctggggaaaggcttccgcggtctcccaggctgacaggatggcttttctcttgttcccctctctgccacttttcccgtgcactgccctgggtctcagcgtggtctgcttgcttccctatagggagctccttgaggactgcccacacctttcttgatttgtcttcactgtaatgactagcacatggtcttacattgagccctatgaagtagccatttttcaagtcaagaatggctaagtaccagcagtttcataggattcgatctaatggttgctgaactccatgactgttaaaggaacaggccagtgaattaatgtatcgtaacaagcacgtagccagcgttataaggaaccacaggctgggcgtggtggttctcgcctgtaatcccagcacgtagggaggctgaggtgggcggattgcctgagctcaggagttcgagaccagcctgggcaacacagtgaaaccccatctatactaaaatacaaataattagccgggcatggtggtgggaacctgtagtcccagctactcaggaggctgaggcaggagaattgcttgaacccaggaggtagaggttgcagtgagctgagtcggcaccactacactccagcctgggtgacagagcgagactctgggtgacggagcaagactccatctccaaaaaaaaaaaaaaggaagcacagtgccagcctctcaacacgctgagagctcagcaaactttcagagagctctggtacccagagccagcaaagaggccttgcaaagcttgcaggaggaccacaaatgtgattagagggttaccaagacattcctatggggtggagaaaacttcaaagattttggctgggtgtggtggctcacgcctgtaatcccagcactttggaaggccgaggtgggtggatcacctgaggtcaggagttcaagaccagccggaccaacatggtgaaaccccccatctctagaaaagagaagaaaacagacaaaaaaaaaaaaaaagatcatgagagttttcagtctcaaggaggcaaggcttaggtcttcgtttctgcaaagcaaactggctcaaattgcaagcattaagaagaaaagccttcttgacagggtagaaggattcctaagggcagctgggaagtttccccctctagacatctttaaaaatagtttgggttctcatctgtcattaatgaggctaaatgaccttgcaaggacttttctggtcataggaggtctggcacaaaggctgagggaatacagaacctaagaccaggtgacaagaacagacagtgggcaagcagccattgaaaccacacctcctgcatatgacatggccattgtactgcctgtgtaactcacatgctctggagcacaagtctggcacagcacaaagcggtgccctccgtttctatatgctgctgatgctgcacgtctgagaccatactttgagaactactgctctaaaaatgcggtcgatcagtttgattgaaagttactgtcagaactgttctctgctgctgtgcatgtaaactcgctgtactgcatcctacattaattcagaaagaatctagtttatcaaaacacactgttctccacttgacaagtgatttccaaaaatccttagttagcatttagctacagctcttggtcttgagagcaattaacaagaattatttaattcttcatggtttctcagggactgtgaatggataaaacattcttcacataaaacaaagagttcagttcataatgacagattcaagagttgtacccagaatagatgttggccgggtgtagtggctcatgcctataatctcagcactctgagaggccgagacgggcagatcactgaagatcaggagttcaagattagcctggccaacatggtgaaaccccgtctctactaaaaatttaaaaattagctggacgtggtgacgggcgcctgtaatcccagctactcgggaggctgaggcaggagaattgcttgaacctggaaggcagtgattgtagtgagccaagattgcaccaccacactccagcctgggcgacagagagactcaaaacaaaaacaaaaacaaaaaacctgaaaaaacaacgatagagttaataagatcaggggtcttgctgaagatgaagatgtatagtttttttttttttattaaagttcccctattctccctcaaattaagcacatgctcttgagagatgtgacaggcaaacatgaacatgggcttgtgtactgcccctgggagtgtaatctggaagaagttttctagaaggcaatttgggaatagttatccaaagtttcacagtgtgtataccctttgatccagccattctatatctagtggctcattctaaggaaataatcaaaccaactgcaaaagatttaggtaaagggtgttacccatagtactggctatcatttgaaaagaattggaaatgacagaatgaccaacaaggagaactggttaaataaatttggttcaactatggattggaatattgtaaccaaccaccacaaatgatattggggatgaatatgtataggaataaaaatatttcaaaatatattattgtgtttaaaatacacggtaaaacagtggatatgcaatatttccacttcttactagaaaaatagtacctacaaatgcataaataattggtctggaggattacacaagcataagatgttaacagggaggaatttaccacttctaggtggtaaaatcacagttgtttttatttctccttcctgtttttctattttagaagtgaacagtaatgaacgtgtattgcttttgtaataaaattttaaaaatgtatgattttaattaaaaatgccaattgcaaatgtgtgaaaaaacacactgtttgaatctatcacttataagtgcaacttctgtgttttttgggggtgtgtgtagccatcttgagcttatgaagggacccactgaggagctccttcctctgagaagaaaggggtagttgtcagcaaatgagagtacagggtatgtttggattcctggcttagttccattccttccttgcggcgtggttaggtactcaacctccctgtgtcttagttacttcatctgtaaacgggtatgttaatatagcatctacattttagagttgtgaggattgtacaggataattcagtgcctagcatgtagtgaacatcaacagattttagctattactgcttaaaaacagtattttttttggtagagatgggggtcttattgtgttgaacaagctggtctcaaactcctggccccaagagatcctcttgcctcagtctcctaaagtgctgggattacaggtgtgagccaccttgctcggccagctgttattgttattctgaggatagatgctttcacttagaaagtccctctccaaagcaaagcactggcaaaagagagcagaaacaaaattgaaatctgtgtgcataactgaacactctccaggctacttgctatgatggcagggaaatggtggttgcaacaatgaactttcagtggatcaatatacctgggccaatgagaagagactcaatcaatcaacatgtttagaaagagcttgagacaagtgggaattaaagacagaagcagcccaggaaatctttcagtgatgtgaagtagtaagggtgttatatgggagaaaagctagcaacaagggctataaaaaataacaaagagaactggggtttgaagacaatatggaataagatggttggtgctctttagccttctagagtaggcccgtaagaaaacattcacaatgagaggctgggcgtggtggctcacgcctgtaatcccagcactttgggaggccgaggtgggcagatcacaaggtcaggagttcgagaccagcctggtcaatatggtgaaaccctgtctctactaaaaatacaaaaattagccggacgtggtggcggatgcctgtagtcccagctactcaggaggctgaggcaggagaattgcttgaacccaggaggcagaggttgcagtgagccaagattgggccactgcactccagcctgggagacagtcaaaaaaaaaaaaaaagaaaacattcacaatgggaaaggcacatgtgagcaaggatcagcaataaggagttacctatgtggctgtttctttgtgggcattgcgattcaatagacacacaacacacatttatgggcttagaagctgtattcactatgactcacgcagtatttgggagagagtgaaagaaaataattgatgcttccatgaaattgggcaacagagaatttttttttaaagatgggatctggctatgttgccccggctagaatgcagtggctgttcacaggtgtgatcacagtacactacagtctcaaattcctgggttgaagtgatcctcctgactcagcttcccaagtagctgggagtacaagtgcatgttactgtgcccagctcaacagagacttttaaaaaaatagttgtttaaaagttttttttcccagtctgattcctaagaagtaattcttgaagttatatctgaaaatgacaacttgtcacagaaggaatttgtatgaggacagaggaacaaaacatgattttagtttgagtctcttctaagaggaaagaggcttttacatttagtatttccatctaattttaagatctaactttttcaaagttttccaacccattccctctattgtttcctaaaacacataaaaaagagaaaagtcttaatacttcaactagggcatggattattatttggaaatttgtatatttgaaaattcacgctttagaagtgcttctggattgaaagtttaaaaatcatacaaattaagaggaacagattcaatgagaactatggggaaactatccaaatcctttgggaaataaaagttccaagacctaaatacactagatttgcttatttctgacttaaaaataatcttaaaatatttcctttcttatatcaggaaggcagatttctacctcatcttagttgaaaacagatatttcttttttggggaggattattttttaaaaatatcaattgacacataataactgtacatattcatggggcacaatgtgatgtttcaatatatgtatacattgtgtaatgacaaataggggtaattatcatacctggaaccttaaacagttatgatttctttgttttcagaaattcaaaatcctcttctagctattttcaagtatacagtacagcattgttagctacagtcaccctactgtgcaattgggcaccagaacttatttttcctacctaattgtaagtttgttaccattgagcaacgtctccctattcccctcctcctcatctaccctttcctggctttgataaccactgttctattctctacttgtatgagatcaactttttagattccatgtatgagtgaaatcatgtggtatttgtctttctgtgtctggcctatttcacttaacataatgtcttccaggctcatctatgttgtcacaaataacagaatttcattctttttctttccctgaatagtattttattgtgtacatataccacattttctttacgcattcatctgttgatggacacaattttaaataaacacttagcttggatccacatcttggccattgtgaatagtgctagagtaaacatggaggtgcagatatcaacatactgatttcatttcctttggatatatacccaatagtgggattgctggataatatagtaattctctttctaattttttgagaagccgccatactgtttccatcattgctctactaatttatattcccaccaacaatgtacaagggttctcttttctccacattctcaccaacatttgttatcttttgtctttttgataatagccattctaaatggagtaagatgtggtttttgctttgcatttccctagtgattcactttgggtttgctttgcatttccctactgattaatgatattgagcattttttcatatactttttggccatttgtaagtcttcttttgataaatgtctattctggtcatttgcccattttaaagttgattatttgtcaactcaaaatggattaaagacttaaatataagacctgaaaccactagaagaaaacgctggagaaacacgtcatgacattggactgggaaagaattttttggatatgactccaaaagcacaggcaacaaaagcaaaaatagacacatgggattacatcaaactaaaagccttctgcacagcaaaggaaacaacagcaaaggagacatcttagagaatgggagaaaatatttgcaagctatacatctgacaaggattaatatccagaatttataagggacccaaacattgcaatagcaaaacaacaaataatcctatttttattactttttaagagaaatttccttgagaacaaacacctgtgaatgatactaaccatcaactatgggattagagaacgtaagactgcagagagtattaaattgaatataatggcttacctcttacagtaacagatgcttcctaattgtatatttaattagggaagtgatgcattactgtatattagtgaaaattaagccccagggcaaaattcagggttcgggatggggtatgggtaagcctagggaggcaaaattgaagagcagaacctcatctggccagagcaaatccttcacttcaccaaaaactgtatgtcttggaatctttgaagtgggagttattcataccaacataacaacaacaacaaacccactgaaaagtcaaagcaatatacttatggctttgtaaaatccagtcctgtggacacattatttaaaagtggtaattcttggccaggcgcggtggctcacgcctgtaatcccagcactttgggaggccaaggcgggtggattacttgaggccaggagttcgagaccagcctggccaacatggtgaaaccccgtctctactaaaaatacaaaagttagccaggcatggtggcaggcgcctgtaaccccagctactggggaggctgaggcaggagaatcacttgaacccaggaggtggaggttgcagtgagccaagattgcaccattgcactccagcctgggtgacaagagcgaaactctgtctcaaaaaaaaaaaaaaaaaaaaaaaaaaaaaaagacttcctctcaagcttggcaagcttggcgtttggtcgatggggacccatgggggttcaacatgtgtatcaagaagtgttatttctgtctggggcccatccaccctggccatggcaagatgttcatccgcaatgattgcaaggtgttcagattttgtaaatctaaatgtcattaaaaactttaaaaagaagtgcgatcctcacaaagttaggtggaccaaagcattctggaaagcagctggtaaagagcttacagtggataattcatttgaatttgaaaaccgtagaaatgaacctatcaaataccagtgagagctatggaataaaactactgatgcaatgaagagaattgaagagatcaaacagaaacacgaagcttaatgaacagattgaagaaaaataaagagctacagaaagttcaggatatcaaagaagtcaagcaaaacatccatcttatccgagcccctcttgcaggcaaagggaagcagttggaagagaaaatggcacagcagctacaagaggatgtggacatggaagatgcttcttaaaaatctctgtaaccatttcttttatgaacatttgaaaatgccctttggagacttgaaactgctaaattattagcttattttttacataaggccacttaaatgaaaaatgattaaaatatatttttcctaccttgccatctaatggcactaggcagcatttgtataataactaatggcaaaaattcatggctagtgatgtataaaataaaatattctttgcagtaaaatattccctttattaatgttatagaagggaggatacaacaaggaactaacaatttgtatgacagtgtcaaatattatttagattttagaatttcctgttttgcttcatttgcatcttagaagagcataatgacattgtttgatgaagcctaattatgctggactgttttgagctggtttaacccttctgataggtagttgtggatgtcgaggatgagaactgaataatctttgcctgaaatcacactacactctagaatttccactctggagaatactcagttctaacttgtgattcctggtagaacaaactttatttttctagcctagcaatgatctagaagcagaggaatcccagtgccttttaaaagttattatgtggttttcttttaaaaagctcctgtttttggaaagtagaatttctgggtacaacatctgtttattatttgcacataaaataagccatttaaaaagtgaaaaaaacaaaacaaaacaaaacaaaaaacaaaacccagggcaatgaatgttcctggcacattggagaggcagtccagtctctggattcacagtgtgggtagtggagtggactgcctggtttcaaatcctggctctgccacctgctgtctgtgtgaccttgggcaagtgacttaacttctcttggactttgttttcccatatgtaaagtgggagcaatggcaatacctactgtgtggactgagtgaactaatgcacataattcagttgtgcagggcagggtgtacagctctcaactgctacctgttattagccctaataaactgattttaggagggcatgagtatatgtcatttttaagatcgtctattatgatcccttaggctgatggcaacttgaaagtgcctctatggtaatacttctaccactttggggtaattaaatgttcacatgttggtttcctccactggattgtgaactcggtggattttagtcatctttgttaacaaagtacatttaaggaaacattgatcagaattgggaaccacagtgatttacttattactgggagagacattttcattttggctaaaatgcatactttgaacagaaaacatctttttttcaattaaaagaataaacaggtaactcttaatctacaatactttggcctaataatattaccatgaatcaactttttagaccgtctgtgtcctaaagtatttttcatggggagttttgattgaactgggacttttggctgaaatgccaccatgctgagaacagagaaaacagcaacttggggttcaaactgaaaattagctgcaagttgagatctacatcatttatagttggtgaaagttctaattcacaatagaatagttccagatagcagatcaaccctatgcttctggttttgaaagactctggtgaaatgtagtgaatgcaaccttagctactttatcaagaactgagacttacttaatcaagattggaaataagggtttatgatagtccgagaagtaatgaagtttctattttcatgtaaactacataagcaccaagagcagcaaaccagaaaaatgccccccaaaacagaagaatggcttctaaatatatgtttttttctaagtttcattttaagcaacagacaaggatttaactaaattattctctacttaggctactaaaatggcttttctattgctatcaggatgtaatttcagatccactcaatttcatgaaattgactgagattcaaatcatacatctggtatattttaaatgatgctgcatgcactaggcaatactgatgctgattatcacaccggagtagctggtctcaggtaatttagttaagagtattaaatcagagatgcccaattaatttattagacatgttcatgaatatttctaaaattattatgaggcttgatgaatgaaaactttccctttttcttattgttcattggtgacacaaattaggccagataaatatttagaatacaagatttccagaattataaaaccagggagaactctaaagtgtatctagtctaatgttctcattttatatgtaagaaaacagaggatcggggaaacaggagaatgtagtggttaaaagcctgggctctggagtcagacagacccgaattccagtctcagattggcaagttattccctgtgtgaccttgagcaagttattcaacctctgtaagcctccatttcttcgtctgtaaaatggggacaataattgtactaggggacactgtaaagactcagtaaatgttagcagctatcatattatttttatgaataacaggtgactcctaaggcaaataaccagccacggaactaaaacttagagtttctgatatatacagaagcttgtttttttatctaaactcagtacctaagttaaatattcactggtactgacaatttaagtactgtctaactctgcattaaatagaaggataactatttcagtcttttttgctgttgaattgatcaaaatattagtgattacatattgaagtctcaatttcatgaagattcacacatatttagctttccataaacaatggatatttcatgtttaccttcatagctgtttcagtgtaattatatgctcttaaattattttccaccaaaagctgctcatataaaataaacaacaaggtatattggccataaataaaagttaggattgcacttactaatgaccttaaatttgactttagttagatgctatattgaacaagtctgatattctcaatttgtgcagttactcagataccagcatagcctctatacacctgttatggaggaagcaagaacaagggacacgtacaaaaggaaaaggtgggtctgcaatacgagttagagttgctttggctaaaatagactcctaggaatcaagcagccactaatcacagatatttggaattgccattttttttttttttttgagacagagttccacttgtgtcacccaggctggagtacaatggtgagatctcagctcactgcaagctctgccttcaggttcaagcgattctcctgcctcagcctcccaagtagctgggattacaggtgcatgccaccatgcctggctaatttttgtatttttagtaagaggggttttgccatgttggccaggctggtcttgaactccttgacctcaggtgatccacccaccttgacctcccaaagtgctgggattacagacgtgagccactgtgcccggcctggaattgccatttttagttaacatttgcccttaaatagttcattccactcaaagttgaatttaaaaaaataaaaaaaaaaaactgagtaagaaattgcataaagaatattagctttatataatatgctcttaatacttctgcttttgataattttagtcaattggtgatgttttcagtaaatattctcagactattcagtgcgtgcttaaaaccttttgttgtaataaagatcatttttctaatctcgaaaatgatacaattaattttaaatctttaaaaataattaagaacaaatatagtacaaatatagcaaatagacattaactcaaactatagtgagataagttcaagcataaacatgcagaaagcaagagcacctttttatgtaataccaatgtgattcagcagaccaacagatggagaaaatagtaatttgaaaggtggcaatttgtatccatacccagtatttagtatttcagctactagaaataaagtagtttggcagacttacccgcatttttgcacaagcatcttgggttgattctgtccccctaagctcttttatcagcatagaacctaaatactaaaatacaaaaaaaattcaatgatttatgaaatggaatatacatatgagtaatgttttaaaaacaaattgtggaagtattactggctaggtttcctggctgtaagttgttgcataactttaaaaaactgacagtaactaatcctaacaaataaatgcattcatagagaaaatgcagcagaattaaccataagttctgggggctgtaattgctctttataatgaaactgcaacatcttctaaagatgccatctttcaaatcatatttaactgcaaaatgggggcatctaaaaatgttttccccttttttgaggcagcaatgtctgcaaaaataaatcacactactatctctgtaattacagggttgcatgagacagctgagaagctaagcaacatgtcccccatttaggcttattctgctgcataggtaattaatgttaggcttttaggcagagatgcagttttggacctttttcattcacagctgtgtgccctatggttgatccacctgagaacgggatgggagggtggggggagggagagaggcattctcagttgtttcccaggggaagagagctgggttcctggtgcgaagtgccacctggagggctgaatggagctagaaggatgacagtctcccaagaattgccaactactttgttgttagaagaccagaccccatactgtatcatcctggtacaaaatgcccctcgtgctccagcttctggctggggccaaatggttttaaacaaaatgtctgatttgcctttctatcaattgactccccttcaaccttttgaagctttagtagggtttttgccttttgtcattcccctgccccttgccctccccccaccagcccccaaagagctctatatatgttttttaaaaaagtgaattacaataattattttagaagatatctgatggacacttcctgacaagactggagacttgtactctgcagagacggggatgggaaccactcttgtggactagggaagtgcctgacttgaagaagacgtgagagggcacaacagcagaaggcgtggtcagggccttggagaaaggcatgttcagaaaggcttggggacttggggtttggagggaggagccatttcaatcctatggttttgggcagtaccactgaaataaatccaaagctgcaatataagtaagctttagtaaaagaggggcagaaagcagaaaatgaaaaaaaaaaaaaaaaaaagctcaactggtatgagataaccacaatgtccatctaaatcaaatgaaggtgaaatttattatcttttggtaaaatccttatcttttaagttatcagggaagtttgcctgattgaaatgtttctttttaagagaggcagtttcaatgcactgctgaaggttcagccactttttctgctgtcgtcaagacaaccaccacctgacccaaaacctacagtatcttttgaacatttaccagttcctattacatttctcagctaattataattaattcccctcttctaaaaaactaaacaactaacctaaactaaaccaaactaaactaaacaactaaaacagaaaaatagtataatcctattgatgacagtgaaaagaatctggtatttacataaagtggcagacccagtgttttgagacccagtgtttggtgagtgagcagagatatatatatatatatgccatatttacactcatttccattttaagattgtacgttataacatttatttaaaaatatacaactatataagaggtcacaacagaccttaaacttacaagattaaaacggttttaaagctctagttatttggactttctctttggatagaaggctactttaagaaaaagtgaagagaaaaacattttaaaaatttcagtgatggatatggatattttggtatattttcaatgtaaatgcaaacaagctgaaaacataccccctatctccacttaggcccaaatactgaattgagggtaacttacaaaagctttgtaatcacacgactggaagataagcttttctgggtgatgctgccagtactgtaccggggtagaggctgtggcttcattcggaggtcgcaaggtaatggaaggttctccccagtctcctgtctgaaaatgacatttattctagaggcaatatgagcagtcagcaaagttcattccctgtagctaccctgagctcaccttacacacaggtgctgtgaatgtaccaaaatgcatttgggtgtcttatgtgaatataaatacttggttattacatttttatatgtattagcatatctctcaaggctgagttaatttttgaggtgtggagttgaattattctatttttagaatgacatcctaagctaagtcactttaaaataaaacatgaagatattcataaatgatttactaatcacaattttccatcacaacagcaaaggacacacaatctttaaaagaattttgtttttaaacttgactgaaatttttagtttgaattgctttcacattcagaacacacagttctataaatttcagttcccaaatatgacatgtactagccactttgaataattttagatctctggagaaatggtagtgtaagcatgatgctaaacaaaatttaaaagaaaaatttactaatgggtgacactaatttctctcatctgaattcaattgcactgatttaatgatgctgtctcagatggattcagctacttttctcagaaaacctaacgtaccaatgaagactaaacagtgaaatgccaagtttggtcacatgtacataggcatgtactttgaggattctgattcacaaatacaagcacattcccaaatgatggtatatcatatgatacagacctaaaacaggaggacctcccatcatttcatttatcattttccatgaggttagcctcaacctgtttcatcagtataatagcttaatgtgagcatctataaagtcaaaggccagtgttggcaggtattttctgggctctactctgatttacatactacgcatgagatatttcttactctttctcctgggaaagatttggatttttccaaaactcagttctttgttctcaagtggacataactaaaactaaataggcagatttctagagtgactctcctctaacctagatttggctatatatagaactatgagaaattacttttctcaggagttggaagagtgtaaaaaggtctcataaactccaaaatcaaataaaaccttggttagagaacaagttccacagaagtgctagaaagtgtgttgacacactgtgggatttcttaaggagaatttttaaggagtctaggacaagaatgcaaaattttggatgcagttgtatgttttgggagagaaaggaagttctctgctttattaaattctttgaaagaatctagaaactccaaaagattaagaaccacagttctctaggaatggcgtacatagggtgcatattttggggaggagaactagctctccaattttctttgcgcactttggacttacattaggtgacatatgaagtagctgccaatgataaaaagccctttctagaggacttcagtaatgcacaggctttttttttttttttttttttttttttttttttttttagcagtggagtgcctgaagcttttctccttgagatgggtcacttcgactcgcagaagagcaaagttagcatcacgctatttccttggcttctcactgtagttagtgtgtgactagttggaactccttcggcttttctctcctgctctgttctcagccactctccacattagttttgttttcgttgctgatttacttttacattgcttaatcctcctattccctgtctgttggtattttttatttttgtacacatttatggggtatatgtgaaattttgttacatgtatattgtctgttggtattgttaagactttacttgcaatattaactttagcatttttgtctgttttattatccatccctgactcattcttgagtttttcttttatatttatatgaatttttagtttgtaaaagtgataactgactgcaattctaaaattagattaagtttttctttggcttcttattttgattttttttcttttccttctttctcaaatggctggctctttattctctctctggtctttatttcatctggctgtaacttacttttgaaaaactagtataaaattcaaaatataggatacgtggatttcaatatcattttgaagctgagtgtaataacctttaagtgataatagcttaaaattctggaaacatgcagctatgggttcttaaacaaaagctttacccaaatctatcaaatcatcctctaatctcccccattaaacttctccctccttctcccgctccctggataaagcaacaacaacacggcaaacaggtattgtacatttaagtcacaggtaacactgttaacaaaacaacagaagtttgcatgcaactccgtggaatgatacaaaaggaggatctggatggcttccaaagatcctttgatccagtgtctgctgatgtgacaactcaaaccaagcatcagatcttcatgtgaaccctattacagttcagcagaggtagaccttggccaagctcaacaggtagttttcaaaaaagtctgaacacggcatgagctggtggtgccatgagttgcagggccagggctgggaacagggctgggggtgggaatgagttgggggaagctagggttatgaaaacatttcacgtgttagtacattaagcatgcaaatcatatgcaaattcattctctaattgttccattaactcacacacttttataattaaactttaatgtgagttccatacatttaaagccagagccacagccaaatgctgatccaaatatttacgtcatccacataagttgtagcagccattgtgggaataacaagccccagcacatacattccaatctcggtctggaaatcactgaaatcccttatttgataaccactggaagaaattagtggaacatccacttaaatctgtttagacagcgccatcatctgctctcccatgactccactttgtccaaaatcacaaaccacttgctttgaattcagagtgatctgataggattttccctaggtgctaaggtgggagataattacaaggaaaagaaatataatacttatttcattttctttgtggccttcaaatattgcttcagtccaaatattgtcaaattccctacagggactgaatctacctttctggaaagagacactgaattttatcagatttagtgctatttccagaaattcatttttaaacagagggaaaggtgttcttaagattgaatttattagaaaataaatttcttttctgcctggaaattcatcaacttctctccccacccctgcctattttttttttttttaaacttagatctaaaagtatttagaagactcaatttgtagatgttaattcttctttttggaattaatttaatgggaatggatggactccaacaactggacttaacattacactgtcgtaaaggacaggtatgaccttggcccttggctgggattcagctgtacctggttgactcccagtaagaacaaaagagttcagagaacaagggtgccttaggtctcaaccctcctggaggctgaattacagcaggaatgagctatggaggaattacgtagagtagttactatatggaatggaagaagaggtcaaaaaagaaagatttttgcctcatacataaaatcattttgaactttgaagcctagtgttaggtcttgttgactagtacattcatgtctacataatacttgcatctcctcaggcaaatatttttaaatttagtaattttccacttaaaaatccttattaaatattaaataacagacctaagaagtcttttgccacaataatggtttataatcaaagcttatttttaatgaaaagcagacctaaacacagctaacaacgcaatatttcattagaatagcaaaatgaagtaggaaaagtttagggtagaattctgtcatattttaaattattattgacacagtggtctttgaaaggattccttaagtaatcacaaatgagaaatcaaaatgattcaaggtactcctaataaatgtcttcaggctatctctttggcacttaaaatatttacagaaaatctttcctttaggttcatgtatttgaaagatcttcatattccaagaattttgtcatggcttaaaacttcatttatttggtatttattattattttttatatgtatgcttaaggcctttttttttattaagcacactaaagaacatcaattaaacagaggaaaatgtacatcattagctctcttcttcaaactcaaataaaaactaaacttctaacataaaggaaaaatactttgacattagaattttaaatggagaattgattctgtgtaacacatgtttgcaactgccaactataaatctgtagtctgggtgagtctgaaggactataattgggccacatctaatataatgtaattaaattaaacattctcttataccaacaactgaaaaatacaaaagcatcaatgggatttagttaaaaaacaaaaagcttcacaaaatacagagatttttactggatggcagattccaaattgcagcttttaaactttgcattatttcaacaggtggtaaatagctgcaaatttttagttcacatgcactggacacctacagcaaattctaaaacaaattgtatcaggtagctgtctccctccaaaagggaaactgaatattacatattctatatgctctgagaatagaaaggaaaaacccttctctatgttattttccgtctttattattatttatttttccaagatggagtctccctctgtcacccaggctggagtgcgatggcacaatctcggttcattgcaacctccgcttcctagggtccagtgatcctcctgcctcagtctcccaagtggctgggactacaggcatgtgccaccacatctggctaacttttgtatatttagtagaaacagggtttcaccatgttggccaggctggtctcgaactcctggcctcaagtgatccacccgccttggcctcccaaagtgctgggaattacaggcatgagacactctaccaggcctttatgttattttcttcttaaggaaaaagtttcctaaggatgtcagtagataattaaaagccatgcttacaacttacttttctaacattaatagaaaagtatggcattttccaagccttgtattattctttaaaatttttaaaaattaggatttaattgatttttaaaaatagaacctttaaaatcttttctatgaggactgctcccacctacttgcttataaatttagatctgaatattaacaaacattagtctcaatttcttcagaacacttaatgaaaaactaaaatgattttaaaggacaattattgttttaaggttttactttcaataattatgacaaatttcagagatgggctacccaaacatacataagatatatgtgattacatttactttctgtaatctctaaggctttgaagaatgctatacacagctctatgcttataaatatgcatacgtatatttgaaagtgaatgtaaggaaaaggcttcccataaacattcacacataatgaaagcaggatgttgtagttgttctttcaaaaaatcttcaagaatgaagaattctagtttgatcaaatgcagttggttatactgaatttgttcctttagatgaaaaagagcagagatggctacttacgaacacataaaagctctggttaacatttatgagtccaagaggaactgctgggtcacgtgaacaccagtaccaggcaatgtatagacaccatggtcctcaagagccagaagtcccatgcacaggagtacatatgtgcctgatgcagcatcccaaaaggcacttcacaaaaatacccgtggcatcccttcacatgccgccccaagaatctgctcagtgattctcaaccaagtgtctcaacctctcagacagcaggctatccaatgggagaaattcaaaagggtgtgaaaatagaatagtattttaaaatatggaacataaaaccccaaacatttaaatgtttattttccaaatagaaataaactttttctaaagtatgcaaaggtgaaatatgaacatttgaaaatcatgcagctcagagtaaaatgggtcacaatttcatacaatttgcaaagatcaattcagtactgtcaaatggaaaaaggctgagaaccactttgtagctgtaaccgtgcctctcccagctcacctccccccacatttgcataaaatgtatacagaataacatgcaaatcatactcagaaatttctcacaagtgaagcacatgaatctttgagaatcattagacacaaagggttgaagagtccatgaatatggggaggtacaaaatggggaggaataatgctgatatatacatgtgtgtatatatatatatatcaatttacccttttctttttcctgtaaaagcaagtttaacacagacgcctggaatgaaagccaaaactcacatgggacatattttaaccatacactttaaaaccaagtatgtttcttgttttaggacaatgtttgcacatcaactaatcacaaggcacagtaaatgaagtataatagacaaagagtctcggagtcaccagacattacaaattttctgcattgccaggacacagtacctatagctgttgacaacactgtgcaacacagtacatagcgcaagttcaggagaagaaaagaaccatttgtaaccttacattatgaacctgatggatcgctgagaaaggaaatcctgcgttctgattcgtccatatttcacagacagacgactgctgatataaacagaaaactatcttatcttgtcaatatttaaaacatggcagctaccaaggtagcatccaggaaggaaaagaggaaaataataaaatgcaaagaatcacatttaaaaaaaactcaaaaaatgttttagggtgctcaaggtttaataattgacttccaagtcattctttttgctttaaaacattttgagttgactaaaaaaatcatttatgcatttatgcaaggaaaattaccaataaattcatgccttggaaaaaagcaaactgtattttatatttgccggaaaaccagaaataccttcccccttcacgtcactactttcagaggataaatattttcatcaacttcaggaaaaacaggaaaaaacctttaacacaggtccgatatttttattttcttatcttcaatgaccaagagcaaacagtgcaataaaatgacttttcctgatttagtcattgctctatttgacaaacctagaagatatttatgcctccagagttcttacgggcaaaactcggtagttaacaaaggaagacgtgtcagcttgctacccagcactgggaggagtgaaggaggtggcaggaaggaggctggggcagggaagaactgaagtcagggaaattcagttctgttcctcaagcagaaacccttgggaacagcatttgggagtctaatgattcagctccataattctggctctcccccacaccattaataagataaacttatcagtaatgtttgctcagaaccaaacactaaactaaccagcatcccttcccaggagttacagtagaaaccttcaaagagaccgactgagctcttggcttgacccatcccaagttctgttcccgaatttcatcattctaaaagacactgtgaaattaaatcacagaaaatggcagagcatgtaaacttattcagcaagctctgtgagcatctttagcattcacaagcagtccgtacaaagatcactgcaggaagaaggcaagcacataaccataatatggttaagaggcccggcaaagaactgtatcatcagcaaacaaatgatagaaaagaaggcttatccctagctaaaagtttcctcaccccagaaacgctcaccagcaatttaacacctctctctctagttacaactgcatctccacacacccctacacctttgctttccatgtcttctgttaaccagaggcttgctggggatggttaaggaagttagatccccagggtctgaccaaaggcacttccaaacacctttcacttaaaccagctctgctatcctcagttccctctctaaacttcatgctattttatacatccatagagggttcttcctcttcttacctttctagcaagttcagtcttagacccattcactctgttggccttgtctccaatagctctcctctgatttgaatgtactaactccatgcgttagctggattaccatcttaagtggcatcctcacccagtcctgagctaattctttacacaaatcacatcttctgcaactttcacacacttctagtgttaatctagtgctagaagtgcttctagcacttctagtgctaaataatccagagaccacctgtcatctgatagatgaagacacagacatttaaagaggtgaagtggcttgctcaggtcacacaggtgagtggcacaatgtgtcagcctgctgggatggctaagaaggagtgtgagcctggtactgatgtcaccagaaggcagagggccactccagctatatacagcttggttctactgaccctgaaatgaacagaaactaaaaataaaatcgtaagccccctcaccgactgaacggacccccttgtggccaaggggaccccagaaaaaccttaaaattgagtttctgaccatgatgggatgggaggtgagacaagcctcattatacctcctctttttcatggtttagacacaacaactgatcggaattaatgttaaaatagacatcataagagtgacagaacagtctctttgtggctataagataccaaattatcaacaggacccgaggccatgctaggcaaaggttaagtcacgcacccctatacctaaagaataaactatgttccaactgccacaaggtttttctttttctctagcagctaaacaggtactggccttaagagaagcaatatttaaacaatttgcacctccaccagatgctgattgacccttagcccctgctccaccagccataactacagctggacaagagattgattcagtaactttatccaaataagattactaaccatggactagttctggttggtctacagagattgcacacttgtgtgccttcatgtcctgaaaagcccttctgacgaacagggctaactgtaatatatctacatgttaagtctccaacccaaagtgaacataggccacatgttacatgcatgttggttcaatacacatgtgtcaggaccaccttcatgaatattcacagctcttgtaacacattgaatatatgtgtttagctaatctgttcagcataaatcttctacctaagcccttttccttcgaagtacccgtctctggggtcttggttggaggtgcttcccagcctgcgggatggccatcttgcaggctgtaaccctttagaagaaataaagtctcctctactttactaaattcatatatatatatttaagttaacacaagtatatctaaatgcaatcagttcatgagacagtcttaactgcactggggtccaaacaccaaaaagttgttttaggttgttttggttactcccaaaggggccatgcccagtctgcctgcctgatgggcacaaggccatttaaccttttgggcagactgcatcacttcctggtcactttgagtcatgaagactccattttgtatgaaatccaaactcatatctgattcaaacttttccttccctccttgtgtgtcagtcttggggcttaaaaagcccggggtggataagagaagctcggtctgcgctttgacttctcctaggagaggtgagggcaggtgtcatggtctaccttggatgttccctgccccaagctctacctacttcatgtgtttagttggggaggaagaaacaggaaaaggacgaggtccctttcttgtctggctgttcctctggcagccgcactgcttttcagctaacgttaacatggtctcccatgtgctctacgtagcagctgctccaacctaggttctcctgtgtccccgtgtgatttctttggagagctcttctaggatagagggcaggtcctcccactgcacagtttctgctggcagaaatctgcctctagcttgacttcttccaactcccactcagccctcctaggacacatgcatgccccctgaaggggacccagggggacaaacataaccccagactccttctgcacatccatgtggcccacatgatatggacacacatccttgtcacacagaacagtagaagggcgggctgctctgtgaacactccccctctctgccagggcatccctccccaagactctctgtgtcagctcggtaggtgctatgtgacctgcctggcagaagtccaattatggataccaaggccagttttccctcctgcaggcacccccaagccagatgtacattcctcctggaccccttctcaccaggattggagagcacgggaatgcattctgtctcctctctcatggcaaaggaggaaaagccttagttctttccacaggactcagacaattccctgtccttctccagcactaaccaatgttctgcctatgtggagaggtagctgacaggggcagggcaggattcacactgcctccttgtaaaccccgaactaggtgtctggctccatgattgatagctttctctttagggtgtgcagtgcttagtacctacaggaaaattcccacttagcatcctgggaatagatcttccaatagtgaatagatctttcactactcacagaaatttaccagagttaagaagggaaaagaggatcctacgccatacttatttcattaaaaaaaatcatataaaatttttctcaatgaagaataaagaacctacccctagtcatatacactgagagttcatacatggcttatgtacattttttagatgttataacaaatattttctatttataagctatgttgtaaatttagagaaagtaaaacctctataatttctaataccgtcatgcacaacataacgatgtttcagtcaacgacagactgcatatgctacaggggtctcacaagactacaataccatatatttactgtaccttttgtgggggttggaagaagtaaagctagagccagacttaggtatgtttagatacacaaatactcaccattgtgttacagtcacctacagtattcagtatagtaacatgctgtacaggttgggaggagcaataggctagatcatatacagcccagctgtgtggcaggtgacaccatctcacgttgggtaaatacacactatgacgtttgcatgacgaaatcacctaacgatgcatttctcagaacgtatccccatcattaggttatgcgtaactgtcatcgtgtcagtgcaagtggtaaaaagtcagaatttaaaagagtttaaaagcagttgtgtttgagttgtgaaaattattattttattttttttgacacagaacctttgctctgttgcccaggctagagtgcaggggtgcgatctcggctcgctgcaacctccgcttcctgggttccagtgattcttgtacctcagccactcgagaagctgggactacaggcatgtgccaccatatccagctaatttttatatttttagtagatatggggtttcaccatgttgcccaggctggtggtctcaaacgcctggcctcaagtgatccacccaccttagcctcccaaaatgctgggatgaaaattatttttttaaaaaatcggatgcattccagataccgcagtagttttgttagcagtaaataatttgtcaggctcacagagcaagcgacttaaggcagacctgttgtaactgctgcattcataatatgaaatggctcttctcctagacatagggtcattatactgagtgctggaattaattttttaaatccaagagtttccagagtagaaattaattatgtttatgaaaataacatttcagggtaaaacatgtattgaagtactgagttttgaaaagttttgagaaagaaatataataccagtcataaaatttcatctggggcccaaattcctagaaaagtagtgagttaagtttttttgtttttttttttttcttgagatggagtctcattctgtcacccaggctggagtgcagtggtgcaaccatggctcactgcagactggcccttccaggcttaagtgattctctcacctcagcctcccaaggagctgggactacagggatgcaccacttcacctattttttttttttttttctaaatgtgtagagaggaggtcttgctatgttgcccaggctggtcttgaactcctgggctcaagcgatctgccttcttcggcctccggaagtgctaggattacagttgtgagccactgtgcccagtcttaaatttaagttttgtttttttttttcttttttggtggcattggagacagggtcttgctctgtcacccaggctggagtacagtggcacaatcttggcttactgcaaccactgcctcctgggttcaagtgattctctcccgggttcaagtgcctcaacctcctgtgtagctgggatcacaggtgtgaaccacctcacccagttaatttttgttatttttagtagagatgagtttcaccatgttggccaggctggtctcaaactcctggcctcaagtgatccaaccaccttggcctcccaaagtgctgggattacaggcatgagccaccgcacctggccaaattaaactattttgtttttttagtttttgtttgtttgtttttgagacagagtcttgctctgtcacccaggctggagtgcagtagcgtggtcttggctcactgcaacctctgcctcccgggttcaagtgattctcctgcctcaacctcttgagtagctggcattacagatgcctgccaccacatctggctgatttttgtatttttagtagagacaggtttcaccatgttggacaggctggtcttgaactcctgacctcaggtgatctgcctgcctcggcctcccaaagtgcttggattacaggcatgagccaccgcgcctggccataattaagctttacaatgtcttcatctgtaaagaaggagaatagtacttgacctacttatttcaccaagttgttgtgcagcttcacgagagaggaaactttttcacagctaaatgtttagggcttggaacacagaaggaacacatttttaccgaatgaatggaatcatataacacattcaaaaggccttggtaaatggcaaagcattatgcaaacattagtcactaccgttatccgttatcatttttaactggtctactctattggtgccacttgtgcctttcataagctatgtcactgccaacacacttccggttaattgtaccagaaactgctgacttcctattggaagattcctcatatttcctgataaagacagtaaagggctgccagcttgccgaagagagaaggaacatttgtcattagcatacctaggtgtcaaaaggctgcttgtagagcttagaaacagttccatgaaagaatgttaatcacccctttgcaatttcatttgcctattttctctcaatccctgtcacatatattgcaaagcctcatttagtttttctgaacctgaattactatgaaacccaaacaaataggggtaagtaaaggtagacttacaactgagatattaccaataatttaatgtttacttctttgatggtgaagtcaacacacatttgaaggtgtataattttatcttcagttcagacctctctcttagctctggaaatgttttcttaaaatgcaatgcatgtctcgctcttgttaccgtcttatactttcggttaccatgacttcagctcagaaaatacaacacaactgcattcaaatctaatcacaaaataaaaagaatataaccaatttccaaagttttcctcctaaaggtggacttcctttttgatccagtagtttacaataaattatctccccttcattatggtttgtcctctttcctggagcattctcagaaattgctataacatcttccatcaaaagcaaacaaactccttcccttgccccaacatcaccctcggtttcctgctcaattactctaatcttctttaagcaaaactccctgagaaatgtctagatggtctccactttctcttttcctgtcctcatctgagcccactctactgaaactgaaacaattttctattttccttgacctatgtgacacccttgatcactcctccattccttagcctctttggctgcttcctgttatctgagcatccctggagtgttagtcctcagtcttcccttccttcttggctatactaggtggtctcttccagttgtgactcccaaattcatatttccagcccagacttcttccctaaattcaagacttggacacccagctgcctgcttgatgcttctccttttgcatttattaaatcagctcaaccttaaattaaatgtcagagaccaagctcctgatgacctcacctccctgtgagcttccttgttttggcaaatggcagccattttttttccagttcctcaggttcacaatgctggagctctcctttctcctgtatctcgcattcaatccagcagcaaagcctattgaatctacttctaaaatttcaccttcctgtcactacttgctccaagctactcccttttctcgtttgatttattccattggcttcttacgggtctcactgctgttatccttgcctccttagtatctcttctcagtactacagccaaaatgacccatctaaaatgaaagccaggtcattccactcagctccattcaacacagaagataattcagtcctaacaatgacctgcaaggttctccgttctctggtacccacactgctctacctccctaccctcctctcctacccatcttcgtcttgctgtctgggttcttgacagcaaagcacattcttgcctcatagcctctgcatttgcttctctttctgcctgacatgttctccctctggctactataggcctagctagctccctcacttccttcaagttctattctaatgtcactttttcagagaagccttccctaggcatattacatccaaattaagtctgtgctttccactctataaaagaattattctttcaagcagaaattatttatttatttatttgtttgtttttgagacagggtctcactgtcacccaggagggagtgcaatggcacgatcttggctcactgcaacctccacctcctaggttcaaatgattcttgtgcctcagcctcccgagtagctgggattacaggtgtgcaccactacacctggctaatttttgtatttttagtagagacggggtttcgccatgttggccaggtctcggactcctggccttataggatcccctcgcctcggcctcccaaagtactgggattacaggtgtgagccactgcacctggccttaagcagaaatttaaaatgtaaaaaatgtttggcacataagaacctatctccctgtcaccctgacattcatgcaaaagtagttactggtcatctactgtgtgcaaggcctgggtcacaaagtgagtagggatcaatcttgcttttaatcaacgtttatggcatgaaaattgctttctccgtggacagaaccagtagtaaactgggactgacaggctgatggtgggtctcagaacagagcaagtagatgacagctccatcaactcgataacccctattaagctctggaaagcttctgggagtctgctgatattatatagctaatctaataaagaaacttttatgaatagagccctccagtcagattctaccagagatgaaattttctgccgtgttctagccctgaaaaaaaaaaagaaaaaaagactttttctctgtttctcccttatgtttgtcataatactttcaacacttcagggtattcagaaattgaccagaaagaaaccagcaagaaatatgaaagtttcagagtgaaagctcaaggaataatgaagtgcattccttcttctggatgatagtgcttctaaaagaaaatgaaaacagacttgaagagcaaacaaaacagcttcaaaggcagaagaaaaaagggcatcccagcaaaggaagccttagccaatagccagcaaactcagtggctccttgagcagagactgggatgaaatgagacctgtcaaaggatggagtcaaacaaattcagtgcagtcaaggggtaacgcaccaaacaccttgtatgcatattttctttcagcagtgacagccccacagttgcttcttctgtgggcattaactgaaccctgcctggaaaatcagaaaattagagccttttgtttcttgtgagttacccagaggccgcaggccagcatctgattacttcttcctgcccaccatcggagacagaggaacactcctccttctcacctcttgagtgagttttgagatacacactcagtcctgtaacaactgcatgggatttagattcttctctgcaaccacactgttagcttctcaagttccctgtctgtgtctatttatttctagttctaaagtgtgaaaaagttatgcatgcacccactgaccctttttataaaaggtctcagctgaactatttcatttgcaggaaatgctagagtcaagaaaatgctgcttcctgccatttctccatctttctgaagggcaatccttccaaaacttcatgatcgtgaccttcccctgtgcctgtggggaggatttttggacagatcagttatcacctgctgggaaggaaaagccaggccaacagttgtttctctaacaacatctgcacgtgtgacccatgattgctggagtcagcattaatcaacctaccaagagtgggaggaagtaaacaacacatttggttccatctaagtccactggcatgatataaattctaacactgtcttcccaagtttaaggttttccttccattccctttccaaactcccttccctttcccattcctctccagttccctccctccctccctccttccctccctccctcccttccttcctctcttcctctcttcctccctccctctttccctctttcccttccttccttaactctaattctgggactgatatcacataaaagaagtcctcggctactaaagtaggagagaaggagagaactataggcttatgatattcctgttattcatttgtagaggtaatatataacctgtattccctaatatgacagctgtagccctaaatggcattacacaattgtttatgaaatccctttacaagaaaaaaatagagcagaggaaaaaaatgagcattgcctgtacaatccagctctcattgtgcagctccccaggttccagggatgttgcagggaatttgagtcaattgggatcatgctgtttatagcaatatgggctgttttacttgttctacctcaaagtctggatgctatcaaacgtttttcagggccactaaaaagcagaacattaataactaattcagaaaggcagtgatcagctttttatcataacatgaatggctgaaaaaaacctagattttgcaaagtaatgttgttctttgtaacatctctttacaatatacattatattcctttcttgcaaagtgaggttgtcatttcctttacttaaattcatttattaactggagcccgactgtttgtttcctgcttctgacagaaaagatgcattgggcagagtcatttattcaatgatgtttattgagaccccaccatttcttcattttatccttgtgaaaaatatgaaaaaacaaggtgcagttgaacaatcctcttgaacgatgccaagctaagaggtctctagtagaaagctcacagtttttttttcaattctactttaatcaacacttcactcaatacactgatggatgacttcaaaggtttgttgttttgaggtaagattcttaaaatgagcacattacatagttgaaaaggatcactgatatactgagtggcaactaagtcttagaaaggtcttgatagactaggattattggatgagtaactttataaaaactgctttatctggaaaaggataatgtaaatccagcgctgctgagaaaggaggcgtagctattgataaaggctgggaaattttcatgaagaaaagcacagtaagaatgaatgacatgttaatgttgatctgcccagagctggggaaccaggatgctgtacggcccacatcccccttatcacatgggattggcaaggagctggagacatttaatatagtgaagggaaaatatcaaattgtcttcagtcttaaaaaaactcttcccagcaaaagggagcagatgtattctttgttgtttcagaagatatcatgaactatgtaggagttatagggaggcttatttcaattcaatataaggcaaaagttatatcaactagaccttttccaatcatggggctgccttacaaagagcgggccagctttccagtcaagtttaggcagaaacttgtggctgtctgtaaggatgtattagaatgggtgcctgcatcaattaagagatgggactacatacattttctggccccttctcatcttaaaattctctgcttttctttaacagtacagttggtcatctgtattctcagttctgcattcttctgactgcacagaagaatcttctagctattaatgcatacagacaaaagcaagttatcacaaattttgtgatcctgcattcaaacctcattagaatagaggcccatacagaaaggaggtcatatcatttcacaatgctttacatgaagcaattgtttactatctctgatttgtaaagaatgaaaaattggatgtcaggagcaaaggattttcttcaaatacaatgtttatccatgctactttagaggtttaattctctactgaagttgcatttacataaggtattagatattcttaataggatttttcaaggaactcaaaacattgcattggagcatttggggttttggaatttctggaatgtgccacgtccgctagttcccagtttgcagagacaatatggggtgttcatcaacactgtggttcacacgacagctgtgaagctaggctgctggcattggaatcctggttctgtaccttttaatttttgtggccgtgggcaagccacataaatgctccatgcctcagtttcctccttataaagctgtactaatcagtgctggctctgacgatgatgccgatgaatcaccaggcctaagctagaccgatgatacgctattgttccaggcagtgtatttccctaaaaaactggagaccatctcaatttgtgtccaatctgatctgtcgtagagccctgtggttttatgatgcctatagccttacataaagtaatttggtcaacagtatttacagagtgtttattttagaggaattaaaaaatgactacggaagagtgaggcattgcccccacatagccaacatacactttaccaaaaaagaagcaaacatttaaaaatgaaatataatgaaatattttgaaatacactaactcataaacatcctttaatttttaaaagtatttaagtatggatatcatccataattccttttccaaagagcaccagtgttaactaggttataacatgaataggagcttcttggacagtgtttgctttcataaaaactatgatttccaagtcagtgaagaggtattagtttgggcttacaagctggaaaacagaaacagttttgcaagatgtagctaaacatgagatttactttaaaatgcatttactcccagatgcagttgagaaagcataatgtagaagaaaactagaagttatctcaaaataataacaataatttctaaaacaacccaaacgtatagtttcatagtttgtaaaacacttcgaaaaaataccattttatttgtgcctcacaacaatgatgtggggtgggcattaacctcactctaggaagagaaaactaaggctctgcatagctaagaagcgtgtccaaggttacagaggaaatagacatcagagatgggatttttcaccatgatctcatttcttcaaacctggcattctaacaaagctcatcaaattaagtatgaaaaaatgaaatcaatactcatctgatatagcaattttccatcagacaatctcagaattccaaagtcagagtggatttattcagatgcccattattgctatttctgcctgcttagaaaccagcccctcttctagcagcagcggcctggctgttcatgggaggaggtgcctccttactcctcagtccacattgttcacatggagctaaaaccacccctggtgtgggacctctgtcttgctaatcaatctgtctgtctgtctgtctctctctctctgtctctctctctcacatatacacacccctttgcaattagctcagggaaggacacttgatccaatccaggctcactggaactgatggaacgtaatactgagactttttcttttttgagacagagtcttgctctgtttcccaggctggagtgcagtggtgcgatcttgctcactgtgaactccgcctcctgggttcaagtggttctcatgcctcagcctcccgagtagctgggattacagacatctgccaccatgcccagataatctttgcatttttagcagagatggggttttgccatgttgcccagcctggtcttgaactcctggcctcaagtgatccaccggcctcagcctcccaaattgctgagattacaggcataagccacgatgcctggcctgggactttttttttttttttttgacactcttggaaagataggttctctttcttgtaacttcaagttaaacagcaatttggcttgaatctctccacacggagagggaggctctttgggaaaagagccaacacagaggacagcagagccaagagaaggagagccagagagcaatgcagcaaaacagcacctggatccaggactcctgcccttttctgcttaagccatcttgagttggattttttgttacttacatgcatctggaaaagtccttgctgataaattactttaggcctatacgcacagaattaaccaagacagggccacacaaacagccctatttctactagatgttaaaaaaccttctttttattttttttaccactggaaaaagaaagggaagaaggagaaggagaataagaaccagagaattctcctacccttgaaaatttagcaagggcagattataacagccaaaactgacctgtggacccaagaactggactgcatgtaataagaaacattctgaaaatttaacaagtggaaaaataacctgctgggcctctttgtgaacaagctgctcaatgtcaacaagcccaaggcaccactaaatatcacaaggtcaattccactgaaatagggtttttatatattgtcagattttttgtttagttgttttgaaaacagaatattttctattgatatcttctttttctttttttaaatccatggtctggttttaactgcaaacaggacccttggttaagcaccagcacatggagacaaggtggagacgtcagagcttctctagcaaaacgactggaggtgtttagggctgacgggtctatcagaatcaactctggctaatttgccttcttgatgaccttgacagggaagaaaacaatctagacctgtaagatgagtatcaaagcctgaaaaagaatccatctgagtgattctcccacttcttccaattatttgttttaagactatagtacagtattcacaagacactaatcatattgacattagtgttgcccaaaagacacttaatcatactggaatttctaatcccaaagttgtctcagatagagcagggtgtatttgctaaaagaaaattaactgaccatattaataaaaaaggtgtacaatacatcaggtttaaattccaagtatggaagcgctattttccacttttgtgttggtcatagctggctagtggcctagagttcttggcttgaaatagggcacagatatcatcaacattccagatgatctctgaagctcgggtgtcagcttgtcaacttgacgagctgtcaaatcggaagctcctgacggaagagcttattgagtgcactcttgaccttcttttttggttatgtatgatctgtctgtgcttaagtattaagagttgctctttagaccttcatggaaggaaatgttgaaatcatggacaagctgagcctttctgagtagtggctatgtgatgaaaatctaaattaaatctaggcattaacttacggacattaaacaaaaaatctgatgtgacacagtaataggaaaacttgtttagtttggggaaaaaaacactctcttttctttgagacagagtctccctctgtcactcaggctggagtgcagtggcaccatctcagctcactgcaacctctgcctccagggttcaagcaattctcctgtctcagctctcctgtctcagctgggactacaggcatccgccatcatgcccagctaacttttgagtctttagtagagacggggtttcgccatgttggccaggctggtctcaaactcctggcctcaagtgctccgcccgctttggcctcccaaagtgctgggattacaggcgtgagccacggtgcctggccaaaaaagccactttccaaaatgctgttcctttcttggttgtgctattttctgaaaactgattctgtaaattccagtaatgccagagcagtgggtagaatttctgggaacaacaggcctattctctcaggaaaagtatataagaggagaagttactgtcctacttctttcccagacatggcaaagtgtttgcctcatggctttctgggatatccatgctttttaagctaacagttctgtgcacaatatatttccataaagttccaaatttcacttaaagaaaaaaaagccctctcacttgatattttatctaacaatgttacaataataacgtgttattaccatatgatattttttgttacaattttgtaacctgaattggtagagaaatatggcatccattctctgctttccctggctttgacatcattctacccagatccctctgcatcgtgatatatgctccttggcagatgatgtgtttacacaattaaaataataaaagaaaaatgcaaattccattctcaatctacatgctaaatatgggtaacactggaacaaaagatggtctttatagaatgctacaaccaccggagcacttgcccttcaactctctttgtcattaattggcctacaatgagcagggacctttgaattagggactgacaggtgatgggtctgaaccgatagtcatatctgtctatatagtgctttacagtttagaatatgctttcatataaattatctgatacatacaggcctgagaagcagacattatccacattttaaagacaaaaaaattgaaattcagagtcaccacataactcggtccaggtcacacagccagaaagaaaccaaatcagaattccaaccgaagaagccactaagaaaacagcatcgactatttggagaaacaccacaagcaagaatttgtttgtagacagagttaaccccacacctacctacaaagcttttcacaaacatgggagacaggcagcgttctgacacactgtgcagggtctctgctgaaggatcaacaaataaccagtgcagttttgcatttaaggatttcatggtgttaaccacgagttgattcaatcagtttccactaaactactgtgattttctcttctgcttgctgtgcccacataaatggaatctattatggcacatgagaaattagtatttgttgaactgtttttaaaatattttatatcattttaatacagaggcaggcacagggcatcagggactatagaagaacaaggatagggttaggcaggccagggcttgagtcccagctctaccatttaccagctgtgaggccaagcactcaccctgtttggcagatgtgcacataggctcttgtgaggattaaataagatactgcatgtgcaatcccaggcatgaacctggtcacagcagtgcttctgtatggctcagcttctacttcccttcctttaataatatcaaaacaacaaaccttggaagaactaaaatgtaatatacaaaatgctttcaaatagagaagtaattgacctagttgtacttattaatactatttagattgagaaatattaagcttgcaactgaattaattttctaataatttagaaaaagtgtctttagtgcccccaggtaatactgcttttttttaaatcttaggcaagagcattcaaaacataaagattttatattacacactattctcactaatatttaagctaaagtttatgcaaagatatgcatttcttttactgttgagaagcctttgttttgtgaaaatacaagtactatttcattttctcatacgtttttctgtaaatggaagccttctataaatggcttaacttgcagcatttggaaacttttttttttcttgcatgagtttggagaatgtggccttaaccttattcattccatcactctcttattgttcattttaagggtacttcgacttctaaatatcattcaagaaaacttctgaagactgcaattaggtcctaaatactgaaaatattttcctccttctgatatattttccatttactatctcatttccacataactcagaattaaaagctgatctgccatgtgctgtacacacattaatagtgtgtaggacaccttgtttgtgctaaaatgagataacagatgtcaaagtactttgagaatttaaaatcactatgcacattaaggtataattacacatatgtgaatgcaacatttatttattaggggtgtggaaattggggagtgtttcagaacttctgggctaatgagtccagtttagaattacaggctggagaagctatgttttcaacatgataggaaacccatcattcagatgtatttatatcattacattcagttcatgctgaactcaaattttgtttcttgcatattcatttaaaataatttgatgccagagtactgcttatatcagaataatagcaaacaatactcacaatatttgcaaatcccctgtatcccaagacaggtattttaaatattgtttcaaattgaaaaaatcaattaaaccccattctagtgttttattttaaatatctgccaacaaatttaacaggtaaaatggacattaaatttatctcaatttaactttaagcattgcttttccaagttaagcaaagcacctccaaacatctggtaagcagacctcaagaaggcaaaactcctaatgaattattgcggccaccaagaacttaaggtttctggcccagggctagaattccaaatcactctaatggtagctcagctaaacttgaagtagaggggtttctaagaacataaatctgtccaggtgattttctctcaactgcattctcatttcttttagtaggtaagaaagaaagcctgaaggtggacttttgcattttagtgggaaatggactggttaggcaagcattaaccaagctacagtaagcttcttgggagaaactccttgggaaagaactggaggaatggagctccaggttggaaggaggtataactggctgcttgcttgcaaaaattttaattgctaattcaagtctttaggaagacccaactcgattgtctaaacacataacttcaggggaaaaagtatggtctagagagatatgacaggtttttaaaaaagtatataaatttcaaaaagtattacagcaaatgaccaaaaataaggtagaataagaaaaaaacaaacatcaattgagtagttgagtggtgaaaagtcacataaattgaattattcaacaacaagatgacagagtatttcatattttgacaggttaaagcagtatttttaagaggtatgcattcattgctccatgggttttggccttccatactagcgatcatgctcaaaactgcaattaacaccacccagagagttgcagttccagaatccctttttctcattgatcagattcctgtggtgtcatctcctattttctctgcagcagaagtgctgtattgaacagcaggcttttagaaagcttctaataagctcctgatggctgatggagcctgtgtgtctagcagtcactcgatcatcgttagtactccacatgaggggaatgcatgcgtgcacaggtgctctagttcactacgtcccatcagcctgcttatctcactctgttttctgcttttaggcttttttcacctggccagataaaagcccattccattttctcaaggcaagacaattctcataagggatgcatttctgattggagtgacccgttaaaagatttgtgctatttggtactactgcccctgctttcgaaaacctcaggcagcatgtaagggtgcagtcttgctaggccacctctgagtgtttatacataggtagaagggtaagtcgttttttaaaaaaaccctgcagtatatggagaaatttcataaattatgtgagcagctgagagaggtaattctgctatactgcggttgacacagtcaataatagctaatgctcattaaagaactatactcccttacccagggaagaaatgggctcagaaaagacccagttcatattaatacacaaagacaacatggctcaaagttaaaacaaaccacatctctgaaatgctgtcattagagaaatttaaccacatatgtgactcgaaaatataacaagtaacgaaataaatgaaaagtttggggggaaaaagctttcagatgccctatttaaaagagcaccagtgaaaacagtaataaaaattaaaagacaatacctagcaacagagaaagataaaattattcttatttctcctatattttccatcccctttcaataaaagagtctccataatcccaacattgccattgcctgcacaaagaacccagagaacaattcaaaattaaaggagctgaaagaagacacagtatcccaggccttctctccccaaggcatctgcaggcagaatagccatggtttccagaacattctcatcacatttgtctctcgtgagctgcagcatacaatgtttaccagaggctttaaaaataaaatctcactaaacagttgagaaaaatatttaacaaccaaggcaaagcaattacagtcaaattttcacctcgagattcccatcttaggtgtgggaggcagagagaagactcctgcacatcagtctgaacctagaatgaggatgaaaagagttgattctgccaatggttgacaacaaatccatatttttgaatctcagggtgaaatgcggagctacccgcccatctgaatgtacattaagaacagcgccactgttcggttaaggctgactcaagtttctaagcagcaatccgaggacaggctagacatgaacatccctactaaaaacatggaaaggtctgaacgtgacagatctcccttttcaattacttgtgctagaaagcatcatcattttcaactagtcaaggtgacaatatgagaaaacgcaactagtcccagtagagcatttctgtatgaatgtatagacttgggaggaaattaaccacatcacacagggttaatccttccccccaaacttctgccccattatccaaccaatttacattttgtaatctagacttttattactcattttcattatgatttgactttgacactatattattcccttcagggcaaagactttctgggtgcaatgagatcagacataatttcttcagcaggaatgcataacaaggacatgtgtacacattccattcccagacatttctgtctcggtctagttcagatgagcaaggaatgaaaggcggggcataacatggtataaattctagttaggcacggacaataagcatccataggaagctactgttcactattaaaaggcattacctgatatggttgaaaaatatcacaaaggcttataacaccttacctgagccatctgcctctccagttttgatcggggaatatcatcaaagtagttttcatttcttctcctccttgcatcgccctgcatgataatgtgaggaacgtctagggagccaccagtggtgtaagtgctttggctaagtgatggagacaactgaggaggagtgtgattaccactgggttcctgaatggaaatacatcatgaaataaataccatgttctgtggctaacctttggtttcaaaattgtgaaatactgacaagacaaactgtgggggtggggagtcgcttttgaagcaacagccaaggaatgaatgacattccaccactttattaatggcatgatctagtcaatacgtttttcccctaagtatttcaggtcaaaggtctgaaatatcaagagtcaggttctgttttcctaaagcagcatcatggatggtctcaggagggaggcacacctatgttgggcacctctgacactactgcatgtgtttacaggggaggaactgggccctcatgtgggcagagcgtcctcaccatggtagatgccatgatgagaaagctaaaatgagacccaatgggtcttgatccttcatcaaagaatggtctgacaacagggttgggaagaggacacagtacggcaacacagcatgtcacacgcacagactgcagagcagtgcatgctacgacagaggatgcttttccaaggcaaagacaactccatccaagggaaacgggtcaggaggaagatagggggcatagacagctcagctctactatttgcaagtagaatgaggattgggatcatggtgtttctccagatcccttctcctccggatattctggaccttctatgatagatttaggtcctatacttttgcatggaaatctctgtctttgatctttttttgttcccctaaatctcttccagagagccagaatgagaggttcagaaggggaaggaaaaagagcagggtaagtagcaggaaatgactcctctaaagagtcattttagggtgactacactgatggtgcttatatctttctctccttccatgtagcaaaatgaaggcaaaacaaaaatcttttttttttctaatttatttgaggctcctctttctaaggggtgaaatttctatttgtacttttatgactcccaaaactctcaagtagcctccaaatatcccagtgtaccctaatgcccccagtaattaattaaaccagtattcatgtagtccctacccatcccactccagtctctctcaggaggctaagcttgtcctcctggagccaattctcttgcatcccctgaaatccttgcgcattttcctctccaaagctgaatcaactccaaatcctaacagctcctttcctgtcctgccctctgttatcctgacagtggctatgctgtttgctgaagtttattgataagaggcagcccactgcatttcatcacgatggttacgtccgggtgccgtgcttgtgttcatctcttcagaaaagaaatcagaagcaagcaagtgcaggacaaaatagagagcagagtgggcaccccacagctttcagggagatctcagcttttcgacgaattttagaaaagttcttgtaggactcatgaacaccagtgactgccggccacttcttgccactgccatttttgcctggaaatcatctttctcacttcctctctgccctttcctccctcccttccttcacttcctctttatttctctctcctttatacaggttctctttagtttcctacctcataatttttttttttttttttttttttttgagatggagtttcactctgttgcccaggctggagtgcagtggtgcgatctcggcccactgcatcctctgcctcccgggttcaagcgattctcctgcctcagcctcccgagtagctgggattacaggcgcccaccaccatgcccggctaattttttgtatttttagtagagtcggggtttcactgtgttagccaggatggtctagatctcctgacctcatgacccgcccacctctgccttccaaagtgctgggatcacaggcatgagccactgcgcccggcccctacctcataattctaaagtgtagttgaataaaagaaatacaatttattaagtaaggttttagattctctattctgaatttttgaagtgagtaaagctggacaaattttacttcttgaaaaacagaagaccctaaggttaattttaaattgatctttacttaactgtggtccttgatcaattttctttctgtgggtttgaggagtctgacagaaaacccatttccgctctcttggcgtagatggggtgtgggatgggaggtgagggagtggttctttaaaggtagtggtttgtcaggctgaattccattatagatggatatctaaatctcaaaaatatatatttaaccaatctagaaaaacaaatcttgttgttttgattgtgtcaaacaatcaaaagacagattgttttctacacagatatggtaaacttcatagaaaagagccagcacttcctgatctattgcttcagttgtataaagtgcacgtttataaaacctataaaactacataaaataattcttttattttcttactctgttgcccaggctggagtgcagtggtgcgatctctgctcactgcaatgctccgccttctgggttcaagtgattttcatgtctcagcctccggagtagctgggactacagacaggcacaaccacacctggctaaattttttctgttttcagtagaggcagggtctcaccatgttggccaggctggtctcaaacaaatagttcttaagataagggcagagaaccagatgaatgtgcttggcacttaccctgagggtgatggaccgagggggcttctgtgggggatcgtcgtgcagcctgtctcccagagatgccaaaatacgtttcctgtggccaatcaaattgatttttaaaacctgaaacaacatatatttgggttaaatatttcactggagaacaaataatttttatatgtcctaaaacatgtggggtgaaaaaagatttgtgcaaagttactcctgcaccatgagatgtggtgtcacttcagtgtgaccgctgaagtccagaaagattgcagtagcatctggaaagcctggagtggctaagtatcaggggcacaaagagaagggaggatggttctccttccactcatgctgcctgagagcctcattcccaatgcagcagcctcaagagaaaccagctcttcttataagcagccgaaacctcacaggataaaatctgagtctggactcaggcttcagagggacaggctgccctctgtctctttccctccatccaggatatgcagtcatgccagcctcctctaggtattagaagctccacattcattctcaccttggggcctctacccctgctcaaccacctgcctggaatgccccctctcccctctgagattttcaaataaccagtgacttctcatggttctggacactgtgctgctgatgtctcctcagaaaggtcctcccccgcctccttattgaagaagccatgccctcaacccctgacatgctctccacgatgatccatcctcattttatcacactctaaaagcactttctttacaagcttagtgtttgtgttttgttccaccctctccaggtaagctccctgagagcagggcactggcatatgtagagcactattatttcccaaaagcataaaaggatgactaaaaaaaaataagggattaatgaatatgaaagaatgaatggtaatagagatgggagttgcaaaattagagtcatcttgcataaggatacagttagaatgaaggactgcctattggggtagactcagagcctccccaggatggtattttgaatctgaccatgctgcaaagggcacatggtagaagagctctcaaagggaactgagaattgcagcgcctcaatcctcagccccattcccggtgctttaccagggccacacccctttcaatcttcccaacttctctatctggaaggagttctcacttgacagatgaagaaactgtggttccgagtggttaagtcacctacccaagagccagcatgtcgtggctctgggatttgaatcagatttgcctgattccaaagcatgttttactccaaagtatacgtcacaaaatttgggcatttctccaaatgttaccagcttcttaaaaacacattgtatattcatccattcataaaaatgtgtttacctcttccctacctatgtgtagtcccaggatataataatcttgttgggtaactagtttccaaagtcgttatcccatgtgtacatttttctcttctcttttcaagttttaagatagaaggtggggagagcgtttctttggcaggcatcccatgataccttgaattttttttaaatttcaacttttaatttagatgtaggtggtatatgtgcaggtttgttacatgaatacactgagtgatgctgaggtctgggatatgaatgatcccgtcaccaggtagtatgcatagtacccaataggtagtttctcagcccttcttcccttcctccctcccctcctttgtcgtccccagtgttcactgttgccatcgttatgcccatgagtactcaacgtttagctcccacttataagtgagaacatgcaatatttggttttctgtttctgcgttaattaacttaagggtaatggccttcagctgcatccatgctgctgcaaaggacatgatttcattcttttttatgtctgtgtagtatttcatctaccttgactttttatttgcctatttgttggttaacttacgggccttttggcctaaactgatgtagattttaaactcacactacgccctattcctttgacagccaccctctgacccatgtctgttgatgatgaggagggtaaatgttagccaaggtgaatgtccccatgcaccatatccctatgattttataaaaccttcatctccccaggctgattaatcctaatctttgcaagtttgttttcataaagcagctcctcttttccataaatcatttcagttgacatcctcaggactttctcctaccctattatagctgcttaaggtttgctgaaaaaatggctcacaatattccaggtgtaagtgaaccatggctttacatttatgcaggatactgttttctgcttttaatacccgtttaaaatgtccttcctaagcacacgtgatttctagctagccttttagctgcagtaggaataaccagggacaaaagtatacactgactataaaatcccttaattttgttatagctaatagttcaaagccctttaatctaggagggatgatttgagttatttttccctaaatttcttatcttacagttgtccaggcagaagcccatctgccatccttctgcccactcacacagccctatgttagctttttgcatttatattaaccagtttggcatttcactacctggaagagcttagtgatttttgcatatctggaaatttcactatgtattcctttcagatgatttataaatatgctaactaagtgtggccctactgctgattacttgcaggcagcattgtttatacgatccatagaaatgcccttatattcttgtattgtttctgtttttaagcatcaagaccaaataattcctccatctcagaaaaaatatgataaccttttcaaaggtattttgcaagtctaaatacagcatattttctaattctcttttattctcatcctcaattcctttgccaaaggcttctattggatataaattcctcccataaaatcttcaccgcctttctcccagcaggtagctggacctcatgctgatggtactaccttgccccctccctgagtcctgctagaaatgttttttataataaagacatttgcttaattattattattattattattattattatttacaaaactgacactaaataacacataactgtggtacaattgagctgatgtaatccccactattgcttttggtttactctcccacaactcaattttgggcaggttacctgactcctctgatctcaggttttctcacatataaagtgaagaagttaatgacaatttcaaatgtggttgggaagatgaagagtaagttgtgagaataaccagcatagtgcctgacacatagaagaagcaactttcacagtgtgcttattccagtgaatgggttctgagggtgcacaggaatcctggcccagaagaacaaggacttgttcattgtcataaagtcaatcatgttaaacaaatacactggagctttggatgaagagatgtggctaaccttgggaaagccctcaatgaagtaacttatcctagtaggaacatggctgatttctagctattagtctgaggccagacccaatttaaaagaatatgctcttctgccatccacatcgcttaatcttcaataggaggtaagctgaggcactcctctgcactgaagcttcattgctgtctcctccatagagctacccagatgagggtggacggatgaatgaatggattgatggatagatgatagatgatagacagatagacaggaaacgaattaacacaggatggttagtactatcaagatcacctggataactctcctttttatcagaaatgagcccccatcactgaagatactgatggtaacttccatttactgaacattttctatactctagttctatgtcctagttgtgctagaaactaccaagtggttatacacaaatataaatatctcctgtaatccttacaatagcatacaataaaaccattctcattttagagatgcaaaatctgagattatgaaatgctaagtaacttgcccaaggtcacactgctaagaggtacatggctaggatgtgcacctgattcttaaccagcccttcactactctccttgctcttcttcttgctgttaacctctataccttttgacctttagctacactattggttatgtcatcatgaggcttcttaagatgttgcttcttactttgagttatcatgtttaaagcatttatatagggttttgagcatctgaaaacattaaaataattcactttttagtaaggcttatagcattgttaaagctacaggctacaagggcaggtacctcacagtattccctgtgaaatacacatatagaccaaggacaggaaaccctcatcacccaagattcaatccgagctggctcactgtggagtggtagagagggtgacagtgggcttcaaaacgcccaagttgacagtaagaaatccaattggcaaaacaataacagagagaatattccaaagaaagatggtcattatggaaaagtcaagtctgaaggtggctgggtttgccttgagtgagaaaggctttatagcagactgtctttgcaagcagatggggttcctgagtagtggaatcctacaaccccaggcatcatgggtgataaccagtgtgaaaactttagttttcaagaacaccaaagcaatggttactgcagtagagaagaattctgtgttttcgttactgtttgggttaaagttaactgttcagacaagaacataatgggagtaaaagacaaaataatggtaatatattggagattcagttattctaagatgttgaagcaattcagttcggctcaaaaaacaatactgaatttctgctaccaattatttggaggattcaaaggggaacgtctatgaacagagcttacaatattggagagatcaggcacaaataactacattatcacaccattaactaagaaaaattattatacacataagcataagaatgtggctccaactgctgagttccaatagataagaaataaaagttggccaggcgcagtggctcatgcctgtaatcccagcactttgggaggctgagatgggtggatcacgaggtcaggagatcgagaccatcctggctaacacagtgaaaccccgtctctattaaaaatacaaaaaaaaaaaattagccaggcatggtggcgcacgcctgtagtcccagctactcgggaggccgaggcaggagaatcacttgaacccgggaggtggaagttgcagtgagccgagattacgccactgcactccagcctgggcgatggagcaagactctgtctcagaaaaaaaaaaaaaagaaaaagaaaaggaaataaaagttatggcatgtgttcttaatggtttttattacaactattgtaagaggaatgtgggtcaaaggcaaggagtattgttgaaaccacaggagtcagccacaggtgggtatccattcatcacagcagtagccgcctccaggaattttctccagtatcacttaaacaggataattccggaaaccccactgtgaatctcagcaacaggagaataatcatgctggatgacaatcctataatatcacgtcactgctgtttatgtttctgggtttggctgtgggaattctgccagacagtatcatgatatacccttacatggaatagcttacttcagaatatatgtcatagcaaagctgaaagtcaatgtacttaaacttccttttttcttttaaaatttaatgtgatataaaattaaacatgtttaaatttatatcacattaaatttaacatgtttaatttaaacatgatgtaaatgaagcatttttatctgcttttaaaaaagtaaataacattttgattataatagctatactgctttcccattttagacactttataaaatacagaaaaacaagtaagagaaccagtaatccacaaactatatctaaatagatatatttcatttctcccccatgattatgttttgtggtggtcatatcacgagtaccattttcgccttttcttcagttctttaaagctaaagaacttttctacatatacaactctcagtagacattttaactaactccatattatcacattattgtttcagagaagtatgtcataattcactaaacatttcccctatcattgaaaattttggtttgtgctcctttctggatagcaaacattccacatgcttaaataattctatcatcctacaatttccgttctcaatgccatgtttacatagacacagcatagaaaacaccaaagaagactgcaagaatcacacaagtcacgcagaaaagtcatgtagcaacagtctgtctctatgttctgcatgaaatctcaatccgtttattgccggctggaccaactcctgggaaaatcacaaacccacataatgttcctcagtgccatattttgcattttgttatgtttttggagttcagatttagctgacagatgtgaaacagcacatgtagctggaattcttcagagagtacacatgcagcgatgctgggcacacaagcgattctagttctcaccaccaggcgactgcatcctttttatttctagattgttattgagggagggagttcatcctgcatttggaactcccttccattttagggggtagattatttcccctttcctttctagatacttggccaactaaagagaacagctcctatgcaagtctgtagagctcacctggcttcagagtagcctcttctaataaaactgcaagtgttctgagcagttctggtgttcctaaatgccaagaatggaagttgcggtggaaactgatctgctttgttctcatctgcagaactaaaattgcaaataattgtcaaagttttcccccctgcctgataacaatttctaaacactttccacctgaaagcatcaaggcaaaagtgcctgtgtaaaattccatttcgaattcctgcaatcttagaaatcctcacttgaacttgcatacagttttgaccatgacatttttctctcttatttcttgaactgcaataatccatgtccagcatgggatggtgaacagaaagacctcaggagcagaaagtcatgacatttggttcttctcttactcttcttctagctaagtaatctttaatgtctttgagttgtaatataaaggggacaataacagtcttattcaacaaatatttcttggatgcctttcacatataaccaccatgttatgcaatttgtgagccacaaagaagaaaaaatatcgagtcctccagggctctcaatccaggcagtaaaaaaatattaaaaccatgtgaacgtatgtgtgtgtatatttgtgtgtatgtatgtaggcatctatgtatgtatgtatgtatctatctttctatcatccatccatccatctaaatatatacgtctacacagccttcccagcctaaaaggggtttctgtggaatgaatgagaatgactaggaagcttatctggaaattataaagcacagaactaaggtactaactaaggtattatttctcttttaagtataacagaaacttaaaactttcttaccctatcaacaatatttagatattacctttgatatttaaatgtgccattatggatatctctgggtagattttagatccagaatcatgccttccacttctccaatcttctctcctgttatttctttgctccatgtatacacacttgtgcatattccagagtgtctctgcctggattttcattagaatctcacaaggatgaaatcgagatccacctaaagccttgcttgctcaccttggattacatagacctttctctctttgaatttctttagtatctgtggtctaccctgtgctgttgacacatgatacatcctggtgggtatagctaactctcttttttttgcgtatgtgtcttacctgatcaactagactctaggcgctgaaaagtcagatatagtgtcactgcatctcagggtccctgaatgcatctagctcacgaatacaactcaaaggtgatctctaagatctcaactcaaacccctgtcaaggtggacaacaaatgaagcaggggagatgtctctaaaagaaaaagagggaaggaaaataacacctatgtcttatttcattccgtttctactctcaagagtcttctattctttctgagctttggcaccttaattcctacacacagtcttgccacgggtgatgcaaaacttccttacatcccaccatctgtaactctttccctttacctctgccacttcatctaaaaaaaatccctctgactacagtttccaaattcccttttccttctgctattactttccaaaccaactgctactaaataatcagcaaataactgtttgacagatgccaccgaaatacaactgtactaacctatggaaaggaaaagaggttccaagttatacagctccagagagagcaaaggatagtgagaaagagcgagggaggaggaatgcgtgttttctgaatgtagtctgtctcattaaataggaaatactaattatgaggaaatgagatcatctttgcatggaaagagagaccttaatggtataattgcctctgaacatttaagggctctggaggtacaaagccttcttttgtaatcaatgagaatcttaggtttatttgtaaagctctctgaattacctcttgatgaaggtactaattttctgattttcatgtaaacattgcttcagaagattaaaaacacacacaaaacaaaacaataaatcagttcccaactaatttccctgaaagttacttttaagtaaagcttgctgccagttaagtttttataggagaaatttggtttacattgctcaataacccaatcattggggttattgaaggaaaaatttgttacaaaagaaaatgggaagtatgtgcaacatcccagatctgaagttattcttggagatgtgaagatgtgctaatagcatctgaaaagtgcaaatctccctgcagtactatgaatacataaaaatgctctgcatcttaagaagtagagagactgctgttttgctatattttgctaaccatgcaggatatttactgctaacgagggtattttctaactttatttcctttcaatttttgagatcataaaatttatgatcaattatattgtgtgactgatgctctcagtattgtaaaggaaattatggttaccgaaattcattaacatatatccatataaaataaacagaaacacgcaacatacatgaacacacccatatttgtaaaagaagctctaagacaaattgagtctcaagagacaatcctaggtaagtgagggcctggttactccgtttttggattataagtggtcttttctgctctgttgctgctctgcccctcttcttgaggtttagctactttaatggcatataacaccctccatcagcagacagaatagtgaaagaggcagtgaattcaatccagccaattctgtttctgtcagcagctctgataaaagggttttatgtgggaggaggtaaaaaatctacctaaaactagctaaactaaagttttaaaaatgcatccacagattttacttagcctagccagctactactgcactttagaattggacatttaccatatttcagctacgtatggaggcaaaaaggatgttaaggttaaaagaaagtattataaggaaagcagaggttgagtcccaaggatgagttcaaaaagaggaaaaaaaaaggggtaacaacagtgagagagatttcttatcgtcccttttctccctttgtccccacccccaccactatccccttccttatcttctggagagtcacatcacagagtagagctaggaatcaccctaaacccataagaatggctaatgttagaaaagaatgaccctacctcggatgataaggatgtggaggaactggaactctcatcttgctggtaggattgtaaatggcacagtcacttttgaggaaactgccagtttctcaaattttgacccagttttctaacatataacccagcaagttgactctagctagcaactcctagctaaaaatgaatacatatgcccacataaagatgtgtacatgaatgtttaagcaacattattcataatagctaaaaattagcaataatccaaatgtccgatcaactggtgaatggataagtaaaatacagtatattcatgcaacaaaatactgcctaatgatacaaaggaatgggctacatgatacaggctatagcatcaacagacctcaaaaacattatgctaagtgaaagaagctgcacacacaagatgatagaatattgtaggattccatttacatgagtttctagacagcataaaactatatgtacagaaaacatatcagtggttatctggagtaggaataggagcagggattgactgcaatgagcataaaggaactttttagggttatggaaatgttctaaaatgggattgtgttgatggttggatagctgtataggtttactgaaatttacccaactgtatacataaaatgggcgattttcatgatgtgtaattaaattgcaatgaagttgtttttgaaaaaagaataatgctgggagaatgcattcagtatgcagtatcgtataaataaggccattcctgaaggctgtaatccaggctgctcgagaagacctctgttgtcttggaatataccacttatcagctggatggaagggtgagcaacatatacactgcaggatgtcttaaggaaaatgtgacctgcagggtagctttgttctaggagcctagtactatttaactataggctaatagatcagtagcatattctttattataagtgcacaatacagtaaattagtacgactttcctatgtatgtatatttttgagggtcttaatcctccaagtcataacacttcagtaaaaatgtttatgctttctaagtacttacaacaaatggcttatggatgtttgcggagtgatcactaggagccaacatgggttctctctggatgggtaacaggtggtgatcatgagatgacactcaagaaccagagaataaggttgcattctaagcaccaaattaatcacatcaacagtgctatgatttgagttttctctgacaaaaactcagctttaaattggatctccaatgtggcagtgttggcagatggggcctaatgggagatatctgggtcatgaggtggcgaatcctccttgaaataacttatgccattctctcaggagtgagtgagttcttgccctggcaagactggattagttgtcacagggatgaattagttcctgcaagagtgggttgttaagaagccaggacatcctgtgggttttgcctcttcacacgtcagcttcccctttaacctttcaccatgttgtgatacaacaccagaaattctcaccagaagctgagcaggtgctggcaccatgcttcttgaacttcctagcctgcagaaccatgaactaaataaaccttttcttctttataaatcacccagtctcagatgttctgttatagcaacacaaaacagactaggacaaacaaagcgactggagtcagaatgactttctagcccatgaagagtcaatgaaatagactggcagtgtgactacagtttaatcggtgatactgaaacccagctaaataaagaaggtgtgccagggtggggtggagaagcaagggtagagggcatattgaagcagtgaaactatctagctttggcagcagcatggggagacactgaatcttaacataagtaagctccctgattactcaaggggttattttatcaggttttgtactgatctaaatgaaacatccctcaaaattccctttccttcaataccacatgtaccaggaagcagtaattgctgaatcagttttctgagtgcccagatatgagaagaggaaatgttgaagacgggggatcagggaggggagcatttggtcagagaatccttcccatcatgtattaacagaatggacatcttgatacattgatctctccttaattaaattaaatccacaccaccgaggcacagaacctgctcaggagggcatagtgattaagagcagggcttggtgtcaggatgacctgagtgtgagtgttggtactggcatttactctatatgccttttggtcaattacttaacgtctctcagtatcacctaacttgtgtaaaatgatggagctaagaaacagtattcgcctcttagtgtaattgttaggattaaatgagacatatgcaatgcatttagcacagtgcctggtataaaatgagcttcataaaattctaacttcattcagtgttttgattaagcccagtttctgaaatggaagggctgagccctcccctggaaccccaccagaaggagctcagcagccagccatgcaccttttccctggcaacaatccctgcatcatcagccactcttcaaactttggtggcctcattgaaaatcagtttttgccaaactttattgactttctttttttgacaggtattagtatgaggttgacagaccaggagaatgtcatagatatagtgtctttgattccaataaagcacttgatgaagtctttcattatctgcaagatggtgggctctatgagggaaaaattaagtggattcacagctggttgtacatctatagccaagaggcttgatgaatggctctgtcataacctgttgggggaccactgattgaatgccacaggctctgcccctggattctgctctattcaatatttttattaatggcatcaaaatagacataagaagaatacttatcagatttttcaatgacataaaactgtgaaaaatatttaatataataataggctaatgtaaaattcaacattctctcaacgggctgaaaaggccaagctgacaccaaaaagatgcaatttaacagggataaatataatgtcttacattaaggatccaaaagaaatcaattgttcaagttcaagatgggaaagatatggctgtgccacagttcaaagaaatagctgaatttttagttaaacgtaggaaggggtttagcagaaagaatgcaaaagtatgggtctaatggggagggaatgaacccatttagaataattttaccaaataaataatctcatttaccttgctattacaacctaacaaggctggtaattaccttaactttagaaatgaattaactgaggttcaggaatttaaggaacttgtcaaagtgatgacaaaatcaggatttgaatccagttccgacttccaaaatttgtgcactttggattcattctatcttgctgccacttctctcccagagatgctgtgtggctcaagtgagacaattttaatggacgtacctagcacagtgcctggctcctaccttctgctcaaaagtggctgattatttttctcccagagactcattaaatgtaaggctgggtgcttatatgaacaaccagtactttattattataatatgaactctgcagtctattctaagtcttttcaagtttatccattaatatacctagtgcagaaatgattctgttgatttttattctctcattcaccattatttccaaatccttaatgccagaagaggaagtccagcctggaaaaggcactggaaaatttgagggcaatctaaaaatctctgtcagtcagtaatgattcccagataattaaaacttttttttttttttaattaaggtaactttcaagggctgcattagtggttcaatgctgcgtattaacatgacaaaaacctctattacctttagataatgaggtggtgtgttaagtaaccttagtacaatgatatgcatacagaatgtacaaaattttcaattaattcaattatttaattagtttagcttatggttaaaaagatacttttttttctgttgttggaggtcttattagaattcttcatatatatatatatacacacacacacacacacacacacacatatatgtacacatacacacatatatatatatgtatattttgttctttcctgcctaagggtggtttattgacagtctttaattcttccctagatatctggaatactgcattgcatctgagtcatgctctgtgtagactatttgtcactgggccacagtgctgctgcaaaaggtggctgaggaatgcacactggctccagcagtatcctgtaagatttagctcttttaaataaaggaattcttaggagcagttagttttcattgcctcttgcactaaaagcaaggcctgacaacattagctatccaaaagttccagttaatgaaggtttcattgtaaaaaagaatccatttgggggaaggtgcaaactctttgtaattttctctccctctttctcttggcctaggccagccatggttcacaaagctggagaatggagaatcattagctgctgatggtgctggtcatcccaccctggcaaggaaaggaacaggtatgttgagtgaccaggttgacctgtgcagtggatgagccgaaaacctcttttgtaagctgttttgtaaagatatggagacaactgatgattctggaggtggaggatgctttgagggccagaacacacactctgcaataaagcaggtcacttccttcaggttttaagctaaaatgtgaacacatcagtggactttcacataagctgtgctttctttctggaatgtctccttttcctcttctccatctagtgaacctctactcatcttctactctttcgagttaaatactacttttgaacaaataatagcaaaagaacaattaacggcaacagaactttggaatgacagttatcaaactagtcctgatccataaacaaaagtctacttagcacattgtgtgaaaaaatgaagtctctttgtttttattttcttaaaccactttattccagtatgactgacatgtaaaaggttgtacgtatttaatgcatacaacttgatcaatttagggataagtacatacacatcaaaccatcaccaccatcaagactataagcatacccatcagctcccaaattttcctccagctcctttcattattattatcatcatttttgtgtgtgtggtaagaatacttaacataagatctcctcttctggcaaattttaaatacacaatacactattgttagttactggaactatgctacagtagatctctagagcttatttctcttgcataagtaaaattttctatttaaccatcacctttccatttctgcccccagcccctggtaaccaccattctactgcctgcttttacgggtttagctatattagattccacattgaagtgagatcatatagtatttgctttctgtgcctggcttatttcacttagcataatgtccttcaggttcatccatattgttgcaaatggcaggatttccttctttttcatggccaaataatattccatggtatgtatacactacattttctttattcatctaatgatggaaatacagattgattccttgtcttaggacattgtgactaatgctgcaatgaacacgggagtgcaggtatctcctcaagatcttaattttttttcttcttttgagatggagtcttgctctgtcacccaggctggagtgcagtggagagatcttggctcactgcaacttctgcctcccgggttcaaacgattctcctgcttcagccttctgagcagctgggattacaggcatgcgccaccatgcctggctaattttcgtatttttagtagagagggggttttgtcatgttggtcaggctggtctcaaactcctgaccttaggtgatttgcccgcctcagcctctcaaactgctgggattacaggcttgagccactgcgcctggccaagatcctaatttaaatttgtttggataaatatccagaaacagaactgaagaatcatatggtgggtcaatttttaatacatgtttattttgtatcaggttgcaaatttgttgatcaaaattatgagttcaagatgaaaaagtgaaaagtagagcaatgctttctaagaaatagatactgaatcatcaaatggaaaagtaatatccccacttgctaatttaattcatcataatttacaagtctctaatgaaaaccaagcaacaaacaatgacttagtatttgttagaaaacagtttaatctccagttgtcactgaactcattagcaacatatgtcattcacacacagtgaggaattattaatttttcatttcaagaaaattgtcaaattaagctggatagaataacaacatacaataaaaaaattggtaatttattcttatattgccctagaatgatgatagtgtgtggcatgtcattaattaataaacataatattattcacatagtgggcccttgatatccatgaaatgtgtaattaatgatgaaaatgctatagtgttactatcacacttactgatcacatcgaagttttttccacccacacttaaattaaatctccctgaaatccctggttcaaatttcatgagattcaagtaatttgtgatttttttttttttttttgatgcggagtctcgctctgtcgcccaggctggagtacagtggcatgatctcagctcactgcaacctcctcctcccaggttcaagcaattctcctacctcagtctccagagtagctggaattataggtgcatgccaccatacctggattaatttctgtgtatgtgtggtttttttttttttgagacggagtctcgctctgttgcccaggctggagtgcaatggcgtgatcttggctcactgtgacctccgcctcccagatttaaacgattctcctgcctcagcctcccaagtagctgggattataggcgcctgccaccacccctggctaatttttgtatttttagtagagatggggtttcaccatgttggccaggctggtctcaaactcctgacctcaagtgatctgctcacctcggcctccccaaatgctgggattacaggcatgagccactgcgcctggcctgatttgcgatttttcatgaagaattttttaaaggccaaagttcatcctcaagataagaaaaatgattgtttgccatagaattcttctaatctcaacttttaaaagaatttattaacatttcaggtcaaatgcctcaaatgttgaaatctcatattttaattctttgagatgaagtgttttccccagcatttcttttttttttttatttagatttagtcttaactcgcatcaaggtttataaaaaatgatatttctatttcatgagcatggacagaatgtgttgaagcctccctgcaggaaaattatgagcagaggtaaaaatccttgcagcattcttagctccttagctgtagtgtctcttagagaaatgttgcatataaggaatgctaattaaggaggctgggagaaaagagatgccacctttccaaacacaacatttcaaaaacaagtattactaacatggtggttttatgaagcacttgaatcttacataagtatggcttgttttttgtttcctaaaaaaagactgcatttgagcaaaccaaaacccgagtaatttaaatcatgaatttcagagaaaaaagttttgcatctagctaggaacttaataaaatataagttttcaaatactttttttttctattttaaaatcaggtacactgctatttgcaaaatctctagtcaagtagaagcagaaaaagaccgtcttaattttaaaagagtaaccctgctcccatttatgaggatttttgcagggagaaagattttataagatattcacttcaatacaaaagggcttaaattcaagagtatttaaactttgaatttcaacttatcccttggaatggcctcatggctaatttcttgtctatatacaaggtcaaatagatgtatgtctttggttaatttggactgactgccaagcaatttattaggaagctggaggatctaaattgatcatgaagacaacagaataaatgggctttgtctgattacttccgtttacctgatgattaaatcctgcctgcagaaaatttatgtgacttccaaataacacagagacagacagacaaccccatgacacactatttaaaactcttatcttcattaaatgaaaaaaaatcaatttcaaaagtaccttttgttctttatgtctttgttaaattacgtctgaggaagtaaaagagcttcttgttgccgtacttcctggtctattgtcatatatcccacaattggagactttttgcaagatgggtaatttggatatcaaatatgagaaattataagtgcctttagcagatactgcttttccaagagttcagtgtgatcttggataaaaatttgggcagatggcttcctttggaggcttatacattgttttccacaaaatgtagttgatggagaccagagaagcattgcattttttttttttttttttttttttttgagacggagtctcactctgtcgcccaggccagagtgcagtggcgtgatctcggctcactgcaacctctgcctcctgggttcacgccattctcctgcctcagccttctgagtagctgggactactggcacacgccgccacgctcagctaattttttgtatttttagtagaggcagggtttcactgtgttagccaggatggtctcgatctcctgacctcgtgatccgcccgcctcagcctcccgaagtgctgggattacaggcgtgagccaccgcacccggcccagagaggcaatttttaagatggaaaaaaaaaaaaagattctctccaactctctttgcccagcctgccaatgctcccattttcacagcacccaggccagccaagacctaaccttatgcagaaaaaggaacaatgctttaactaggcacagagttctattacttttgctacctaatatgcaaaacactaaaggaagagggcttattaaagaaccgcagcatgttttgtaaaagttggtcactgagtctttgacagaactgctacagtactacagttctaagttcctactggcagcttctattttgagagtcatgccttgatgggagctacaaacaatgcagcccacagtagtacacattcatccatccattcattccttcagcaaatacacattgagggtggaatgtgatggctgatgttaagttggttaggagcacacaaaaatgcacaggacatacttattgctttgagaagctctgggcctagtggggaagatgaagtgacagatgctcttagggagtaggttcagagtggtgtgaaaagtagggagtggcaatctctacctggggagctggggatggcctcacggaatagaagacaggcttcagggctgagaaggagatttccaagtaaagagctataggaaggcgattctacacagaggagacaccgtgtgcagtctcagacgtgtgcaaggacacaacaggacatgtctgtttatggtttcaaaattttacttagttccctattaattttgctaagggggaaccatatgtgtgagtagcaggactgggggatatgaaggtgggtcagagccagattgttaagagccttcaaaaggaatttggtcttcaacttaaacaaattagaaaatacgtgtaaagtgcttggaaagatgtccagcatatagtgtatactcggtaaatacaagctgtttctgttatgttgaagtagacaggaaaccaaccaaggttttaaagaagggaaaggatgctcatgactataatcccagcactttgggaggctgaggtgggtggatcacgaggtcaagagatcgagagcatcctggccaacccagtgaaaccccatctctactaaaaatacaaaaattagctgggcatggtggtgcacgcctgtagtcccacctacccaggaggctgaagcagcagaattgcttgaacccaggaggtggaggttgcagtgagccaagattgtgccattgcactccagcctggtgacagagcgagactccatctcaaaaaaaaaaaaaaaaaaaaaaaaaaaaggagggaaaggatgatgatggcagagttggtttataacaataattctgatgccaatattgagaatgggctgcagtggggaggcactgtccacaggccaggaaagggaaataattcaaatagtgaggataaggctcagcaattagaacttgttcattactaaattcccagggtccaacatagtggctacttgcagtgggtgctcaatgaatagttgctgaatgaataaatgaatggcaatgggaggagggagcagatctgagaaatctctaggcggcagaaacagcagggttggtgagtaccagatgtaggcgttaaaggagagggaggtttttttaaggatgactctggaaattaggcttgggaagatggtgttgccaaattctgcaatcaagtagaaaggaggaagaacagggttggcagggaacatgaggctctgggagtactactttctatgcatctgctgggtttagcctcttggagtgttgagaaaaagtgggcaagggaggacaaagaaccctcacatgggcactgagctgggtgttttcctttttactgtgtttaatccccacggactatgagtttgatattgttatccctgtttacaggtggggaaactggggctcaagatgacacattagcgaggtggcagagcccacattaaaaacacgtatctttctgccacaaagcctgagctttttccccccctccatccatcaaattgcctcctccattaaaatgaacatttggaatatgatatattccatatttagaaggctcgggggtgcagggtgagtactttgcaaaggaaccaaagcctaacttctgttaactttctgcttcatcgatactccaaatctgtcttcctcattcacagagtccctatgaggatccaaaaagatgtgagaaatcttttgaaaaatataaagcgttctataaaaacaaggtgatatcaaaaatgagaagaaaaatatgttcagattcttgttaaggaattctagaacactgtaaaagatgacagaagctggatactgtcttaggaccatttgactggcaacagcctctttccaactatggttcagggagcaggttgaggtttttctgtctttaggggtcagtcttcctaaaatatgaaaacccgggtttgaggtatggggaaagaatgaattttgccttccaaaggcagagtttacaacttgacggctttcactcctctttcaaaaataaacctaaattcctatcagttgtctgcagagttccatcagggacttggtagagtggcccctaactggggagcaggaattatatgtgcttcctccttgttctgcaaagcctctgaacaccaccgagggcccatggagagcgtgatgatgtgtctcttggcccatcacaacgtaagcatgctgagcagaggctctatcccacatcctcactgtagccacagtgtccagcaggaaggggctcactgtatgtaactacaagaactttcggtgtttgcattcttccctttgctctttaaatggctggcttcttcttcccactcagttttcagcttaggtgccacgctgggagaggcctcctgtgactgccctagttaaatagatcccccctgctactctctatcactgcactctgtcatttttcatgtggttcctttcagaatttataatcacacatttgcttgtttggttatctgtgcctccctctcaaaccagactgtaggcttgagggcacaaagcatgtcaactctattcagcccagcatctagcatggggctggcatgtggtaggcattcagggtctaactgttgttttaatgaacaaacagacctaaacctgagatggtgggacaaccgacaggaaagcagaaggccccctcagcactcgggggctgttgttccataatcaggcttcattatgatctgggaccagggatggagccgtggattggctcacatgtggactgggcccacccctctggactcatcagcaagacatgcaaaccacatgagtcaatggtccacacacagccccaaaggagaagaacacaagtatcactattcctcaactttggagtaggttccttggtctcctagttaaatatgcatggcacataaaaataattgtgcagacagaaggactcacagttgcttaatgtagaccaggaaagtgtttgaaccattcagtgggtggtgcgactcctaggggaaaccagccacgggtgggaatagaaactactccaggaaatggtactgtatggaacaatttacatattttggggcatgggaagttttggaaatgcatttgttctcctccatatctaccactgaaataaatccttgagatttaaaatgagtagatgatatttagtaatatgactgaaaaatcacataggactcatttatgagccaggctttatgcgcaatttacaacctgtatggaaagcaacaccatcccctgttttacaaagaaggaaacaagttcagggaggttatgcaagtctgttagattttaacacttgcactcccttcaccatggagccaaagcctagacttaattgtttagaatatcattctaaattgctttttgcaatgtcatttcttatgcatttcttacacaccttttaggtgccaggaacgtatttctaaaggcaggatagcattgcagaaatgctagcctccaagagatggggtgtattttccattgagaagcagaattaggggaagggtagttttacctcctcagtgtcaactgaaatggcagtcattcaacatttcactcatttcccatcagacaattttaatctgaataaagtttttaaaaatctcttggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcctagctactcgggaggctgaggcaggagaatggcgtgaacccgggaagcggagcttgcagtgagctgagattgcgccactgcagtccgcagtccgacctgggcgacagagcgagactccgtctcaaaaaaaaaaaaaaaaaaatctcttaagaaaccatctccttacaaattcccttcttgcaaaatacttatttttcagtaaatatcttcgttgacaattctaacaaaggtactcaaattctatatcctggctatgcctgtcaagagagttgaaggaggcagtggccatatttagagggccaaaacctgttcttctggtggtatattttgctgatctgctgatcttgaaggactccagtgccttaaatttacccacatgtcatttattgctgcctaatgtgcttattcattattttttgaaaatagaagcatattcggaaacatatttaattttacgatgttaaaaatgatcacttctggttcttcaccagaactatatggagtacctggaatacagtaggtactcagtaagtacactattaataaatgaagaaaatatacgcaggataaaataaactgtttttcataattctatccatatatgatttttaggattgtactggcttaaaagctgggactatacaaatacatcatcaatgtgaaaagctgggaaaatgggaatgcgaaaatcaaactggctcttggccagtgattttttttaaaaaaacaaggtcttcaaatgtttgtaaactgcaaaatgtccttgttgtccttctccctttttttttactactggcattgtcatacaaactttgtgtctcttccaaattagtctgttgtttgggatccttaactacggagagtgtcaactgtgcgtctccaagacaaacaggttgatgcgctgtctttctcagacctatgctttaaagcccaggctagggtcatgctctgagactagagcattctgactttctctggtctgctcttttctggtccttgattttcttatctgaatcatggggtgtccattgtttagacggaaggttgcaaatataaattaaataattcctcagcaaacaatatctttctgtgaggtgcatatatcagtggctaggaaaatatctgaggcctgctacatcatggtttagtgaataatttgcattttatgatgtatatacagtgtagctatgaataatctgccagaaattatagctatacatatataagccatacactcactaatggtaacccattctccttatttttgaacccattctcggtaccagtaatagagagctcactggctttgatttgaggcagacctaggtttgaatcctagctctaatatgtacaggttgaatctcagggaaagaattcatctttctcagctttagtttcttcatctgtgaaatggagataataccaacttcataggcctattgaaggcatttaatgtgttgattatatgcatgaagactgatttgttaacaaacagatgatttcatgtgtgtgtgcatgagttgggtgcagccttaataagtgttccccttctcttctgttttgctatttaatgtgatggtgaggagagtggtcagtgtttgtctgtctcttccttctagaagttagggtggcataagatgaggatatgggggacagcagcctcagggagatactgaataacctctgggagcctaggaggacagatgcttgacactagctggggacaaaaaaggaagagcccaaacagtttttaaagcagaatcttctgtgtctagaagaatcaataggaaggtgcatcatcaaaagaactagagaacacaaatgacagggtatgacatgagtgttcactttcattaagtaaacactgctggggtttacttaatacctggtgagagggaaaaaaagcagtattactccacaaacatttgttaaaatatcaactatgtgagcaagccatacaatggagaggcaatgattcctaagacataacccctgcacacaatgattcctgacataacccctgcacacagtgagttcttagtcacaggggaagcacacacagacacaagagggctgtgattaatcctatatgaaaggacaacatgccatggagcacagaggaggaagtagttacttctaagaagaccaaagacattttcaaagaggtgaggatattttaagcgaggtcttagaggacgctgttcacagggaagaggagatgtaaaagcattctaggccaatgcacctgcatgagaggagtgggatacggtgtgagcaatgcttggagaattgcagctatttggatactgctgggacataatgacctcggcagccaggaattgtggttacattgcagggggccttgaggctagagagagagaactgattgagcttgaggagggagagtgggaagggacccagagcacagatggagttattggctttggagataaaaagggacacatgtttctctgagtaggtgagtctgggtgttacttggataagtctagagaagaagagacagtacgttctaacagaacatgccttgttaccttcatgctctcggtgtagtgggaggcaatgtcactggttgaataaatatgaataaatgaatgaatgaataaatgaatgaaggtggctagggtagaggattaagaagcattaaaatgaatatttcaagaactatttatgggggtcagtaaatataatatttctaaactcaaaacttctaaactcaaggtatttataagctagttgaagatgtaaagacatcatacatcttttcaaagcacaggaagttaaatgaatggttcctaaaatatgaatgttcagagggaaaagtacgtttattaactgcttgacaaagaagtatgtagctatattttgtgtaacacactatggtgtagtcttatctttttgggtatgtttttctttcttaatgttaaaatatttcatagctggtccatgtaactatagttatacttttagttttactcaggttcccgataatgtttgtcgcacagacaggtttgtgtactggttttaataattccattgtactttctacctcctcctccgcccccatccccagggtcttcaggtcacagttgggacctactctatgtactctggtgctctccataagcaaatgggatgatttctctgaaaagacagctctagattatagtcctgaaaaagagagctcttgagtcaatgaaaaaatcatagtttagagtagaagagaaaggtaagtatgttcagaggaaaagctggtcagatgaatgtaagagaggcttcttttatttgttcatttaattttgagacagtgtcttgctctgtcagccaggcttcagcgaagtgctgagatcatggctcactgttgccttgacctcctgggctcagccattctcccacctctgcctcccgagtagctaggaccacaggcccatgctaccatgcctggctgtttgtattttttgtagagatggggtttcgtcatgttgcccaggctggtcttgaattcctgggctcaagtgatccgctcgcctcagcttcccaaagtgttgggactacaggagtgagccaccatgcccagtctcaagaggaaattcttttagcagagctttgagagataggtatggaagaacaggctggggttagagtatatgttgctaaggaatctgaccctcactccatgggcaataaggagccatggagcagggatagaacacttctctggcactactggaagctgtgatgtccaatgtatgctctctggaagatctaactaaacacaaccttagcacttctctcaattttctttgaaaaggcaaatcttgtgagtcatttgttctctgtaaaatgagagaggaacatacattatcaccttatattatcgatttacattaagaagacttccggattctcttagggttgttgtgtctttctaagatttcaggcaggtgggtaaatccttattttcatggattttctattggctaaaggaacgctgtgtgtagtttgttggaatatactttgtagaagacattcttgcccttgtgaaccagtttgattcccgaatcacacaagtgctgggttccagaagagattttggatataacgccaggatttctgaccctacagctaagaataggcagcaataggaactcaagttacaaaaaatgacttcaatagagcattcacatatgtgatggtatcagagcccaagtcttcaaagagaaatattttgaaacttctccctggtttctggcaagagcagcaaatcttgatttttcaggcctttataaaaataagaaaagactaacaattttaaacctgggcattaatcaaccatttaatgatgccaacaaatgagttttactgtaattcagtgcggggagattaaaggaaacctaagagccacaaataagccattatgaacagtttacagtgattgagtacataagctgtgattaataatgatcagaagtaaatctatgaataacaacaaacagaaaggacttgttagattgagaattttatcagaaaggtataatttggatgttgactcagtggtaacaacaggaaaaataaattacctttatgcattttagtttatgaaaatcaaatagataatatatgaaacaacatttaaatcgatacagcccaggagatataaaagtataggtttgtgtggtcttctaattaactgacatttacacatttttcttaagatcactgtaagcaaaatgggaaagctctctaaatttttggccttttgggagggaggcttttcagtcttgctcatatttgagtcaatacactgatgtcttgacttgcgaaaaaattttcacatccctgttttgggctctcatattttctttattacacaggaaaaaaactttattgcacagacaaacagaagttaaattgaattgattttataagctgcaataagtacagctcccagaaacaaatgcaaatggaatgaacagttcttaccatatgtttcacataggctactcacgttttctctcgttccgagatgatttcaaaaaacctgttctgttaatgtatgtatgaaattctgcaatcttaaagatttaaaaacctatatgttttcaaagacctgaatatcctgatacacatcctttcacacctggatgccaaacacatacactgaaatatattctatgaacaaaggaatttgaaagggaccacaaatttcgcattgcatgctgaagctgtcctgtgtcagctcttcaaactggggcctctgaattttaggaaaaagtgctattattctggttcagtaagtttgaccctttgttgtctatctctgctccttagagacacaagcaggccttgtgcttactaagtgaatattaatatcttcattaaaccttgatagacaagcacactacagccctcatccaaaatatgcacaaaattagaaggcaaaaataaaaaaagagccagacattataagcccgtcaatggaagcagagagccacaccattaatggtggattgaaaaagactctgtgttgttcacctcccacgtataaatgagaacacacggtgtttggttttctgttactgtgttagtttgctgaggatactggtttccagctccatccatggacacagggaggggaacaacacacactggggcctgtcaggggtcagggggagggagagcatcaggataaacagctaatgcatgttgggcttaataactaggtgacaggttgacaggtgcagcaaaccaacatggcacacgtttacctatgtaacaaatctgcaagtccggtacgggtatcctggaacttaaactaaaattaaaaaaaagaaaaagacttcctcagttttttctctaatggcctgaagcaaaaattactctcatttcctcttcattgatataatttgtttttgagaggtgaggggacaatgggaagagagtggttttaagtcactataaaaagattattgacagatgcgtggtaaaatgaaagactcaaaaattcctgaccctttctcccctccagagttaggtaggcgggaaggaccccaaacttccatacaagagtctcttaaggtaaaattaagacagcttccccttcggagtttatgctagtatttcataattttccagccaagagctggaaattatgaaatagttgcataaactctgttaatatagatggatcaggctccaatcttgattttgccatttctcatatcatttttctagggctgagggggcgcacttcttggagtccagtttctgatataaagagaaaagccatttagtgtcttggaaaaaaacaaaagaaggaaggaagggtgttgttgatttaatagatcacccttattgttctaatggctccagatggctctcctactgtgtggatgagatttgacagtgccttcttggggagaaacagaagacttcactagcttcgctcagcaaatgaccactgattgcctggaatggaggagttaatgtgatcaattaacaatgtttgaagaaaaatgatgtttgccagctgttgatttcatcagcaagaaaaagcccacaataatcatcttagaaaagaacttaattagttttgatcctaagatagcatgcaaaagttctggactaatttctagtctgaagatattcataacatattagagctggcatgaactctggtgattactagaaaaaaagatttttaagtttgtgaaaacagagatgtgctcaaggtcacccacagttaacagaaaaactggggctgaatcctggggcttctgagctctgatatgctgctttttcccaccacaaatcacagtttttgagattcacactttgaaaagaatgatccaaagtaacactgccattttggggtgagtgttctcttatgacagatgagtttttttttaccttcctgtttccatatgtttaaaatgctattagtatttcaaacctcattttctttctttttaaaaattcagccatgattttagagtgacagatttgccatatcaatttctaaaggtaagtgtttgggtcagtttgctttttctctaaattgtgtttgtcatccctcagtgtagtaagattttggtgtggttatgctgacattaaagtttccttttcttaaaataaaactaatgacttgaccttgatattgtataagagtacaggccctagggtcagtcatcctgggttcagaacccagcctaccacttctcagccatgtattgcgggagagttatttatggttccctacatttcagttctctcatctataaaatgggaacagtaataatcccattctcaaagggttgtttgtgtgagaattaaatgagctgatctatgcaaagtacttacacagtgactggaacatagtgaacactcaatgtagctaacagttattattattattactagaaaaaaattgaaaaataattttatgtaattgttacttacatgagtagcggggtctcagcttcccaacacaccatgagaatatgaaatttcatcaataaattcaaatagacactttatgtaaaaccctttgctcaaataatgtaacttagcaatgactgacttttagatactggggaaatgcattcatatgaaccagtgcgacattctgaaaactggttcattgaatcccaataatataggttcttactctcaagtaggaatcaataatgcacatcccctctgtacccacatgccccataaaaaagctgttcaggacaatcttgctttatatattatacacattcagggcacatttagagttctgaaatttgaggtgcaaagtaagcattttgatagggatatttttccaaagaatgtttttggccccagcataaaatgaaaaatctctaccacagacagttgcatttcatggtccaatatagtctctgcatgaaaaccaacagatcattctacatgtctcctgacacatttacaacaggcactctgtgtaaaacccattcgcatcactgggggttctcaccaattcttaggcccttgacttatttgtgactgggatacctttatcacaaagacatgctttacagatattttcacggacacaagctattccagtcttgtcctgcataattaagtttttacattcagtaagtagagttcacctcttcctcctaatggtaagtgtttattaaccataatgactaataaagaggttctggcctccgtcacctgagaagaacaaaacagtggggtttttctgcagctcggctggatcccagcttctatgacctctgctgctaacaggctctccacaggcaatgaatgggagacgccagctatgcaaattagagtactgatgttccttgtcagctgcaaagcccaaatggccctgaaggtgacccaagtgaggcttctgtgctgtgtgcctggttaggtggagaccctgattagtctgattatggcaacaaattttttaattgctttatggggtgcatgaaaattatatgtttatctccttttattgaataaagtgtgttggttgtatatgttcaatgttggtagggaggaaggtattcttatatataaagagaaaatctgttactctttatgtcagatcagttgatagatattaaacaaatcatgttgttttctcatattgagtatagatcactaatgaccagctggaacagaagtaaacttgtacattagccagtaatgaacaaaatgctaaagatataactagagaaattctagaggtaaggaaatagtccacatatattaatacattttttcccacagtcatcttggtagaaagttgaccgtgatgtcgatgatataactgggtcagacaaataccttttaatagtctgtattacttacacacgcatacgtggcaacagatttaccttagacataaacacgagtttatattcctggaggtgtcctagaagcatgctgactgttgtgtcctcagtattattcacttcaataaccgtaagagctggcgttctctccaagactctgttccttgaaggaaggaactatctactgttcccctagtaagacctggcctacaataggtgtctgtgatgctttttttttttttcatttttaaatgtccattttgtttattgatacataatatttgtgcatacttatggtacgtgtgatattttgatacatgtatagaatttgtaacaatcaagtttagaatatccatcacctcaaacatttatcatttctctgtgttgagaacatttcaagtcttctcctctagctattttgaaatatacaatatactgttgttaactacacagtagtcaccctactgggctaagggatggttaatgtgtctactcagctagatcacagtgcccagatatgtgatcaaacattattccagatgtttctgtgaggatgtttttggatgagactgctgttcacactggtagattttgagtgaagtagattactcttcctaatgtgggtgggcctcatccaatcaggtgaaggcctgagtagaacaaaggactgacctcccgcaagcaggagggaactctgccagcaggcagcctttgggatcaaactgcagattctggacttgccagcctccataactgcatgggccaattccttaaaacatacctttctatgtatgtatacttacatcctagtggttctgtttctctggagaaccctaatactgtgtccagtaaaaatctgttgtctgatgaaggaaagataattgcctgcctctttccatcccttcaacactcaccctgactctcagaacacacgctgtttggcctcatcctaatctccattccctcagtttctctgttacatccctgccatttatcccatttatgatatccctccttccttaggcaggataaacttgaagatactgttttcatcttcagcatactacctcctttgtctttcctctgctcgccttgtaaatcttcaacatctaatcaaatcatgtgccttctctaacctcactgttgttttctgctggagagaagccctgccaccagccagtacatattcataatggttgactgtatgtggctgggccctcagaccgctcagaacaccttttcatggtccttagtcagcccctactctctaccaccccaaatctttcttgctattcctctggtctcccatttctatcttcagactctcgatcttattgcctgacaaatgtttcaagcagaactcatcaccttccccacttcttgttcctcttgcttagtccctgttgtgataaattatgtccctcccctccccattcatctgcccaagctggaagaaaatttggcatcatccatgcctcttctttcatcttcaattccatcacccatccagttatttaacaagcgttagctgagtggctattatgttcctggcattattctagagcttgggatataagagtggacaaagtaaaacaaaaacactcctgccctcatggagcttatattctagcaggggagaaggatcatgaacataagaataattaaatttacagagtatattagaaagtgaataaacgagacagggaaaaatagagcatgaaaagggtgataagaatcgacgtgtgtgttggtggggaggtggagtgtgcagtgttaaacatggtggtcaggatatgcttcaatgagaagatggcactggagccaagacttgaggtgagggagggactcacacagatatctggggacaaatcactttgggtcaaggcaatagctggtatagagggcctgtcttaatccatttgggctgctataacaaaatgccattggctgggtagcttcaaaacaacaaaaatttatttctcacagttctggaggctgggaagtccaagatcaagatgctggcagattcggtatctggtgagggcatgcttcctaatagatggccgtcttctcactgtaacctcacgtgcaagtgttagaaaagttgggggagcctgagggtgtctctaggttgttgttgttcttgttaaggtactaagcccctcccaaaggccccacctcctaataccatcactttaggagttaggatttcaatatataaattctggggagacacaaacgttcatatctaaagcaaggccctaaagagggcctttttgagcgaagtaggccctaaagcaagagtgtccctggcatgttgctcgagcagtcacagcacttctgcgaatcttcagttacagcactcctgtgaatctccaactgtccatctcactgctactacctcaatctaggctctgggccttctcacctaaattaatatactgatttcctaagtggttttcttatatctggtcttgctgcatgcccacctacttcccacaccgagctagaatgacctttcaaaaacacagatgtcacctcatcagaattcttccatggctccccactgcccacaggctgacatgtgcacattgggagggcttagccctctcccacctggctccagcccactgctgcaatatcacaatatcacctcgcccatccttgacgcttatccagaggtctgtacataagattctctaaatgcaccaagttccctctggacccttcacctttgggacactgcttcctcctcataaaacacctatctcttttgctacccattgcaaccctcctcgtgctagaaagcatggcctggtcagctcagtctcatttccctttccctatacaacattgcttcctgcagaaagttcctcctgcccttcctctctctggcttaggtaccctccactatgcttccacaagagtgtggctatctctactgcagcaatttcatactgtatcttcacagtctctttattttttgggctcccctagtaggttttgaatatgggcaaggatcatgctttttaaatatcccagcacttggagccttacttgatacataaggagatactacataagttttggtcaaatgaataaacaaatacacaaataagccccatgtggaaaggtgaggattatatagatgcataaatagggaaaaactatatgcagaaactgtacatagcttcctctaaaaaggaatttcttatggaagcagaatctgtaaccatgaggcagccacccagaggagtagagtaatgatttgtgctgctccagtgactatgggttaggatgagtttccaggtcaactggattactctgatccctctttagagccattgcaagaaatcacatctcaaggaaagactcttctggcacctaatctcttttgtactttagtccagacagtgcgaggccatcttcaaataaaacaatctctttggcttcacagacaagaaaaatgtaatctatttcctacacgtgacaacaagagaaaatctaaaatggcacaaaaatgtaatggtaatatcctacagagaggaaagagctgaatcaaaatgaaatatgaccaaatgcaatcagcagctaacagcaggaaaaaggcagctgtcatcttcatttctttcataaacttcttagaacaaattatgtcttttagaatgtaagtcagtttgtcgggcgcagtggctcacgcctgtagtcccagcactttgggaggctgaggcgggcagatcacgagatcaggagatcaagaccatcctggcttcatcctggtgaaaccccgtctctactaaaaatacagaaaattagtggggtgtggtggcgggcacctgtagtcccagctacttgggaggctgaggcaggagaatggtgtggacccgggaggaggagcttgcagtgagccgagatcgcaccactacgctccagcctggcaacagagcaagactccatctcaaaaaaaaaaaaaaagaatataagtcagttttctttctggatactacttcgtaaagcttctgccgtttatgggaggtaaagcattctctgcatcacccaacttcgaagctggcctgcatttgcttagacatttcattcatgaaagcctgccctctcttagcagaggagcgatctaaacaccacagtcccaaacacctccatctgactgtctcctctgtttgtctatcaaaccactgattaaaacacattctgcattgattgattaataaacaggtttcagcagctctggacactcagagtctagaaggagaaaagtctagactcaaatagataaaaacccgtaattcaaggcagaacacaccctgggcccgagggggctggaggagaggtgccaagtgtgggctgcgcatggaacgggaacactggtgttaggtgtgggctgcttggaacgtcccaggagtagcttgcctcatgttgcagactaggaatccagctgtctggaggtggaagaatccatggatggtgcatattgcagagacacggtttcaaaatcttttgcaggatgcacatgttagaaaagagatcttaaaaaataaaaaatcctctaatggctttaaatgagcatgaagcattcagatgttaatgtttagctgtgtagacaaggtgtttcccaagttatctcaaaggttgatgacatgacgaattgccccctttaaagaaaataccaaatacacgaacaacaaacttccccgaatgtgttgactatcttttggaatgaagagaaaatctgggtcgagttgaaatcaccaaaagtcaatccacaaagtggaatgacattgctaacacacttagcatgagacctgaccccatctgattattgctcagcaaatgggggctgtcctgattgattactatttgtccagtctctcaccagctgagctctttcctctgttcctaaaataaagggtagggtgggggactttgtgccagataactaatctttactcagtaccttttctgtttcaggcattctgttagcagcttgatgtactgttctcatctatctcctcaagagtcctttgagagatatattttataactgttttgtagaaaaaaaccacgaaggatctggagatgttaggtgtatccaagggcacaagatgattgggaaggagtgaagatatggatgccagagcctgaaaacactccatgtgtcccatggtagcttgttctttggccaagtagcccttgcacacccccgccttgtcttgagacatgtcaccaaagacactcaaaccataagctccatgaggaaggaattttttattttcaccattaattataccccagttccttccacagtgcttgatgcatgcttggtattcaatacatatttattaagaagtgaatagacccaaggcctgggatgaagtttctgtctccaccaccactttccacccattcaagagtgagctgctcccctacgaggactgggcacgagtcaaaacactcctgggaaggatgaagtcttttggggagttcaagaactcctgagtccggacaagacttgtgccaacctgggtgacaaaggaactgtgagaccctggatggagttacaacccgaagatatgcctgaggcctgtcattcagcacttaattcctttttctggtgaaaattaaagtaactaaaatcctggaaccctagaggcttccagaattgtaacaactgtcttcagtagccatcaatctaattacatttttgcaatattctcattttgagctacaaaggtacaaattacacaaaattgtgtgtggaatgcatacatatgtatgtgtgtgtatgtgtgtatatatatgtatatatataaacgttaacatttagatgttaatgtttagccatgtagacaaggtatttcccaaattatctcaaaggttaatgacataattgtcccctttaaaaaaatactgaaaacatgaaaaacaaacttccctgaatgtgagcctcactttgttctgtacaatggagataataaaaccttctgtttcacatgaagagtacatgatggaatatggcaaaatgtcctgaaaaccagaaagtagtcttgtcaatagccaagatctgcctgactttttcacttggggtgcagtagttaagagggaatgtgctggagcccagctctggcatggccactagcaggtttgggagagcctgtgcttcagttgctttacctgtaacagggagatggaaatgtacccagctcctggaattgtttgaaagattcaatgtgaattcaatgatataacacatctaaagcacttagaagagcccagcacatgaacaatgcttaaacaaatgtttgctgtgattattactgtgctttcgggatcactgtgcaaatgacgattctggtcagctatgcattcccagagcagtggaagggttcactagcagctatcttcagtaatacactgcagtgaggggtagtcagatccaggcccacaatccaataaaggtggttggtcccagaagttattttgccagataggcagaaatcaaattgaagagaagagctttggggagcatgtgttctttacttccttttcctccctccctcacccttttcttttctttgctatttaaataaaccaccactttcaggcctgcctgggagaagatattagggcagcagggagtccagctgggagatgatgaggaaagcagctgagcccctgctattccacctcatccactccatcctccccaattaactggtaacgaggtggtgacgccctaaccacatttcacttcctgctaacaaagcttgtacaacaaatgcaaacacttggctgtcagcttctgtccagcacacagcctcgttatccatctcacccttctgcatctatgtcagcatccaggaggcaggcccaggacgacaaaccttctttgtgctacactcaatgccgtaccaggctctgatggtgcttacaaaatgcctttgcccgacagtaacaagaaaggtcccttatagatgattttgtaagaggagacatattctgtgcaggcttgtgtcattcctctgattattcagactgggagtaggggcagggaaggtgccaccatttcatttcttcctttctcatctgataaaaatttcttcccacctctttgaattgaggtcaggtctttttcccttttctaaatttgcctcaaagaagtctttttcatttttccttaagaatgactttaatggtctacattttaacctcttcctcatgtaatgtaagtgatctgcaaactttcttatatcttattccttttgaatttcaaattcctttttttctaaatcaatcccattatggcaagacattattactttctgctcacataaatactatcatccataattttctctcttccctcataaagcatgatttatgttgatatttaaaagtaaattctgatatttagtctaagtactgtcttacatattaattcaataacataatttctacgatagaaaagtacataagagtacaaaatatgaaataagcttgatatagacatagttatctgcatttgaccagtgaggaaacaaaagctcagaaaaattagataccttgcacaaatcacaaagaaatcagtggttcagctgaaaattagaaccaacatcttctgatgattacacaacttttctggttgactaccaaagaagatactagaaaaattactaatgagtgaaaataaaaagacatttcaaagtctttcatatttaacacaaaattatttttccatagaagatattcaagaagcagttacacatttgaggagctgtttttttttaattaaaaaaaccatattctttatctacatctagataatgtagattgatgatccatctaaatcaagaatttatcttctacagtgggaacaaattactggaatttaagcaacgtgaaatctcatcactttagcaatgacaatgaatgtgatgtagctttcaatgcagtactgaaaaagcttgtacactgtcacatgtcccaggcccttaggaacaaagtttagtatgcaatgagtgacgagctctataatattttcattcgaaacagagctacacaggaaatctaggatgtttataataatatttggaatatttggtataaatgtaaaacattgtaatagttttctgggcagataagagctcatcatatatccttttagttaagtcaagtgactctggagtccagttataccattagttcaaacactaccaaagactaaatacaagctcttacaggctgaattgcatctccccaaattcatatgttgaagccctaattcccaatacctatgaatgagactgtagttgaagacagggctttaaaagagctaattaatggctgggcatggtagctcacgcttgtaagcccagcactttgggaggccgaggagggcagattgcttgaggtcaggagtttgagaccagcctgggcaatacagtgaaaccctgtctctactaaaaatacaaaaattagctgggcatggtggcgtgtgcctgtaatctcagctactcgggacgctaaggcaggagaatcacttgagtccacgagttggaggttgcagtgagctgagattgtgccgctgcactccagtctgggtaacagagctagaacctatctcaaaaaaataaaaaagagagctaattaagttaacatgggggcattagggtaagccctaatcccataaaactggtgtcctattgagattaaaacacagacattacagagggttgaccttgtgagggtaaagtgaaaagggggccatcgccaagctaaggagagaggtctcagaagagacaaccgtgctgataccttgatcagctgacaccttgctgataccttgatcagggttctggaggcaggacttccagcctccagaactgtgagacaataaattacttctgttttagtcactgtggtactttgttatggaagccctagcaaaactaatgcacttaacaaacttaacacctactttcttcctccagcctctgtgcctgtgtttcatgccaacttttagtttctccttgatctgccagtaatacaaagatgagaaggtctggaaggaggatttaggataagctgagaggatccatcttgtaagactatactttcctatgaaatgctgtttcctccttgttgcctggaaaactcatcctcaatcttctagacctacagttgggttattcttcttcagaaccttaatctcttcaaggtggtgcctctgctacaccctataaacccacctctggcacagcacatatcacaccatgttagaattgcttccattggcaactccttcctgatcttgtgaatgatttgtgctgctccagtcactattaggatgagtttccaggtcaacctcctgttttgaaaggagggacttacctttgtggtcatgtatttgacacctaagacttactcgttaagtgtttgttgaatgaatgaatgaaataaaatgatctccattcctattcaaataagcctgtaaataacagtttaagcatggtcatatttgtttgttgagaaagagaagtattaagtgatataaggtttaaaaaagcaataaaatctgcaaaaagaaaagtgtctattgatgaatttattaacaggaaagaaagtaatcgaggataagaagatggaaaaggtggaagaagagaccttgacaacctgaaaaggttatacccttgtgcagatgtggtggacaaatcctcacctgagaggaggaatcaaaggggcaactgctctgaaaccggccctagagcatccaacctaaaaacaatgccttcatcatgaagttccagaaccaatgattcaaaggataccccactgaaaaaagacagtcgtcgtcctagaggtaaaaatcactttacttgccaataaacagaaacatgagcaaatgggaaataagcaaaaatgaaatgatgtgtgtgctctcttccaaagggcagcaaaagcagctgagttaatgctaatggctcacatatggtgggtggggggaaaggatgttataagtcacaaaaccctggaatggagcagaggcctgtcggcaagttaggtggtgatgatggagtcaggatgacttggaaacactgtgaaaagatggcttcagataatgggccattatctgtctgcctcttttcactttgactactgtcctctataaataatgtagctggctaatctaaaacatacagaatcaataggaagccaaatatttaggtaccacaaaatgaggcaaaaaaagagcccagattttcaaacaatgcaagtgaccctgaaaattgtaacttggcaagtctgcaatattgtgagagcaataacaatctgttaacatctagagggaataaacccaaaagaaataagaagccgagctttatgaagggaaaaaaaaaatggcacgccaaatttgattgcttttctgatggaattacaggattactagtttaagggagtggagcagatgtgatatatttgaattttattagggcatttgggagaacgtctcacacaatttccttcacaaaactaagtgactttagcttgaacatgaactgaggagataataaatgaagggtaataatacgttacagtcaatctcatcgggaggaaggtgtttaagaggtgacactaaggctcctgttgtttggggtggatagaacattgattttaatgatctgtaaaaaaggaagaataagagtgacagagaggaaacatggagatttattggacaaaaagactaggaacctggttaaaaatacctgaatatagggaaaatgcaagctaacaaatatatctgtatgtttagaaaagtaaatatatttggaaaaatatttgcagaaatgcacacatgaaaggagaaaaatgagaaattaataacactgaaaagtacacaggagaagctccttgtaataaacttgaactgcaatacagatataaaataagagatcttaataacttatactgtcataacaatgacacacatagcttgccccaaagtaaattttaggttcaaaaagctaattttactcctctttgaattgtatcattataaattttaaccttcaagtttagcaataaaatgacttaaacagtttaaacaaaagtgtaacttcctataatgacagcagcatccatcgaaatactgtaccatctgtggactagaaactacccttcttcatcctagactttgccctcttattcatctccactgaatcacaaatcttagacaattctgcctccttgcctctctttgggacctatccttgctccttgttccatagatgctaatttggttccagccctcattctttcttaccagcattattaccagagcccagtattgcagtatcacatctgctctctgtgctgtcagaacaatctttctggaaagctgaccatgtaaattctccctgtttaaaaacctccagtggctccccatgccctataagacaggcctaggcatagtgttcaagcccttgaggatctggtcccttctgatctctttagctccttctctttccaactctctcctccctttccacactctggcctgaagcccttccagttctcggcagctctgttgtctgtttgcctgtctacccctccttgcttcctccttcaggatgccatgcagatgccatattttgaaggaagccttcctggtttctttctttccactcttgtttctttagtttgtttatcatgcaattttttctactctatctataaatggtgggaggcaggggctgttttaatcctctatgttgctagcctgggacacacagtaggcccgtatgtacatgctgaataaatggacccaaaccaccaatataatcagggactgtgtctactggtaaggcaggcctgggtttgtgataaaaagtgcattggttttgtgggcagcatagtggaggcagaaataacctctaaaaggactacagtgatgacacaactgacacactgctgtaacaagccagggggtaactggggtgtgcacctgttggccggtggctcttgaattcagtcttcctcattcatctggcctacaaaataccatagtttagatcagaccctgcaggaaccataacaaaaactgaaggacaggctggtctttaagtacaacttagcagagcatgacaaatgcagattgaaccaaagtgacccttcccacctacaaatatagtcatactacacctctgcttaaagtcccttcaatggcttcccattgctaggaggctgatgtctaacagcctcatgtctctcctcttcctcacactcactcatattacattaccactggttgccacaggcaccacatgtgggatgctcccatgccttcatccgtgctgtttcctgtaactgctggaagtgccctttaccctcaaccctttctcaggtttcctggtgaattcctgatcatccttgaagtcatctcaagtatgaccttctctgagaagtctcccacaacctttctaggtagagctgagcatgcctactcagtgtcgccaatgcaccttgtaatctatcaattaatgtaattgaacagattacaaagtgcattggtgtctgttacatgcttgctcctgtcccacgttatgggccttacacgtctttgtattctgggattctagcaccatacctggcccagatcaaggactcaaattatgtgttgaattgaatttgttgaattcacatgaaagacaatacttatccaaagcctgaatggctaaagtggttatctttgggtttcttttgacaataggaagcatcatcagaatggactaaaatgatcaagaatgtgcagaaggacctccataatcagtaactatagagataccaaactttttagttacataaattgaagacaagagcaattacagaagattatatttaatggccttcaggtacaggtagaaatcacatgatattttagactgctttctttaaaaatgcatcaaagcactgtgaaaagccaaaaacatccttttggaagcagcattttataccaggtatttaaatctattttcactgtgagtttattcagagtaattgtataataaagaaaagcacttggcttcaggtcactatgcatatatagctaaattatgcaattagatgacatgtaattaaccagagtagcaacacagccaatctaatggggccagttggggtctgagtgactcataaaaacattatgtagttaagcgataggcacctacaagaacaatgaattttggtctacctgcagcctaatgagtccctcctgtgactaaagaggtaatgcaaagagaggtctcagagacagggcagtgtcaatggaaattctgtctaagaaggagccaaggtatcatcttgattcttattttccaaaacttctaatgagataagaaatctctccaaacgtactgctgccaacattaccagcttgactcttccattaccacaaataataaacaaaaaacattagttaaagcttattttgaatgaacttgaagaaatacttcctgacccattactcaggtagtatatacaacagattgactattcagtaagtgaaaactaacggcggaagaaatccaaattagctttcttccttttccttcaaggatgtatacatggcaagcatgcatgaattaacacagttatgaacaagaaatattatctcttgtgtaaagatcaaggtttactgtctcattgtgtttggttttgggaacgtagttttgattttgtttgcttaagagatggaagaattccagttctgaaagaattcaagctatgaacaggaaagtatacttcaataattgtcccagtgacccttatttttattaagaagaatctagcaactgtcatacttgctaatgtggcaataattcttctaatcttaaatttttaagtaaggaaaaaatgaatatgtagccatttaatcacaaactcatcctctatttcccaacaccacttattccatatatatatttactgaatataaatatactaggcctcagtggaaacacgaaggatgtgcaagactcagtacctgcctttaaatagcttacaatctactagaggaatgaaatctgtcgcccactcttttattttcttcttcgaaatggtttgagtatatacagtatactctaaaggtttaattaaaatggaatatataaaaatctgaaaggatacatactaaaatgtaatctgaaagaggggtagcaaattattctttttgctctctacattttctaattttttttttccctaatgaggacgtactacttgtgtaaaaaggagaagaaagttattttatgaaagatgaaaaaaaaaaaaacacctcactctggttagcctgatattttgtccttttgaacacttaaaaggccccattaccaggcagaggttgcaatgagctgagatggttccactgcactccagcctgggtgacagaatgagaccctgtctcaaaacaaacaaacaaacaaacaaacaaacaaaatgccccattgcctaaactctgaaaaagtcaatacggggttgttgacaaaatctattattactgcccatctggtgatctgctgctcccctaccagtgaggaagcttcttgaggtcggggactctgtcttgtttgctattttgtttgttcaattcctaacagggatcagaggacaccatagataggtaataaacgtgtggggaagatgggaggacaggagagcaggaagagagcagggaaagctgaaggtacacacacttctgaggcttttgttaaaattaagtatttaatgcgatcactttggggaaaccacattgattaaactgacgggaggcatgaaaatgacataattgatacaaccgataattttattcttcaacaaaatctactattggccagagtgcccctttgagagataatggttcatatcagggagcaatttgctttcaccccttgcatacaaagcgggtttcaaaacctatgtagtttcggaacaaaagaaaaactgtaatgtcttaatttttaagcttttttcaatgcagagactctaacaaagcagatctaatgaacagggcatcatattgcatactgtctgtgtgattggcgccttctggagttgtgcagaagacaacctgtgaggccatatttagccactctgggcttgcttcaggctttaagttcttgttgttaaacttaatttttcagatccatgtggtttggaagcattgtgcttatgcctaactttggtgatgtattgacctttgtggaccaaggatgaaagctggcatgaaataagtacaggaaacttcataaaataacagccagcattaattgagcacctacaaactgtcagagggctatccatctatgtgtctatctaatatttagtcttcagaataactgtgcaaggtagatatcatcaccattttacagatgagcaaaataagtcttagaaaggtttagtttagtaattttcccaaaagcacacacagctaataagtcatagagtgaggatgtaattttaggtctgatcagcaacctcaatatgtcattcatcctcgcctttcctctgaagaaaagcagcagcttgtcttatgtattttaataacactggcatgttataaaaagttaacctttttgttttgcagttcctcatttttctttatgtatttctcttgcttcttgttttttttcccctctcctccaatatcaattcctattcctcttacgtttttgtggcatttgagaaaccttcgttgaaaattctttgacagtgtctgcaagtcttctgagacaaagtgccacaaagataatgtttaaataaaataccacatagtacagataattatatttaggctttcagtcaccctgaatattggacaaataaattctcttggaatcttcatattgatgtacataggacacacacacatgcacacatatgattagaataattttttccaaccagaaatgacatttgcttttgaaatgattaaatattaccctcaccatcagccaagatttccatgacacttgaataaacaaaaaaggagttgattactgagattctttgtttttcctcttcctttgcacagtaggaaaagtaatgattaaaaaaagtataaaacacatattaatgatacaaaacagaactatctccaatgctttgaagaatgtattcttcatatccactagggtgctaaccttcggaaagctacaaaatcaatcctgaaagttttatctcccatggcgacagagcccttttttaagtcagtaaatactaaaagtgatacaataacagctcatatttaggattaccaagtttctctacaggagacaggctcaggtatcaagaggaaaacaaatattcattaaaataatttagcaacaacaaaagacacgtgatgatgaaagtctgttcaaataacaagtgactaaaataagagtgctgataaaaaggaaggtagcactgatatggaactgggttttggtaacaatatgccaatcaggaataaaaatataaatcaaacttaactggaatgcataagtatacccagctttacaagatgggtaggtttctggccgggcacggtggctcatgcctgtaatcccagcactttgggaggccgaggcgggtggatcacaaggtcaggagatcgagaccatcctggctaacatggtgaaaccccatctctactaaaaatacaaaaaaagttagctgggcgtggtggcgggcgcctgtagtcccagctactcaggagactgaggcaggagaatggcgtgaacccggaaggcggagcttgcagtgagccgagatcgcgccactgcactccagcctgggcgacacagcgagactccgtctcaaaaaaataaaaataaataaaaataaaaaataaaacaacaacaacaacaacaacaagatgggtaggttcctaaaaagctttgtataaatacagttgctccccaacccccataattactggaaggagagagagaaagaccctaatgaaatcttgcagtaaattctaaattacaaaccgaaaaaaaattttgaatggcaaacagacactgctttaattccctgcttggaaagttttttttaaaaaaaattttttaatgaatgatgatttgaatagcagtatattttttaaaaattaggcaaacacgtatatcactgcaaataatatggaaaatagtatggaaagtggagaaaacccccaaagagctaatttccattttatatttggtatttaaatgccacattgataactgaacactgtagtataaataaattattgttaaactgtcttataaattgctcagtccttcagtccatagtcaataaaatataggccttgcctgtggtttactcaagactatagaaattcagagtaatcaatcattccaggtggcttttatagctttccaggtagcaagagctatattttattgaatgaggcatttaattagtgggtattattaaagtgcaattttccatattaaactgttttctatataaattggcttcctggtatgctgacttgtaatgacaggattatcttgcattcactcttgtagagacaggtaataactcatctttgtgcctgttttttgattccacagaatgttattctttctgctgtcatcaaaaaatagtttctgaacaaatattatccaagatttttcttatgctattgtcctataaactcaatattttaagactaacctgaatgctaatattatatattgtgatatttcttatgttataaaggaaattgtaccataatttctaattgtagactaatcgcagccattctaccacaaaaatgccatattcaacactttttcctattacagtataaaacaccatttgaccttttattttaaaaagactgtgacaaataaatactaatttaatgcataaagtctaataatgatctagatttaccagtgtaagtgacaggaggtaaattaatatggaataagtatatacttcacatgtttcttggcatatatgaagaagcactgaagcaaatgaatctatctcatgtaaggcaaatattatggaaaaactccagaatcagtagaaagagatatttttgccttttcttactatggaaattcactgttataatacttaaagctgcagatcttttctttaataataacttctgtttaaaaatctgtaacaagagataccattgctgattacataacattggtgacatactactgtgattttttcagttctgtaccaaaagacaagaaaaaaacaaaaaacaaacaaaacgataaattctgccaatgtttttaaacaagaatgtcttctacaccaagtgctactttcagatacagggctacagtgcttgaacaatcaccgtattagaaacaataagtgatacaaagagtaaaaacaattttcaaaaaaatcaaacttttataacatttacatagacaccaaagaggacaaaatatccatttccagaagatgtgcagtataattagtcagaaaggtatcgcaatgcttttgattatgatcagccagttgcaaagattatcaaataaacaatctagctattgctgctttgctagaaaaatgatcatcttagtggcaaagattaataactgctttttaaaaagacaaaaactagctttgtgatttactgtgtactttctcaagaatgcacagtaagtaaatcaacagtttgtttaatcactatcaatgtggcatgctttaatatattggatataaataattgtcactaaaaaatcatctgctgcatgttcagataaagctgtagagatctctgccttgttacctagcaactgggcaagtaactgccatactgcaaaaaaaaaaaaaaattccttattatttaggtaaagagaatgatcataaaactccacattaagatgttaatgaagccaaaatgtatattaagatacaacagctaacgattttagatgcatttatggccttggttttgaaataccatgcagtaatgaaaactgtaaagatttaaatctattatttcagcttgtcacaaacaacaacgttctttagagtgtatttttaaaagaccactgttattattaattttttatttgtactctttcacagacaaaggaatttcaaccagatcttctgtactgagtctatttattgaaagggtgatgcttacttgtttaaatacaataaaactgttctgagtaattagttcactgcaagggatcccaaattatttcttatatttcatataacagcttaatgtattaattttataacatctggaggaatctggcttaagttctgtttcaattttgctaaaaatctggattccaagattgtgcataaaatctctcttaaaaagcaataggggattagggcaattataaaatttcacttctgaggtccaaaattcagcatatggccagtcttcaggcctcaatctgaaagtaattctttctggtgtgtgatgaaggctgactggtcagagcccatatgacgatggtcacatgagagtaaggaaaccactcatcattgcaacaaacagagactgttttgtgaacagacagagctgtgcttgatgaaggcttcacaggaatccaaaccccatagcttacatggcattcctctgttgatttaatgtacgatgcttttattcatagtcacttacaatgcagggacacaattcaagaaagctcttcaaattattgcatggaattaagtttcttgataaaactttacaatttaagataaattatgctgaaaagttaaagggaaggttggctttacaaattaggagccgaaagcccagagagattgagtagttggaagttgtgcaacgatataacttcttataaaagtaaatatatataaagtgcatagaacagtgcttgccacaccagaaggattatatgtgtttgatattgttattttttattagtgtaattattattagaagtattggatctagaatctgttttttcgtttccagaacaatgttcttttcactaagcacattacctcaaaataaagcactgttttaagatgcaccatgtacatcttctatgagccaaagctgtattttaatgataaaggtgtgtattaaatgaagatgtatacgtagattcacattaaaagcagaaaaaattgagtcttcataactagtaatttatagttatttgtttaaaatcaaatctgtatcaccttcaaatatatatcatttacaggctaatagctaaacgcaagtcaaaatggtatcccaaaggaaacactttactagtgttagtgtatagaccaagatgtataaactttcccatctttaaatattttctctgagttacattttcactaattcatatcaaccattaacctgttatttttatttttataacattaactttacatacatataacctgatacgtttgtactgaaagatttcagacatttgttggattaagaaaagtttactctgagcctaaagagttcatacatatgtacttcttgatcttgattagtatatattcatcatatgcttctctgtatttacattctctctccctagctggtctcatctaggcacgtggctttagaaactatctatttgggggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagctgagattgcgccactgcagtccgcagtccgacctgggcgacagagcgagactccgtctcaaaaaaaaaaaaaaaaaaaagaaactatctatttggggagtctctcagatgtgtatctagcatcctgatctttcccctgagttccagactagtagacccaatgatctgcttgacaattccatgtggatgtcaagtttctcaaacttaaaataccacaaaaaaactcttgcttccttctttcactagtagcctaatctgttcatcatccactcagttgcacaggccccaaatttagaagtcattcataactcctccctttttctcatctttcacattaattcattagcaagatctctaggttccatctctaaaatatacattccagaatctgatttaagatggaaaatttaaactgcttcacagaacttcccttcctcaatatctaaccaaaggagaaaaaaagagtaaacattagtaaaatgaaaaaaagaagttccaacagtaaccactcaaggaaaggaacattaacaactataataaacttcaaaactggcagccaaggaaagagaagattctggaacaggctaaagagacacagtgttccttggttcttaaccctgtgttcaaccctagagaggtaaacaaaattctgagactttttgctaataattctaaatttagagaaaaacacattcagtgaacatccttatgtttccttttactactaaggagtaataggaacatgtgcaatgaaagaagaagatcaaagggctgattcaacagaagtgaacactccagggctgcccactattttggggaaacccatcaagccccagattatctcgaggatagctactagctcttatggaaccctttagttaattataaaaaggctatccttggtatctctccctccaccaccccccttgcccgccccgtcaatttggtgaaataaaggctgataatggagacatttaacacaagttaaggaagcacggcccaggaaatctaacaaagattgcatacagcttgagttgagctgagctgtctacctccctctgcaatttctttaggttgcagaaaagtggatagatccaagcaataaaacatagctcaaagaggaagcaaactggtctccaagaaggtgggaagaaatttaagaagttactcacactatgtctggggaaagctgcccaggcaccagcaagatgaaaagaaatagcacggcagatatgcaagcattctaagggagggaggcaggaggagggaaaagagaggaaggaaagagggagggagggagagagagagagcaacaaagtgaagaaaaaatataaaatgaaagtatcacagcatataggaactaaatctagaattttattcaaataaacagaaagaaatcctcacacaaacttcctactgtagaataacgagttcaatgaaaattgaagtttaaagacagaataatgaagaaatctgaatgagatgaaaaaggatattgtggacctaaggaagcaaattaaggactaaagatcataattttagaatcaataaacaaatcagaacatcagaagcagagtagacacttctgatagttgaattactgacacagaagaaaggacccaggtaccatgaatggagacacttctgatagttgaattactgacacagaagaaaggactcatgtaccatgaatggagatgaaaatgacaacagattttcatcaaatgataaactaatagatatggaagagatgaaagatgatccaaaataaggataagtgatgttcctgaagtaggtaacaatgtaagtagaataaaaggtgttttcaaagatatgatacagtatctgatctaaataacacatcatattgtggaaaattcttaagcagaccatccaacacctccacatatcttagctatgttattaagctatgtggataaagaaagaattccttgggataaaggcagaaaaaaaatcacctacaaagggtggcctcagactatacagagatattcaatgctattaaacaatgaagtaatagctgcaaaattataatggaaagaatacatgacataagaatacaacgttcggccatgatatattgttcgactacaaaagcaataggaagacgttctccaaaaaacaaaacaaaataaaacaaaacaaaaaactcacaaatgcagaatccatgggtctttctcgaaaaaaagaaacaaaaagcagttggcaatgaaatctaggcaattcagtgatgaatcaaagaactcagtcagaatgaagaagatatactaaagggctgggaggcaatggatccatttgaacataggaatttatactaaataaccatagtaattatgattacagaatagaaagtaaatattataaacacaggcaatataaattagttaaaattgttagctgaggagaggatgggcaaaagcattacctttcaaagcaaggaaccaatctgatgtgtttaaaactggaatatgcagcttaaaaatgtgattccaactctgaggtggatttactgttaacgctaaggaagcttaagttccaaggttttttatctacacaggtgatttgcgttttcccatgccctggaaggggtcacagcagtgcattcatattgtcatatttttgtaaaatttgtaaaaatactccattttcttaaagagggcccccaaattatataaccttcccacagaaatcttgatccactcctgatcaaacctcttaacatttttcatcgtattttttcttaaccataagggaaaataataactcccataataaggagacacttattggaagttcaacaattatttagtttttctttattttttttctgctgttaaatacaataaaaccattttttttttgagacagtctcactctgtctcccaggctggagtgtagtggtgcgatcttggctcactgcaacctctgtctcctgggttcatgagattctcatgcctcagcctcctgagtagttgggattacaggtgtgtgccaccacactcagctaatttttaaaaaatatttttagtagagacaggatttggccgtgttggccagactggtcttgaacttctggcctcaagctctccaccggcctcagcctcccaaagtgctaggattacgggcatgatccaccaataaaataaattttaataatttttatttaaaaatagcatcagcattatgactccacagttataaagtctttctttctatccgcacagtcatgtatcaatccctttgcacatatttatagaaagatgccttaaatgatataagtctactgctaaaggtggttatttctgggcagtggtatttggggtaattaaaaaatttaatctttgtattacatgcattgtctgaattatttattgtgatcatataacaaatatttcaaaaataatacaatgacttttttccttcaaatgccaagatagtaacagatattattttggatggtgagaactatagggaactgttattttgtactttgtattttcctgtgtttttaaaatttcaaaaatgttttccaaaatttgatattctgaatcattccacatctctccctttttcttcttccagccaagtcactattatttctcacctggactactctcatagtcttctgtgtggtcccacctgtgtccatcctagccctggtattacccagtctttacacagcagccagggtgtgctcctcaaatgtaaaaggatcacacctctgctttacattccccagctgcttcatattgtctttagaataaaacccaaactctttgccacgaccagcaaggctgacctgagctgaccgggattcagtcacgctggactgctctctgtcccccacacactgcacttgttccccctgacagatattccatgagctgttcccctagcctggggtgttctttctccagcatctccgtatagctggttccttctattcaggtctctgttggagggccaccttctcagggatacccccaaattttctaatttctccctccatctccctctccagtgcttcaccctgctggatggccttcatggcctttatcaccatctgaaatgatcttctccatttatttatttacttcctttgtatcaatcctctcccactaaatatctgctctagaaaactaggaccttgtctatcttgttcatcattatatctcctgctcaaagaatgtgcccagaagatagcagacacttaataaatatttctccactcaatggatacacacagagattgtttctcagcttaaaaaggcttgtgtttgcaaagctgtcttttaagtcagttgtttagaattcagaatgcatgttctttaaaatgagtcacagtacaaattcaatatcaagcctagctcacaaagtctactggacccataatgagttaaacttctgtatatctgcaacaaaaatgctagaaaatcaacatgatgaattatcactgggaaaataggaaattaaaaagaaacatttcaactgatctaaatatgaacaaactatgactattatttctctctcatattggtgaagacttttgtgaatattctgaagggaacgtcagaaccttttttattttttttttttttgagacagtgtttcactcctgttgcccaggctggagtacaatggcactatctcggctcactgcaacctccacctcccgggctcaagcgattctcctgcctcagcctcctgagtagctgagattacaggcacccgccaccacatccggttaatctttgtattttttgtacagactggtttcaccatgttgccaagactggtttcaaactccggggctcaagtgatccacctgcctcagcatctaaagtgctgggattataggcgtgagccaccacacttggcttcagggcatttttaagagctgcagaagtttctggttttttattgtgtataacttcatccaaaaatgtgtagcttttggctcctttgataacagaccattaaattagaataatgtttgtaactatgagttttattatctgtttttggttttagttaaagcttgggaatgacttgcacgtagttgtaactgcaacaggtggtatgttttgtgaatgcttacctgtcattacttgagtcactgtttgtgtcaaaaatgtaaaagaggaacgagtttctgggaggtattaggaagagaggggctcagaaggaaaggaattaaagaggacgtgtgattggaaagatatctgagataagagcagcgaacgagaggaaagaagaaattagtgatgaatgatcagaagaagacagggaagacgacttcctcctgctagctactaggaaatgttatcttccaagacagcttggttcctgtctagagtagctctgggtgggtaaatggagggagggccagtttgtaaataacgctgaaatttaagagactatatattatctaatttgaggctttgtcccaaatttggtttggagtgagtttttatgactaatctaccagtagggtgaaataaatagcatcattcatatcaggagtaccaaccaaccccataagagatattgaagagacaatgccaaccttccattctggagtaaagctatagtgcaagaaaacaatttgaaccaattattttcatactaagttgacagttaagacagaaaaaaatatatatattaagagccaagagatactgcatatggtctgcaagtcttttctggagaaatgaatcatgaagataaagagaactggcttatttttacagttacattttatatttctagaaaaataactacaacatggtcttgatgtctaaacatagggaaatgagacttttatgaacgttacacaacacaaaacataccacttgttgcagttacaactacgtgcaagtcattctcaagccttaactaaaaccaaaaacagataataaaacatatagttacaaacattattctaattgaactatactttgaaaatgactgaatgctcaaatattcttaaaatacaatgttctcttgccaagaaaagagtgttggtcttaaaatggccacaaaacctagccccgtcccatgttactagagctacagaatcaagcaccctccaaatatatggccaagcagccttggaggcacctaatgagtccaacgcagtcttcccatgtgtctcagaggctgctgtctgtagtgacagaggtgatagaatatggtaaagttgcgtatctaggaaaatctcaatgtagtccctgatttcccagagaatgttcttgtggcttatcctctgaggttagtagtttcagtttagtacattaattccaaacactaaagagatgaatccattcaagtcatttacagaaaaattgttttgagatttacccaaaaaacaaacacactataaagaatttagtaacagagaagattagaacttgcacttttgcttctgctggttcaagttttgttctgatattctctgcatttcctatttccatatgagaaaaccaccagtacatctttgctgtgtgaataccaacactgagaaatattggccaaacataaagatttttagagaattaatttttgatattcatctaaacaagccaatatattctcacaattttttaaagaaaaaaaaaagaactcagcttaatcatatatttgacttctaaaaaatcatctcatgattccatgaagatagagaaaaaatcagatgaacaggaatggttttcatttcacactggaattataagaaaggttaatttttgcataaaaattacatctacataaaaataatttctggaacaatgcattattgacagttatgtgggaagataaatgcattcacgtaaatgttctttctcaagcaaattactaaatatattgacagcactgcactttgaaaacaaccattttaaggcaaccaaatacatatacaagagtaaaaacattacatataatagccaatgtaatgtttcactcaatgcatattcactcaaatatgcatactttttttcagtttattgatatatactgctattaaattaaatagcaaacacttatgctttgttgttggctattgcccacagaaggaaaaaaatgggtagtcaactggagcctattcacacttctgttaattactggtggtccatggaagatgttatagtttgattactagcacttgtaaatattaaccaagtctaagttactgctataaaatccaaaatgtgtaaaaaccaaacacacctatacaaatacaaatgttttactcatgatcgttaatgactttaatcaagcagatcttctaattaattttgctaattgttcattcctctcaggacatttattggtttgatggatattactatgacatatgttgatgccagcatctggtcagaaatgagggcatcaataaactctccttggtgtttctacagaatgtgccaatgctataaacactgtcaatgccacagcatttatttcaatataagattttgagaacatgtctgcctttcatttagagaaaggataaacctacttcgaaacacacggtgctcaaatatgcttattcaatgaatggtgcaatgagaatggcttgataacaaactggaaaacatctgccaacatttaaaatagaataataacatcataaacgattattaggaatggcttcccccacaatgtactctgtcaatttataccctatttcgaatatgtagactaactttaaacaaatatagtaccgctatcttaaaggaagtgatcccctaaacatttctgaccaaaggtaatcatatgcagtaaattaatagacaagaaatgcatcagaattcgattcatgtatagaaatttggctaaacttgcaaacttttatgttgttagtaactattcagagattatcactttaaactgctgacaaataagtgcacttatgcagttttatttttaaaaactagttatcccaaaatatcatattaaataatacaccatgctgtatctatatttcaaaattattttaatggagatttgatctccaggtagaggcaaaacactgttttctccttctggcccccattagggaaactgtaacagtatggttgtctcccgtttctacacatgaatctattgtcactctactgtcatggcttaagaaaaaaatattgcttctactcaaggtgccaaactgcaccaagcaaagtaactccaatgcagtaacattaagtttggcaactgcaggacaaggtttccatccttgaacaaggagcactgatacttcactattttgccccccaacatcatatttccccctgcattctgaaggtttttttaaaaaatatttgtaacaatgtttttgtatgacactggcatcaagtctcccaggcagcatgcatctgttttaatttcatttgtattcgttactcctttcttctctatctgagtccaagagaatcactgctaacacacccagcactactcaggatagacaacgacagaatgaaacacttctgaggaagcctttccggtggcataatgccagcactactcattatagcctattttatcacagagccgtcaacattacggactcgaataacccagataccagcggcatccccttgcacgagctcatctgcggagtacaaggaatacagatttggaagaaacctctgagaggttttctaatctttcctctcttccttctgacttctaactttaacgtgagcccaccccaaagaagagaactagactctcttagtaacttgtgcaaaccttcagaaaagtcttaggttgtacctaaattcctcatgttgccattccaacactatttcctgtagttttccctttccagatgcaggagtccacagagcaagtatccttataagtgtctaagaatcatcaagcaattccaaagttcccgtgtctctaatctactgatccaacgtgcccggcgcacataagcagcaccgcgactgaatttcaagtcttctcaaactcacacctcagttgctcagagaggagaaatgcagcgaggactcgccttcctggccagtctctgaaaacgcgaaaccttcctgagctgtccatttgttttaggggctgtttataaacggctggttttcttggaggaaaaataaacaaataaatacggggcgatggcagcatcctgataaacacaggaccttgtttggcttttggcaagttgtaacctggagtaaaatcacatccaagttacaagcacgcaaattggaatttcgctggaaacactgacccgaccttcaccgaagcagcaaatcgcagtctctgctgctctgctcctgctctccaaggcttaacattggaaagtccatgcccacgtccccctctaattaatcaatgtagaaagaaatacgagggaagagagagggagcacactccacaccaaccttgccagcttctattcttcctgctattccttaaaggcgatgcacagcgcacctggaaattacgtggacttggcatggctttttaatattaaagacaaacgacctttggaaaatatacactgttaaagtcaaaccatttggagagacacccagcaatttacctcctcaaactcctcggaaccccaagaatgaggaaaggaaatggaaaatgcgcttaacccgggggtggtgggggaatcgataaccagaacaggtttgaaaaaaaaagcccccctcccgccccctccgtagagaccgctagctgaggctgcaacacctgccccggcaaagcgtctccgcagccttcccggcttgcccgactcggcttcctccgcctctgccccggctgcggcaccacttcttggagccacgtctcggcgagcgggggccgcggagcgagggggccgctgtgccgctactcacccgagccgctcgggctggccgcgagccgggatccgcgagggctggcgggctctggcccccgaggacgcagacatgtggcttgaacctccgctcccctagccgttgcctctgtgcatctttctgggcgcccccagcgaatgcgagcggcgaggcgagggcgagcgcgccgaggaagggcgggagaggcgcggagcttggccgcgccgcgctgcgccgagcgccgggctctccccgcgagctccccgggcccgcgcgcgcgccccccac
